United States Patent 10,760,091 (GENES AND USES FOR PLANT ENHANCEMENT) - sequence listing, part 3

SEQ ID NO: 7527 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFREDEHGEVVAESKRNDLEPYIGLHYPATDIPQASRFLFKQNRVRMIVDCYASAVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAIACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAIGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7528 - protein, 145 aa, Oryza sativa (japonica cultivar-group)
MGFSETQEELVLRSWQSMKKDSESIALKFFLRIFEIAPAAKQMFSFLRDSGDDVPLENHPKACESATQLRKTGDVKVREATLRRLGATHVKAGVADAYFEVVKTALLDTIKDAVPEMWSPEMKGAWEEAYDQLAAAIKEEMKKAA

SEQ ID NO: 7529 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 7530 - protein, 477 aa, Medicago truncatula
MENIAAQLKRGISRQFSSGSLRKTLSRQFTRQASLDPRRNNLRFSFGRQSSLDPIRRSPGDDEDQAELTVPENLDSTMQLLFMACRGDVKGVEDLLNEGIDVNSIDLDGRTALHIAACEGHVDVAKLLLSRKANLDARDRWGSTAAADAKYYGNTEVYYMLKARGAKVPKTRKTPMTVANPREVPEYELNPLELQVRKSDGISTGTYQVAKWNGTKVAVKILDKDSYSDPDTINIFKHELTLLEKVRHPNVVQFVGAVTQNIPMMIVREYHAKGDLTGYIQKKGRLSPSKVLRFSLDIARGMNYLHECKPDPIIHCDLKPKNILLDNGGQLKVAGFGTVRFSLITPDKALLEQPEANIDPSSLYVAPEIYRGDVFDRSVDAYSFGLIVYEMIEGIPPFHPKPAEEALKLMCLEGKRPQFKIKTKSYPPDLKELIEECWDPEPEVRPTFSQVIARLDKIVANCSKQGWWKDAFKLPWK

SEQ ID NO: 7531 - protein, 163 aa, Rhizobium leguminosarum bv. viciae 3841
MASLSGSISSLFLKEFVGAFFLSMRYFFRQKATINYPFEKGPVSPRFRGEHALRRYPNGEERCIACKLCEAICPAQAITIEAGPRRNDGTRRTVRYDIDMVKCIYCGFCQEACPVDAIVEGPNFEFATETREELYFDKARLLDNGDRWEREIARNIAIDSPYR

SEQ ID NO: 7532 - protein, 319 aa, Triticum aestivum
MAPMLKRIAQDEPKKAAYVTFLAGSGDYWKGVVGLAKGLRAVKSAYPLVVAVLPDVPEDHRQKLLAQGCLVREIVPVYPPESQTQFAMAYYVINYSKLRIWEFVEYERMVYLDADIQVYDNVDHLFDLEKGSFYAVKDCFCEKTWSHTKQYEIGYCQQCPDRVVWPERDLGVPPPPLYFNAGMFVHEPSMATAKALLDKLVVTDPTPFAEQDFLNMFFRDVYTPIPPVYNLVLAMLWRHPENIQLHKVKVVHYCAAGSKPWRYTGEEANMDREDIKMLVKKWWAIYDDESLNYKPAADPLRAALAEVVAVKSFPAPSAA

SEQ ID NO: 7533 - protein, 475 aa, Medicago sativa
MENIAAQLKRGISRQFSSGSLRKTLSCQFGTRLDPRRNNLRFSFGRQSSLDPIRRSPGDDQDQVELTVPENLDSTMQLLFMACRGDVKGVEDLLNEGIDVNSIDLDGRTALHIAACEGHVDVAKLLLSRKANLDARDRWGSTAAADAKYYGNTEVYYMLKARGAKVPKTRKTPMTVANPREVPEYELNPLELQVRKNDGISTGTYQVAKWNGTKVAVKILDKDSYSDPDTINIFKHELTLLEKVRHPNVVQFVGAVTQNIPMMIVREYHAKGDLTGYIQKKGRLSPSKVLRFSLDIARGMNYLHECKPDPIIHCDLKPKNILLDNGGQLKVAGFGTVRFSLITPDKALLEQPEANIDPSSLYVAPEIYRGDVFDRSVDAYSFGLIVYEMIEGIPPFHPKPAEEALKLMCLEGKRPQFKIKTKSYPPDLKELIEECWDPEPEVRPTFSQVIARLDKIVANCSKQGWWKDTFKLPWK

SEQ ID NO: 7534 - protein, 662 aa, Rhizobium sp. NGR234
MAHSSDLALFRHRIAEALPSANVPTLLLLLYQFTGKEYWLTPPFLPVKSVWGDNDSGGLAAELQTEIRNAALDAIICWHSGAPVTKQDLSEEELIRMLTVSEAEPIPPEYADMMLHKLRRYAGAIPDPVSLPKGFRVLIIGAGMSGVAAAIRLRQLGISYIQVEKQDSTGGVWHAHHYPGCGVDTPGHLYSYTFASGNWSTFFPLQKEIDDYFNRVARDFGIESSIRYGTECLVTRYDEESLTWHSRLRLPNGTEETLVTNVVLSAVGGFTTPKWPNLSGLRNFDGPVVHTSKWDPEVALDGKRVAVIGNGASAMQVVPAIADRVGALTIFQRSRQWVAPFPKFQKPVPEPMQFLFREVPHYEWLYRLRLSWIYDSEVHEALQKDPAWPHPDRSVNAVNDRDREAYTQYIEGQLAGRPDLIAKVIPSYPPFGKRMLLDNGWYRTLLKPHVTLVDGAAARVEGRSIHAIDDETHEADLIIVASGYDTTRYLLPVEVIGRNGRTVRDVWDDDDCQAYLGTVVAGFPNFFMLYGPNTALGHRGSFIFTIESQIDYVLSVLRQMGEKRLVEVECRQDIYQHYNRKIQQMHQQMIWSHEGMSTFFRNDRGRIVTNSPWRLVDYWNLLKEADLDDYRTMPQVDSRLETSGVPREGVQRPGSRLRRRPS

SEQ ID NO: 7535 - protein, 472 aa, Escherichia coli CFT073
MSTIFDVAVMGGGPGGYVAALRAAQNGLSVVCIDDGVNAQGEPSPGGTCLNVGCIPSKSLLQSSELYAQVQHEASIHGVNVDGVSFNAAAMIQRKDAIVSRLTMGIGLLFKKNKVKYLCGLATLEHARDEIWQLRVNDQQIRARNVVIATGSQPRQLPGVTIDNQQILDNRGALALTAVPPRLGVIGAGVIGLELGSVWNRVGSDVTLLEMAPTFLPALEARLSNEVRKAMIASGMKMQLAVEIEAIEQRDDGVHVRWRQGEKREESRFDKLILAIGRVPRLSGVDLVQLGLEADNRGGIAVDNLCRTGKAGLWAIGDVVRGPMLAHKAMAEGVVVADQIAGLAVEPINFALIPSVIYTQPEVAWVGENEASLKAAGRVFNKGNSLFAGNGRALALGQEGGRCTLYSDKHTDRVLGGAIVGPQASELINEIALAMTFSASGEDIACAIHAHPTLSEVIHEAAMALNNKALHG

SEQ ID NO: 7536 - protein, 243 aa, Lotus japonicus
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYEALQRSQRNLMGEDLGPLNSKELESLERQLDSSLKQIRSTRTQFMLDQLSDLQRKEHMLSEANRSLRQRQLEGYQLNSLQLNPGVEDMGYGRHPAQTHGDAFYHSIECEPTLQIGYQPDPVSVVTAGPSMNNNYMAGWLP

SEQ ID NO: 7537 - protein, 524 aa, Mesorhizobium loti MAFF303099
MSTPSRPSRCRYSQEARETVPMNAPLNIAMPAEASAAPKNYRLLIDGKHVDARDGRTIARKSPGHGFTVSRYAQAGEAEVEAAVQAAHKAFETGPWPRMKAGERAAILFRAADLIEARLEDIARLDALESGKPIAQARGEIGGAVDIWRYGASLARTLHGESYANLGDAMLGVVLREPIGVVSIITPWNFPFLIVSQKLPFALAAGCTAVVKPSEMTSASTFVLGDILLEAGLPAGVVNILAGLGADVGAPMVSHPLVEMVSFTGSTRVGKMTMASAAQSLKKVSMELGGKNGQIVFPDADLEAAADAAVFGGFFNAGECCNAGSRLIVHEAIADDFLSAVKALTARVTVGDPLDDQTKVGAMISSDHLAKVTDYVTAAAGEGSNVYSGGKQLASNAGQYLDPTIIRGVTEDMAIAREEVFGPVLSVLTFESIEKALHIANNTPYGLSAGVWSASIDTCMSVARGVRSGTVWVNTFMEGYPELPFGGYKQSGLGRELGKRAVEDYTEEKTIQFHRGQRTGWWVG

SEQ ID NO: 7538 - protein, 968 aa, Oryza sativa
MAPPENPNGAGPAAPSDPAQPQPQPPAKSKWKKKDEKKDDDLSEEDLALKEQLELYVVRAQDADPGVQKLALESMRQEIRSATSSMTSVPKPLKFLRPHYGTLKSYFETMPESSDLKRYMADILSVLALTMSAEGERESLKYRLLGSEGDIGSWGHEYVRNLAGEIAQEFQKRQDDDMPIDALMELVQQIVSFHMKHNAEPEAVDLLMEVEDLDLLVEHVDSTNYKRTCLYLTSSSKYLPAPDDMLALDIAYTIYMKFEDLTSALRIALLLDNKSMQYVKQVYTATEDLQLKKQFSFIIARHGLAMEIDDEIAADGNDKEGLQEIVNNSKLSEGYLTLARDIEVMEAKSPEDIYKVHLIDGRGASSSLDSARQNLAATFVNAFVNAGFGQDKLMTAPSDSSSSGASGNWLFKNKEHGKASAAASLGMILLWDTDSGLAQLDKYLHSNDAHVVAGALLGIGIVTCGVKNDCDPALAILMEYINKDDTNIRIGAILGLGIAYAGSQKEELKSYLSTVLGDSEKSTLEVLIFSAIALGLVFVGSCNEEIAQSIIFALMERSEAELAEPIIRLLPVALGLLYLGKQESVEATAEVSKTFDEKIRKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGFIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTSVLEGFVILKKNPEYNEERGILGNHAATWDRIFAYWVPSSAPPGVNRIGLLSLLPESRVLEQSSLNSEILFGCAMTDVTYHLYPNMGI

SEQ ID NO: 7539 - protein, 1126 aa, Arabidopsis thaliana
  misc_feature (722)..(722): Xaa can be any naturally occurring amino acid
  misc_feature (733)..(733): Xaa can be any naturally occurring amino acid
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFREDEHGEVVAESKRNDLEPYIGLHYPATDIPQASRFLFKQNRVRMIVDCYASAVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAIACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAIGKSLVRELIYKEYKETVDRLLSXALKGDEGKNVXVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWPSPEGLGLSVCR

SEQ ID NO: 7540 - protein, 187 aa, Brassica napus
  misc_feature (28)..(28): Xaa can be any naturally occurring amino acid
  misc_feature (31)..(31): Xaa can be any naturally occurring amino acid
  misc_feature (152)..(152): Xaa can be any naturally occurring amino acid
MPAGGFVAGDGQKAYPGKLTPFVLFTCXVAXMGGLIFGYDIGISGGVTSMPSFLRRFFPSVYRKQQEDATTNQYCQYDSPKLTLFTSSLYLAALISSLVASTVTRKFGRRLSMLFGGILFCAGALINGFAQHVWMLIVGRILLGFGIGFANXQSVPLYLSEMAPYKYRGALNIGFQLSITIGILVAE

SEQ ID NO: 7541 - protein, 1164 aa, Arabidopsis thaliana
  misc_feature (647)..(647): Xaa can be any naturally occurring amino acid
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMCSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGMTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVXQGMQEIGAVAREMVRLIETATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFSFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSIAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7542 - protein, 934 aa, Cryptococcus neoformans var. neoformans B-3501A
MRTLPLTRRPFITRRCLTTLGLRREDPSRIWERRTPLTPHAVQSLLADAKDQLKVEVESCKRRCFPDSLYSDAGAKIVPSLSKDVDVILGIKEPRLSDIRNLVEASKNEGKKRTWMMFSHTHKGQEYNIPLLSAFLHPTQTLIDHELLTAPAPGKDGKPQLKRVAAFGWFAGAVGAGEALSLTGLALLRRGLATPLLSLSRPYSLGSLAAFKEALKKAGEEVKTSADLKGQEPIVIGVTGAGNVSSGATEMLNELGVVWVGPEDLADLRQSGSPNKIYACAITPASYLQRIEGGIFDKQEYYKSPDKYMSIFAAKIAPHLTTLINGVGWSKGFPRAITRPSLNKLIEKENGKQKLVAVQDITCDKEGGLEFVDQFTTVDNPYFEGPGDILISAIDILPTELAADASSYFSSALYPYIQGLLFPSGQGDKNDITETLSRAAIVKDGVLQSQHEWLGGKIEQWKTGGAVAPDSLKQEKLRKGGKKKVLLLGSGLVAGPAVDVFAARPDVHLIIASNNLAEGQSHIRGRPNVEAMALDVADDASMSEIVEEADIVVSLLPAPMHLRVAKHCLDHSRHLVTASYVSPELQALHSQAIEKDVIFLGECGLDPGIDSMAAMRILERAKREGKQVKSFVSWCGGLPELSASKVPLRYKFSWSPKAVLTAAQNDASYKLEGKHVKIPGNELLARRFPEVKLWDGLPLEGLANRDSMPYAKKYGLGPAEGLTDLFRGTLRYQGFSSLLESFRLLGLLRSDPLPGSPKSWTEFLSMTVERELGLSKGLKGEDVNSAVQDLVGEGSKDVIRALKLFSLFPGSDTSLLPLPNLSTPSPIDFFAHLLSRKLAYLPDERDTCLLHHSFTISTPSGDTQKVTASLRHMATPTQSSMSITVGKTLAFAALRIADGEVKVRGVTGPYEPEVWAGVLSSLEGAGVVIEEKWH

SEQ ID NO: 7543 - protein, 1164 aa, Arabidopsis thaliana
  misc_feature (665)..(665): Xaa can be any naturally occurring amino acid
  misc_feature (699)..(699): Xaa can be any naturally occurring amino acid
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIXTATVPIFAVDIDGCINGWNAKIAELTGLSVEDAXGKSLVRELISKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7544 - protein, 175 aa, Oryza sativa (japonica cultivar-group)
MDSSNNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVAAAAAAAEWDDDGFDAGLFGFGDEVSALRHETMPAV

SEQ ID NO: 7545 - protein, 1164 aa, Arabidopsis thaliana
  misc_feature (1116)..(1116): Xaa can be any naturally occurring amino acid
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDALGKSLVRELISKEYKETVDRLLSSALKGDEGKNVEVKLKTFGSELQGKAMFVVVNACSSKDYLNNIVGVCFVGQDVTGHKIVMDKFINIQGDYKAIIHSPNPLILPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTXPEGLGLSVCRKILKLMNGGVQYIREFERSYFLIVIELPVPLMMMMPSS

SEQ ID NO: 7546 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIKTATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7547 - protein, 877 aa, Clostridium tetani E88
MESKKYVYLFKEGNAKMKNLLGGKGANLAEMTILGIPVPQGFTITTEACTKYYEDNKKLSDEVISQIYKALEEIEKETKKSFGSIDNPLLVSVRSGARVSMPGMMDTILNLGLNDDTVKAISRLTNNERFAYDSYRRFIQMFSDVVMGLDKRMFEDILEEVKKSINAKFDTDLSAENLKKIVEKYKEIYKKEVGEEFPQDPKIQLLESVNAVFRSWDNPRAIVYRRLNDIPGSWGTAVNIQTMVFGNMGDTSGTGVAFTRDPATGENKIFGEYLINAQGEDVVAGIRTPQAITKLKEDLPSCYEEFVNIAGKLENHYRDMQDMEFTIEQGKLYFLQTRNGKRTAQAALKIAVDMVNEGLITKEEALLKVEPKQLDTLLHPNFHEGELKKATFIAKGLPASPGAACGKVYFTAEEAKEKHELGEKVVLLRVETSPEDIEGMIAAEGILTVRGGMTSHAAVVARGMGKCCVVGCDDIEVFEKENTFQIGRIKFKKGDYISIDGSTGKVYGEAIKTVSPEISGYFGIFMKWADGIRSLKIRTNADTPKDSNQAVEFGAEGIGLCRTEHMFFDEKRIPAVRQMIMADNEDQRREALEKLLPMQREDFVGIYEAMEGRPVTIRFLDPPLHEFLPTEDEDLKELAKDMGVTFERVKYEIESLKEFNPMMGHRGCRLSISYPEIAEMQTRAVIEAAIDVKNRKGYNIKPEIMIPLVGEVKELKFLKDIVINVANKVIEESGVELEYFVGTMIEVPRATIVADEIAKEADFFSFGTNDLTQMTFGFSRDDAGKFLNNYYDNKIYDFDPFQKLDQKGVGQLVQNACELGRKAKENIKLGICGEHGGDPASVEFFHKVGLDYVSCSPYRVPIARLAAAQAEVKYPRK

SEQ ID NO: 7548 - protein, 472 aa, Myxococcus xanthus DK 1622
MATQRKSRPHSRSAPKKSGAPSGKKPSPSERPERPLREDLVLQACLEAYGSVRHEGRMADRALDFTLRRKANLYSNERRAVAERVYGLLRRQRTVDFLLSRAHPRFDSLETSRQDVLRLAASRVLYGEPHGLVARQSALAPPDAQALGALPEAAAALEALPARERFPIAASLPDFLADRFLQTFGRDAARAAEAMNERAPLVARANLLKGDRDALAQRLKAETVDVKPTPLSPMGLVLETRINAFSLESFREGMLELQDEGSQLLGMLVDAPPTRVVDACAGAGGKTLQLAAQMKNRGDLHALDIDERRMEDLKKRARRAGVHNVRAQLIPHEGPEADAALTPLKGKADRVLVDAPCSGTGTFRRKPDARYRLTPEDLEMHVGRQKALLARFATLVKPGGRLIYGTCSVLREENENVVEDFLAKHPEFTVKPVAELLGAELAEKVGPGPFLRLAPHTHGTDGFFGAVLVRAK

SEQ ID NO: 7549 - protein, 430 aa, Heterocapsa triquetra
MIKSLFAREILDSRGNPTVEVDLVTESGISVRAAVPSGASTGIHEACELRDGDKGRYLGKGVKKAVEAVNTVLASALKGADVSEQKALDAKMCELDGTPNKGKLGANAILGVSLAAAKAAAEAKGVPLYKHFGDLAGNPGPVVLPVPCFNVVNGGSHAGNKLAFQEYFIIPVGAETFTEAMRIGAECYHTLKGIIKKKYGGDATLIGDEGGFAPPCDAREGVELVMEAIEKAGYKDKCKIGMDVAASEFKVEGQDCYDLGTWYPDGEKDAPGLKMTGAELADFYAKLCQDFPIITIEDPFDQDDWASWKLFTEKVGGPCQVVGDDLTVTNVTRVKKAIDDKACNALLLKVNQIGSVTESIDAVKLCKQSGWGVMTSHRSGETEDVTIADLAVGLCTGQIKTGAPCRSERNAKYNQLMRIEEELGDKAVYA

SEQ ID NO: 7550 - protein, 186 aa, Oryza sativa (indica cultivar-group)
MAARRGRGRGREWEDDDLGVGGGQQPPHLAAPVVCLARSAGDLAAGAFVGSLVGYGQGLLTNKGMKGSLSSAGSSAKHIKSKRLVMTIPSVAVINAGVAGCCTGLALSFPGAPQAMFHSCVTFAAFSCIMDGLNKQQAAMAATLASKPSTIKHQEGDVLPPFTLPPLLNASDALASCCQAFLKPKD

SEQ ID NO: 7551 - protein, 121 aa, Glycine max
MNARGYRSTRTALFDGIEEGGIRSSAYSSHEIDEHENERAMDGLQDRVSILKRISGDINEEVETHNRMLDRMGNDMDSSRGFLSGTVDKFKTVFETKSSRRMGTLVASFVALFMLVYYLTR

SEQ ID NO: 7552 - protein, 197 aa, Candidatus Fritschea bemisiae
MKGIKFKSASFLTSALKGEELPRLNLPEIAIVGRSNVGKSSLINHLLNAKGLAKVSSTPGKTQRINYFIVDEALLLVDLPGYGYAAASKQIQKNWGLWIDTYLKNRELKGLLFLLDSRRELTREDAQFLRWASYENLSLLLVLTKADKLSQKEKHGALKRIQEEKTLSEFPMVLYSIKRGACRNFLIDAINKMLWGY

SEQ ID NO: 7553 - protein, 400 aa, Prototheca wickerhamii
MALEKIITAPKYKNFTINFGPQHPAAHGVLRLVLEMNGEVVQRSDPHIGLLHRGTEKLIEYKNYLQALPYFDRLDYVSMMCQEHAYSLAVEKLLNISKDIPLRAQYIRVLFSEITRILNHLLAVTCHAMDVGALTPFLWGFEEREKLMEFYERVSGARMHAAYIRPGGVALDLPLGLCEDIYKFSKQFASRIDEIEEMLTSNRIWKQRLVDVGVVSAEQALDWSFSGVLLRGSGIAWDLRKTQPYEVYDRMKFNIPVGTRGDCYDRYLIRVQEMRESLRIVMQTINEMSKGIIRLDDRKITPPTRDQMKQSMESLIHHFKFYTGGFVVPAGETYTAVEAPKGEFGVYLVSNGTSKPYRCKIRAPGFAHLQGLDFMARNHMLADVVTIIGTQDIVFGEVDR

SEQ ID NO: 7554 - protein, 543 aa, Brucella suis 1330
MTVKTIATTPYQDQQPGTSGLRKKVPVFQQPNYAENFIQSIFDVLEGFKGKTLVVGGDGRFYNREVIQKLIKIAAANGFGRIMVGQGGILSTPAASNMIRKYKAFGGMILSASHNPGGPTQDFGIKYNIGNGGPAPEKITEAIFARSKVIDQYKIADAADIDIDKIGTSKIGDTEVVIFDPVADYAELMESLFDFAAIRAMIKGGFQMKFDAMHAVTGPYAKEIFERRLGAPEGSVVNFVPLPDFGGHHPDPNLVYAKDLYDLLMSSHAPDFGAASDGDGDRNLILGRGIFITPSDSLAMLAANAHLAPGYKGGIKGIARSMPTSAAADRVAEKLGIGMYETPTGWKFFGNLLDSGKVTICGEESSGTGSDHVREKDGLWAVLLWLNILAVRKESVKAIADDHWARFGRNYYTRHDYEAVDSDIATKLVADLRGKLAGLPGTSVNGLRIEKADDFAYHDPVDGSTSEHQGIRIYFEGGARIVLRLSGTGTSGATIRIYIERYEADPAKHNLDTQATLAPLIDAAEQIAEVKKRSGRTEPSVVT

SEQ ID NO: 7555 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAIEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVLAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIKTATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7556 - protein, 884 aa, Anaplasma marginale str. St. Maries
MSELLIYHFSKSKCDGGSHLANLLGNKGAGLAEMCRIGINVPPGFTIPTSVCGHYHKHGKLPEGLFQQLQKALQHLGNEISLEFGNPDRPLLVSVRSGSVRSMPGMMDTILNVGINDEIVEGLKRAYSERFAYDSYRRLIQMYATTVMQLDNHLFEEGYDRKCRELSLLPGGPIADVSALSELVTEFKHLVLKHGGAEFPQNVHEQLYNAIGAVFRSWMNSRAVAYRKVYGISSEIGTAVNVQSMVFGNVSQNSATGVVFTRNPSTGAKEIFGEFLINAQGEDVVSGNKDPAPISLMERVMPRVYGELVEVCHKLEQSYKDMQDVEFTVQDGKLWILQTRAGKRSAQAAVHLAVAMVKEGLISREEAINRIDHTTLSGLLHPVLDGGSDNAVVCRGLPASPGAASGCVAFTSSDAESLKKQGKNVILVRQETSPEDIGGMSSSVGILTLRGGMTSHAAVVARGMGKPCICGTSGLFIDKSGEFFYNGEGLKVAQGENITINGSTGEVMLGTVKTVTPQLPESFSELMSWVDEVRTIGVMANADTPEDMKTAKQFGADGVGLCRTEHMFFSDGRIATVQEMIVAGDKQERDNALAKIEIMQKNDFKEMCACMQGKQITIRLLDPPLHEFLPTSREVLEDIAKRIGKPLEHVRNRVSALSEKNPMLGHRGCRLAISYPEIYEMQVRAIFQAVGELREEGIAEVVPEIMVPFVMDEGEITRVGDLVRRVAEQFNNAPYSIGVMIELPRAALLADRLAKHVQFFSFGTNDLTQTTLGMSRDDSSKFVEHYTSAGILRSDPFELLDEQGVGKLIEITMKLARESGAKIKTGMCGEHGGTLEAMQLCAKLGIDYVSCSPYKVPVAKLLAAKCAIACKQLTLSNGAVTQSS

SEQ ID NO: 7557 - protein, 1164 aa, Arabidopsis thaliana
  misc_feature (470)..(470): Xaa can be any naturally occurring amino acid
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVEILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTXRPSIMDLVKCNGAAFLYQGKYYSLGVTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7558 - protein, 1165 aa, Arabidopsis halleri
  misc_feature (585)..(585): Xaa can be any naturally occurring amino acid
MVSGGGSKTSGAEAASSGHRVNRSRHTSAEQAQSSASKAQRSQNQQPQNHGAGTESTSKAIQQYTVDARLHAVFEQSGESGKSFDYSQSLKTAPYDPSVPEQQITAYLSRIQRGGYTQPFGCLIAVEESTFTIIGYSENAREMLGLMSQSVPSIEEISEVLTIGTDLRSLFKSSSIVLLERAFVAREITLLNPIWIHSKNTGKPFYAILHRVDVGILIDLEPARTEDPALSIAGAVQSQKLAVRAISHLQSLPGGDIKLLCDTVVDSVRDLTGYDRVMVYKFHEDEHGEVVAESKRDDLEPYIGLHYPATDIPQASRFLFKQNRVRMIVDCYASPVRVVQDDRLTQSICLVGSTLRAPHGCHAQYMTNMGSIASLAMAIIINGNEEDGNGVNTGGRNSMRLWGLVVCHHTSARCIPFPLRCACEFLMQAFGLQLNMELQLALQVSEKRVLRMQTLLCDMLLRDSPTGIVTQRPSIMDLVKCNGAAFLYQGKYYSLGVAPTEAQINDIVEWLLANHSDSTGLSTDSLGDAGYPRAAALGDAVCGMAVACITKRDFLFWFRSHTEKEIKWGGAKHHPEDKDDGQRMXPRASFQAFLEVVKSRCQPWETAEMDAIHSLQLILRDSFKESEAMDSKASAPGGVQPHGDDMAEQGLQEIGTVAREMIRLIETATVPIFAVDIDGCINGWNAKIAELTGLSVEEAMGKSLVRDLIYKEYEETADRLLSCALKGDEGKNVEVKLKTFAPELQGKAVFVVVNACSSKDYLNNIVGVCFVGQDVTGHKIVMDKFINIQGDYKAIIHSPNPLIPPIFAADENTCCIEWNTAMEKLTGWPRSEVIGKLLVREVFGSCCRLKGPDALTKFMIVLHNAIGGQETDKFPFPFFDREGKFIQALLTLNKRVSVDGKIIGAFCFLQIPSPELQQALEVQRRQESEYFSRRKELAYIFQFIKNPLSGLRFTNSLLEATDLNEDQKQLLETSVSCEKQISKIVGEMDVISIGDGSFLLERTEFFIGSVINAVVSQVIFVVRERNIQLIRNIPAEIKSMAVYGDQIRLQQVLAEFLLSIVRYAPLEGSVELHLCPVLKQMADGFSAIRLEFRMACAGEGVPPEKVQDMFHSSRWTSPEGLGLSVCRKILKLMNGGVQYIREFERSYFLIVIELPVPLMMMMPSS

SEQ ID NO: 7559 - protein, 1045 aa, Cleome hassleriana
GESGKSFDYSRSLKTTTYGSSVPEKQITAYLSKIQRGGYIQPFGCMIAVDESTFKIISYSENAREMLGLMPQSVPSIEKPEILAIGTDVRSLFTPSSTVLLERAFVAREITLLNPVWIHSKNTGKPFYAILHRIDVGIVIDLEPARTEDPALSIAGAVQSQKLAVRAISQLQSLPGGDIKLLCDTVVESVRDLTGYDRVMVYKFHEDEHGEVVAESKRADLEPYIGLHYPATDIPQASRFLFKQNRVRMIVDCHATPVCVIQDERLTQPLCLVGSTLRAPHGCHAQYMANMGSLASLAMAVIINGNEEEAGSVAGGRNSMRLWGLVVCHHTSARCIPFPLRYACEFLMQAFGLQLNMELQLALQMSEKRVLRTQTLLCDMLLRDSPTGIVTQKPSIMDLVKCDGAAFLYQGRYYPLGVAPSEAQIKDIVEWLLANHGDSTGLSTDSLADAGYPGAATLGDAVCGMAVAYITRKDFLFWFRSHTAKEIKWGGAKHHPEDKDDSQRMHPRSSFKAFLEVVKSRSLPWENAEMDAIHSLQLILRDSFKESETVNTRVAVRADQPGGDMAVQGLDELSAVAREMVRLIETATVPILAVDVEGRINGWNGKIAELTGLSVEEAMGKSLVRDLIYKEYEETVEKLLSHALRGEEDKNVEIKMKTFSRELEGQAVFVVVNACSSKDYLNNIVGVCFVGQDVTGQKIVMDKFIHIQGDYKAIVHSPNPLIPPIFAADENTCCLEWNTAMEKLTGWSRAEVIGKMLVGEVFGSCCRLKGPDTLTKFMIVLHNAIGGEETDKFSFPFFDRNGKFVQALLTANKRVSIDGKITGAFCFMQIPSPELQQALAVQRQQETECISRAKELAYICQVIKNPLSGLRFTNLLLEATGLSEDQKQLLETSVSCEKQISRIIGDMNLETIEDGLVEVEKEEFIMGSVINAVVSQVMMLVRERGLQLIRDIPEEIKTMAVYGDQMRIQQVLAEFLLSIIKYAPSQGWVEIHLNPILKHLPDGSSSLRSEFRMACGGEGLPPELVRDMFHGSRWTTPEGLGLSVC

SEQ ID NO: 7560 - protein, 395 aa, Candidatus Fritschea bemisiae
MDKLSLRDLKLNQKRVLMRVDFNVPLNADGSIRDATRIILTLPSIEYILRQKGRLVLISHLGRPKGSFDSKVSLRPCAQKLGELLGKEVGFCFDCIGAEVQKRVQNLNPGEVLLLENLRFHKGEESPEKDPGFAQSLAELGDVYINDAFGAAHRSHASIVPIAQFFPANCGVGFLMEKEIAAFSKIYLNPNRPFYAMVGGAKIGNKIDILQALSKRVDGLFIGGGMAFTFFKAKGLAIGESICDESRLKFARDFLKECERKGIRLHLPIDVVVTNGKKIQTVQIKGGVPDKWEGKDIGPQTVELWSKELNRGATLFWNGPMGVFEERAFASGTERLAHFLSEVPGDVTIGGGDLVAAVQSLNLEKKLSHVSSGGGASLEFLANGTLPGVEALSNK

SEQ ID NO: 7561 - protein, 114 aa, Clostridium tetani E88
MEDCIFCKIVKGDIPSEKVYEDELILAFKDISPSAPTHVLVIPKKHIKNLNELSDNDAKIISHIYIKIKELAQQLDINEKGYRVVTNCGEQGGQTVEHIHFHLLGGRNLQWPPG

SEQ ID NO: 7562 - protein, 567 aa, Arabidopsis thaliana
MGRGRKHTDAAAEQRELAIKASLKFFRRFRSIGKAAWEWDESQVLSGRCAETDGTWLGISIRGRVAFLVEAGPVNRDRIIGAECRTLDFLKSNLSPEDFADSLALDSGRNTGIAYHLIVADIVSNSMFYIYKPSLSEDGMVYTEPVGPGVHTLSSAGLDSEVGHRDLRLKRYFSERINRELPEPISGLAEEVMYDTVEAINGDPLSSIFVVDTLIENEHYGTRCTTALVVRRTMQVRFFERYRARFNDDWNVHDFRFTVFKVIVNFLGGSCSGLLLLFIDGLFLANPLTKRFRPLNHSGSKLLSPIFGRNSQITSRDDGIEDYKARKERRMRVGFVVSPTKGFKIVCILEMETVYGFEISDGDSWRLSETTITTSSKSLLTTWMKPVYLDGTLHWLRNDGSIIAFDPETEQARFVPSVFHRGGPGTKLIFTEDSKKNRLTLISGTKETISVYTLVNNSKWDLTRQIANVYVNEIDLLCWQLIVCDGKCLVVVENTHSGYGVVHVYDLEANSWKVSGSNEFMGMSIGDFYKFTPSLVFVEGDEQEIIASTEKRIISALTAVMGLTDRT

SEQ ID NO: 7563 - protein, 354 aa, Zea mays
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHPTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 7564 - protein, 130 aa, Oryza sativa
MAGKASIALFLAVNLVVFSLGSACGGRCPTPTPSTPSTPTPTPAAFGKCPRDALKLGVCANVLGLIKAKVGVPPAEPCCPLLEGLVDLEAAVCLCTAIRGNILGINLNLPVDLSLILNYCGKRVPTGFKC

SEQ ID NO: 7565 - protein, 321 aa, Gibberella zeae PH-1
MTGLNYDPEYFKAIGSPPKGPRADPPKTAHEMRSNIENTIGIFVTNSPYPSGVKETVYKVKSLDGTEIEVTRFTCEETLASEKPTPAVVYFHGGGFVACTVPPFAPQIARFANDSKLPYFAVDYRLAPEHPAPAALEDAWAAIQFVSKSAAEFNIDPARIALYGDSAGGGLTAGAALMARDRHLDPPIAKQILIYPMLDDRYNLKDDDPYLEVLAMRPAGAKVAWDAYLSKLREGDDAQALSYAVPARAATLKGLPSTYIDIGSLDLFRDESLRYANRLADEHVEVEFHLWPGLPHGFDGLRELSWYTRATESRVSALKRM

SEQ ID NO: 7566 - protein, 630 aa, Candida albicans SC5314
MGVLGKIFSSSSNLAQLEHQQKQQQQQQPPPSTKLLSKQSPPQPPPPVKTKPSPSNGTTVPDEDDEILSQVENDIVTPLRQIKQPQPQHPTSVNTPTVNSIRSNNSSPRLIKTRSVSPSNGLSSSTTSPMSLELLEDKLKNHQIASPTGSSTQPVAISSNDKPSTGRPSPTVSRTSSFRKPPSRATSVKTRSNSVSSTNLSGSSTNTNPVNNLPRFVMLESGNHEHHLRSAKRQEKLSNMLKDLLGAKKLRGEAKSAVPDIFQGAMQSSTSQLSQQQQQQPQPVKPPTLFAGLVNSVKNSTSPYHQPGTTDVVCSTPLSAATGTSANGIDCRSFAEKYGRCQEVVGRGSFGVVRISHKKLDSTSTTEKLFAVKEFKRKPNESEKKYNRRLTSEFCISSSLKHNNIIDTLDLLKDAKGDYCEVMEFCSGGDLYTLIIAAGKLEYAEADCFFKQLIRGVNYMHDMGVAHRDLKPENLLLTQNGVLKITDFGNSECFKMAWENEIQYSDGICGSSPYIAPEEYNQESFDPRCVDIWSCGVIYMAMRTGRQLWKLADPKKDEFFEEYLVKRKESSGYEPIESLKRARCRNVIYSILDPKPERRITGKQILSSEWGREIKVCEAGEGHLNELGKQ

SEQ ID NO: 7567 - protein, 759 aa, Bacillus cereus E33L
MNTPTQTPSLSETMKEWHYALAYEIKHWKTIGGSKISIMNGRFLYTDYENTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHIEKMKNPKNELAYRAFYNPTTYVWGPPGTGKSYNLSRIISAHYQKGKSVLVLAHSNAAVDVLMSEVTKQIEKKKKWTPGEIVRYGYSQHEHIRNHETLLASKLVETTNGSWGEERLYLEETRQELREKILSYKATSADKKRMQEIESDLRKQRAKIKEVEKEYIENAKVIGATLSKCAIDSLIYERTFDLVVVDEVSMAFVPQIALAASLGKRIVVCGDFLQLPPIAMANHELVRKWLGEDMFYHAGIVESVNKSEAHPNLFMLQEQRRMHADISKFTNSFIYKNRVYDHPSVSERKELAQLQPFAKEASVLFDTSQMGAFSLKDAASGSRFNIMSGLVAMQMMLIGLLDGVQSIGVVTPYRAQSRFLSTCIREMLQRTKYQNIPVLAATVHKFQGSERDMMIFDTVDSYPQERPGVLFFDHKNHRLVNVAVTRARGKFIQLSDCHYMRKNLSRKQALSQLTAHIERHGDVYDRTTSRQLWERKISKRLRWFMEMNLEEPKGLLKDILAAKRKIVISLPSTKQVDKRVWQALMRTNAQITVYSDGPVPLKNVKLQRQNKAFPFIVIDDEIFWAGAPLTSQMMFEGSTEFPYVCARLQAPETIGVLKGFLDIR

SEQ ID NO: 7568 - protein, 532 aa, Magnaporthe grisea 70-15
MSNFSFQLNSIALLITLTALLLIYKLLNSFVIRPLHNHLAARRLNCGSLPTEPSKWPFGIDTVLRGLQADRDQQMPDYVASRFAAMGRYTWRISVLGTSNIITAEPRNVQALLATQFDDFSMGDARTTNLRILLGRSIFAVDGAAWHGARETMRPLFARDNVSNVELLEGNFQKLLRCIKQELHKDAEGRLWTAPTSLAALLPSFTLDSASEAFLGSSAGALDARLDGSAQPHLLWALERMAPLLRVRFALRGLYFLYGTRELRRCADAMHAFVDAAMTRADDALKQDHDGQHLGGKRFEFLQKLRARCADRAEVREQVLGLLAAGTDTTAALVGWVFYSLIRHPRVFARLREAVLEDFGATGRQVTFERLKSCRYLQQVLSETLRRHSVVPLNSRRARRDTTLPTGGGADGTQRVFVPAGTEVNFSTHVLHRRGDLWGRDADDFRPERWAERRPGVFHYVPFNGGPRICIGQQFALTEAGFVVVRMLQEFDAVEGLHVDPERDWHNFGITCSPGSPEDRHAGVTCRLRLAS

SEQ ID NO: 7569 - protein, 489 aa, Mycobacterium tuberculosis H37Rv
MALWGDGISALLIDGKLSDGRAGTFPTVNPATEEVLGVAADADAEDMGRAIEAARRAFDSTDWSRNTELRVRCVRQLRDAMQQHVEELRELTISEVGAPRMLTASAQLEGPVGDLSFAADTAESYPWKQDLGEASPLGIATRRTLAREAVGVVGAITPWNFPHQINLAKLGPALAAGNTVVLKPAPDTPWCAAALGEIIVEHTDFPPGVVNIVTSSSHALGALLAKDPRVDMISFTGSTATGRAVMADAAATIKKVFLELGGKSAFVVLDDADLAAASAVSAFSACMHAGQGCAITTRLVVPRARYEEAVAIAAATMSSIRPGDPNDPGTVCGPLISARQRDRVQGYLDLAVAEGGRFACGGARPADREVGFYIEPTVIAGLTNDARVAREEIFGPVLTVIAHDGDDDAVRIANDSPYGLSGTVYGADPQRAARIASRLRVGTVNVNGGVWYCADAPFGGYKQSGIGREMGLLGFEEYLEAKLIATAAN

SEQ ID NO: 7570 - protein, 137 aa, Glycine max
KVVLFQIGEIISRFDRKGFYLKGLKLVTVDRPFAEKHYADLSAKPFFSGLVDYIVSGPVVAMIWEGKNVVTTGRKIIGATNPAQSEPGTIRGDFAIDIGRNVIHGSDAVESANKEIALWFPEGPANWQSSQHSWIYE

SEQ ID NO: 7571 - protein, 398 aa, Arabidopsis thaliana
MTMMMSDLPNDLVEEILSRVPITSLGAVRSTCKRWNGLSKDRIVCKGDANQQFTGFTRYVNESTVCSMRLDLNEIQNEDVELVELSINKINKFIELELFQVYYSDGLLLLVTDEVDSKIVVWNPYLGQTRLIQCRDTEHFKYRYALGYDNNRNHKILMYNRKNCEIYDFKSDSWKVLDIIPDLHTNIYVRDMSIKGNTYFFYRGEKIGEGLAGCLLSFDFTRERFVSCLPLPFQIAKFDDNVALSSVREEHLVVLFNNWEESEMEIWVTTKIEPNAVSWSNFLTFTHFRIKFLVTSFFIDQEKKLAVVFGRSLSKQMRCNIAYVIGDNGYLRILDFGVTFIPSNLPVSYAPSLVKITQGQELSVIEEKKRSRLLASLVYSTLFVSFIIFFSFISSVFI

SEQ ID NO: 7572 - protein, 373 aa, Zea mays
MTKQGMVVPVPEAAVAVPPNSAPLFQYPPPRAAPGVAVRKKCLQMGAGVGVGAGAGRIGGWVESMRASSPTHAKAAAALAAGVEEERYAAWMVKHPSALAMFDQLVAASKGKQIVVFLDYDGTLSPIVDDPDAAYMSDTMRRAVRSVAKHFPTAIVSGRCRDKVFEFVKLAELYYAGSHGMDIKGPAKGSRHTKAKGGGVLFQPASQFLPMIEQVHDSLVEKTKCIPGAKVENNKFCVSVHFRCVDEKSWITLADMVKSVLKDYPKLKLTQGRMVFEVRPTIKWDKGKALEFLLESLGYADCTDVLPVYIGDDRTDEDAFKVLRKRGQGVGILVSKHPKDTCASYSLQEPAEASIPRVPVSTPPPPPLRLLRR

SEQ ID NO: 7573 - protein, 141 aa, Halomonas sp. #593
MATERTLSIIKPDAVAKNVIGEIESRFEKAGLKIVAAKMLQLSQEQAEGFYAEHKERPFFGDLVGFMTSGPVVVQVLEGENAIAANRDLMGATNPKEAEAGTIRADYAQSIDANAVHGSDSPESAAREIAYFFEESEICSR

SEQ ID NO: 7574 - protein, 470 aa, Anaplasma marginale str. St. Maries
MESCDLIVVGSGPGGYIAAIRAAQLGYRVTVVEKEESLGGVCLNWGCIPTKSLLKSAEIYSKLRKADSFGVEVSGNISVNIAKVVARSREAVSRLGHGVAGLMKKHGVKVHQGFAQVLGGGKVAIQQKGKPLTLAAKHIILATGASARLVPGLDEKMLWTARDAMLPKALPKSLLIIGSGAIGIEFASFYSHMGSKVTVVEMQDRILPLEDKAVSAFMQKVLQAQGIEILTGGSVPSLKKAGPAMQAQIKLGTQKVITLECDKAIAAIGVIPNTHGLGLENTKAALDERGFIVTDDCCRTAEPNLYAIGDVAGPPCLAHKASHEAVMCVEGIAASDGILKDKPHPLGVHNIPSCIYSIPQVASIGLTEEQARAQGLDIKVGVSHANCSGKAIVSGAVDGFVKVIIDSTSGELLGAHMVGEEVTEMINGYVIGKKLEATDLDLLSTIFPHPTLSEMMHEAVLAALGRPLNG

SEQ ID NO: 7575 - protein, 375 aa, Clostridium tetani E88
MPKKDFYEVLGVEKGANDAEIKKAFRKLALKYHPDKNAGNKEAEERFKEINEAYQVLSDPQKRAQYDQFGTADFNGGGAGFSGFEDFDLGDIFESFFGGGFGGFGGSSRRRNGPQKGPDVQYSINLTFNEAVFGVEKEVSITKSETCETCTGTGAKPGTNSKTCPKCNGSGQIKVQRNTALGSFVSVNTCDMCGGKGTIISDPCSDCKGKGTVRKQKKIKVNIPAGVDTGNVIPIRGQGEAGVNGGPPGDLYISVRVMPDPFFKRRGDDIYIDQHISFAKASLGTELKVKTIDGEVKYDIPSGTQPGTVFRLKGKGVPHVNGRGRGDQYVNIIVDIPKSLNQKQKEALFAYMEASGEIQSSEKEGFFDKIKKNFK

SEQ ID NO: 7576 - protein, 466 aa, Burkholderia xenovorans LB400
MSKTSLIAADRKHLIHPVINYRAHEARGATVLESGQGAYLRDIDGNELLDAFSGLWCVNVGYGQQSIVEAATRQMTKLPYATTYFHFSSEPAIELADKLVALAPASLQHVYFTLGGSDAVDSAIRFITHYFNATGRPSKKQMIALERGYHGSSSVGAGLTALPAFHRNFDLPLPHQHHLPSPYAYRQTHGDDAQALIAASVAALEAKVAALGTDNVAAFFCEPIQGSGGVIVPPVGWLKAMRDACRRLDILFVADEVITGFGRTGPLFACEAEQVEPDLMTVAKGLTSGYAPMGAVLMSDEIYQGIAGDARDTAIVGHGQTYSAHPVSAAIGLEVLRLYQEGGLLANGQAQAPRFAAGLDALLGHPLVGDSRHRGLLGALELVADKDSRARFDPALKLPDRIAAAAYRNRLVFRAFGDSILGFAPALCFGEAEFEQMFGRLKRTLDEVLDETEVRAALRTAGRAAA

SEQ ID NO: 7577 - protein, 548 aa, Arabidopsis thaliana
MANSDSGDKDAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSVPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 7578 - protein, 309 aa, Arabidopsis thaliana
MDMLHTILNFLLPPLTISFLVLFYPFYLFIKLVRFLVKHLRFENVTGKVVLITGASSGIGEHVAYEYAKKGAKLALVARRKDRLEIVAETSRQLGSGDVIIIPGDVSKVEDCKKFIDGTIHHFGKLDHLINNAGVPQTVIFEDFTQIQDAISIMDINFWGSTSITYFAIPHLRKSKGKIVVISSATAIIPLPAASVYSASKAALVKFFETLRVEISPDIKITIALSGFISTDMTTPQFKEMYGSDFILLESVSQCAKAIFRGIGRGEAYVIEPSWIKWIFLIKNVCPEIVDYVLDYIFVSYLRPYFKRD

SEQ ID NO: 7579 - protein, 411 aa, Brucella suis 1330
MSISFDLTIDDTRDQLARHARASLEAKPSLIGMSREEMAAALIAAGVPERQVKMRISQLWHWLYVRGVSDFADMRNISKDLRAMLAQHFTIARPEVVEEQISQDGTRKWLFRFPPRGAGRPVEIESVYIPEEGRGTLCISSQVGCTLTCSFCHTGTQKLVRNLTSEEILAQLLTARDRLGDFPDKDTPDGAMVPAEGRKITNIVMMGMGEPLYNFEEVKKALLIASDGDGPSLSKRRITLSTSGVVPEIYRTGDEIGVMLAISLHAVRDELRDILVPINKKYPLAELIKACREYPGLSNAKRITFEYVMLKDINDSLDDAKLLVKLLQGIPAKINLIPFNPWPGTNYQCSDWEQIEKFADYVNAAGYASPIRTPRGRDILAACGQLKSESERLRKSERLALEAMMIAGHGE

SEQ ID NO: 7580 - protein, 127 aa, Brassica napus
MAAPAMKIVFGLLTFVTVGMIIGALLQLAFINRLEDSYGNGLPSLRGLRGQSSRHLRDVSRWANDKDAEALRLGYVKPEVVSWSPRIIVLHNFLSSEECEHLKAIARPRLQVSTVVDVKTGKGVKSD

SEQ ID NO: 7581 - protein, 440 aa, Pseudomonas putida GB-1
MATLKRTLSLGSVVLFGIAYMTPIIVLGTFGILADTTAGMVPAAYLAAAIAMLFTALSYGNMARAFPVAGSAYTYVRKSISPQLGFITGWAVLLDYLFLPMAIWLIGAAYLHSAFPSVPQAIWVLAFIAVTTTINVIGLRLAKTVNGLLMLIQLLVLAAFVALAVHYVWGDPTVPLWTLEPFYKEGAQLPLIMSGAAIACYSFLGFDAVSTLTEETKEPRKNIPRAILLITLIGGGLFIACSYFVQLAHPSTDFINADAAAYEIAQNIGGDLFVSVFLLGLIVGQFTSGLSAQASASRLLYAMGRDGVLPKSFFGKLSERFSTPVPSIILCGVVALLALRMDVTTSTSFINFGAFLAFSLVNLAVIFHYWLAMGQRGGTAVLLYLAFPLVGLVSNVWLMASLDHLAIYLGLGWLCLGMLYLTAITRGFSKQPPEMHFEEA

SEQ ID NO: 7582 - protein, 890 aa, Pseudomonas putida GB-1
MQTSRPCLQAHFHLPCPNAAMPASLTDDGGRAGCLPFSHRHRPMTFNPQVNLTNCDREPIQTPGSIQPHGCLLACDASATVVLRHSVNAPDVLGITGDINGQKLQAVLGDEVAHTLRNALARTREASRPALSFSVRLPNGQAFDVAAHLFKGTAILEFEPAGASIAEPIELARTLIAQLREIEQTSKLFRDAARFVRAVLGYDRVMIYQLGTDGAGKVVAEARRSDLESFMGQYFPASDIPQQARALYLRNPIRVISDAQFKTVAIEPVLDPSGEPLDLSYAHLRSVSPIHCEYLCNMGVGASMSISVIVNGELWGMIACHHYAPRTLAMGQRVAAEMFGEFFSLHIETLRSRQKLEAAVQVHKALDSMLRDANQTADIDSFFHARLPRLMSLIPCDGIGMSLQGRWSTVGLAPPKTAVPDLLRLADMVSEGRTWASNRLSMVLPSAQAYFTEVSGVLIIPMSQQPRDYLIFFRKEVVETLDWAGDPNKTYDSGLLGDRLTPRKSFAIWKETVHQQSLPWTEQDRQFGDSIRTAIVEVVLYNSELLASERTKAEVRQRILNEELNHRVKNILSLIGALVAHPTSESQTLQDYVATLKGRIQALSLAHDQVVRGDGGGRLAKLLEAELSPYRTAAGVIELQGPNVTLDARAYSVMALVLHELATNAAKYGALSRAGGKLAVSWAIDATNACAISWRESGGPTVRPPTRNGFGSVLIDRSIPFDLGGTSAVEYHAEGLQGLFKIPAMHLSVAEAAEPASLAAPIARAKDIFAAQTGLSVLILEDQLVIAIGLEQILNDAQIKDVITASSEDEALRLIASRTPDAAILDVNLGTGTSISVADELVRRQIPFLFATGYGDSISIPEHLQHVPVTRKPYDANAILASLKRLLDLG

SEQ ID NO: 7583 - protein, 456 aa, Xanthobacter autotrophicus Py2
MAIEVLMPALSPTMEKGNLTKWLKKEGDTVKSGDVLAEIETDKATMEVESIDEGILGRILVPEGAQDVAVNTPIATILADGEDANAAPAPAPKAAESAPAPATAPAPAAPAVIAPQAVAQPDPEVPAGTEFVTQTVREALRDAMAEEMRRDGDVFVMGEEVAEYQGAYKITQGLLQEFGERRVIDTPITEHGFAGVGVGAAMAGLKPIIEFMTFNFAMQAIDHIINSAAKTLYMSGGQMHCSVVFRGPNGAAARVAAQHSQDYTSWYSNVPGLRVIAPYTAADAKGLLKAAIRDPNPVIFLENEILYGHSFEVPKLDDFVLPIGKARIARSGKDVTLVSFSIGMTYALKAADELAKQGIEAEVIDLRTIRPMDVDTIIASVKKTGRCVSVEEGWPQSGVGAEIVAQLMDKAFDYLDAPVLRVTGKDVPMPYAANLEKLALPTVADVIAAVHAVTYR

SEQ ID NO: 7584 - protein, 448 aa, Xanthobacter autotrophicus Py2
MPIEILMPALSPTMEKGNLAKWLKKEGDTVKSGDVLAEIETDKATMEVESIDEGILAKILVPEGSQDVPVNQLIALLAGEGEDVAAAAAGGGAKAAAAPAAAAAPAAAAPAAAAPAAAPAPAAAPASNGQGGRVFASPLARRIAKDKGIDLAALAGSGPHGRIVARDLEGAKPGAKPAAAPAAAATPAPAAAPAPKAAVASAPGAEQVKAMFEAGSYEEVQLDGMRKTIARRLVESEQVTPTFFLTVDCDLDDLMALREQVNANASKDKDGKPSYRVSVNDFIIKAMALALQKVPAANAVWAEDRILRMKHSDVGVAVAIDGGLYAPIVKKAEQKTLSAISNEMRDLAGRARTKKLKPDEYSGGSTSVSNLGMMGIRNFTAIINAPQSSILAVGASEQRAVVRNGEIKAVMQMTVTMTCDHRVMDGALGAELLSAFKGFIEKPMSMLV

SEQ ID NO: 7585 - protein, 547 aa, Acinetobacter calcoaceticus
MYLYTDFDQQLINQRVAQFRDQTERYLAGKLTEDEYRPLRLQNGLYVQRYAPMLRIAVPYGLMNTKQLRKIAEIATEYDRGYAHVSTRQNIQLNWPALENVPDILAELATVQMHAVQTSGNCIRNTTTDQFAGVVAGEIADPRPTCELIRQWSTFHPEFAFLPRKFKIAVSALEEKDRAATAFHDIGVYIVRNDAGEIGYKIMAGGGLGRTPIIGSVIREFLPREDLIAYLEATLRVYNLHGRRDNKYKARIKILVKALTPEVFAQKVEAEFEHTREALKIQPEILKKLDEEFTPFDYQDLEDQDFTTLFAEHPKFKQWFNVNTNAHKVKGYRIVTISLKRAGVAPGDMTTEEMNLIADLADKYTFGEFRTTHEQNISLVDVPQKDLFELWQTLEHHNMARAHIGFITDIICCPGGDFCSLANAKSIPISEAISRRFDDLDTIYNLGELDLNISGCMNACGHHHVGNIGILGVDKKGAEFYQITLGGHADHDASLGDILGPSFAADAVPDVIEEILNTYLDLRTEGERFIDTYRRVGIQPFKERAYA

SEQ ID NO: 7586 - protein, 484 aa, Erwinia carotovora subsp. atroseptica SCRI1043
MAKFTPASLPAEFLDTMRDIMPSSLSMEDFIAACQRPLRRSIRVNTLKISVDAFLQLAQPYGWQLEPIPWCQEGFWLLNAEEENTRLGNTLEHLSGLFYIQEASSMLPASALFHHNDAPGTILDVAAAPGSKTTQIAARLNNEGAIVANEYSASRVKVLHANISRCGVSNTAITHFDGRVFGAALPEYFDAILLDAPCSGEGVVRKDPAAMSHWSQESITDIAATQRDLILSAFHALKPGGVMIYSTCTLNRQENQQVCRWLQAQFPDACEFESLDDLFAGAERATTEEGFLHVFPQIYDSEGFFVARLRKTGSVPPLPRPGYKVGKFPFSPVAHKDRALLTEAARKQGIRWDEELLQLWQRDSEVWLFPAALTSAFGNIKFSRIGIKLAERFPKGFRWQHEAIVALADPNASNAYALNDRIACEWFQGKDSYPEPLPTADELILTYQNTPVGLAKRISSRIKNSLPRDLVRDGASSARPLAKE

SEQ ID NO: 7587 - protein, 518 aa, Glycine max
MATRPESEKDPPQPPSRGFLATVQEITRIYSSLPPRPSIEEVEAATSTVDTLNNEEQIKLNEISMQQQPPHDDVPQDLFSVLQQLKKTMVLFHTHQQRRDALYLLELENMFQTFGDLIQRASELVSGDTQKQKLPTIPEEHAVITEESETLVKEEEGRHKNVFHVVKPSLSAGDGSTEKLSLMKVATVIESCAGSGATILELRGKLVDQMEWLPVSIGKLSDVTEMDLSENRLMALPTTIVGLKALTKLDLHSNQLINLPHSFGELINLVDLDLHANKLKSLPATFGNLTNLTDLDLSSNGFTDLPETIGNLSSLKRLNVETNELEELPYTIGNCSSLSVLKLDLNQLKALPEAIGKLECLEILTLHYNRVKRLPSTMDNLCNLKELDVSFNELEFVPESLCFATNLKKLNLGKNFADLRALPASIGNLEMLEELDISDDQIKALPESFRFLSKLRVFRADETPLDLPPRELVKLGSQEVVQYMADFVTKRDAKLVPSKKKKKGFWFWFCSIFCPQLK

SEQ ID NO: 7588 - protein, 337 aa, Rhodococcus sp. RHA1
MSVLNRTWRVAGMPREHLETSHFSFETADRPEAGDGQVLCRVLWISMDAAQRAWFQAATYRAAIQVGDAMPGFSLAQVVESRCDDFAVGDIVAGDLAWQDYVIAEPNTLRRIVPNRPLSNYLSVLGITGLTAYFGLLDIGEAKPGETVVVSGAAGATGTLVGQIAKKQGCRVVGICGSPEKQKWLTSELGFDAAVSYRDESFRKSLREACPDGIDVFFDNVGGTTLDTVLGSMAYRGRVVCCGVVSQYDTTSPVRGARGVPGVLIIKSITMRGFLVMTDFADRWDEGLKVLEGWLDDGSLQVREDTLEGLEKAPEGLIGLLNGNNVGKRMIHVADPS

SEQ ID NO: 7589 - protein, 297 aa, Nicotiana tabacum
MVEKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 7590 - protein, 281 aa, Euglena gracilis
MDLDYEGQAPTTSLLLLFPPHLVPEYIGTISNNLRSAEVNHRPSKTFLEEVQVDITRLMRAILVDWMNEVTEEFRLKMETLCLAVNYVDRYLSRVPVPRHQLQLVGVASLLIASKMEEIMHPQIDEFVYITDSTYNREQVLRMELSILNALRYDMTVVTPRDFVGIYLKVAQASPEVCMLADYLLELILQEYAFLHWEPSMIAASAVVLALFGFRLPCWSDDLRRITQYQPNELNACLKEMHRVFQNAPHNNLQAVREKYSHGRFMHISMVAQLPPSPPVF

SEQ ID NO: 7591 - protein, 450 aa, Brassica napus
  misc_feature (313)..(313): Xaa can be any naturally occurring amino acid
  misc_feature (332)..(332): Xaa can be any naturally occurring amino acid
  misc_feature (344)..(344): Xaa can be any naturally occurring amino acid
MALRHLSRPRDIVKRSTKKYLDEPLYHRLFKDGGSEVSVRQQLNQFLKGTKHVFKWEVGDTIKKLRSRGLYYPALKLSEVMEHRGMNKTVSDQAIHLDLVAKARGIAAGESYFVGLPETSKTELTYASLLNCYCKELMTEKAEGLLSKMKELNITVSSMSYNSLMTLYTKTGQAERVPGMIQEMKAEDVMPDSYTYNVWMRALAATEDVSGVERVIEEMNRDGRVAPDGTTYSNMASIYVDAGLSEKAEKALQELEMKNTERDFKAYQFLVTLYGRLGKLNEVYRIWRSLRLAMPKTSNVAYLNMIQVLVNLXNLPGAETLFQEWQANCSTXYDIRVVNVMIGXAYAREGLIEKANELKEKSPRRGGKLNAKTWELFMDYYVKRGETAQALECMTKAVSIGKGDGGKWIPSEDTVRALMSQFEEKKDVNGAESLIEILKKGTDDVGAETF

SEQ ID NO: 7592 - protein, 317 aa, Haemophilus influenzae R2866
MTTQLDSLRNMTVVVADTGDIDAIKKYQPQDATTNPSLILSASALPQYAPLIDEAVAYAKAQSNDKAQQLIDAEDKLAVNIGLEILKIVPGRISTEVDARLSYDTQATVEKARKLIALYNAAGISNDRILIKIASTWQGIRAAEILEKEGINCNLTLLFSEAQARACAEAGVYLISPFVGRILDWYKANSDKKEYAPAEDPGVISVTKIYNYYKEYGYNTVVMGASFRNVGEITELAGCDRLTIAPALLKELQENSTALVRKLEYKGEVKAKPQPLTEAEFYWQHNGDAMAVEKLAEGIRKFAIDQEKLETMLSAKL

SEQ ID NO: 7593 - protein, 958 aa, Oryza sativa
MERVLKSARESGSLNLSNRSLREVPKEVYNNLDTGAQDEKWWEGVDLQKLILAHNNLEVLREDLRNLSSLVVLNISHNNISSLPAAIGDLPLLKSLDVSSNQINAFPEEIGFATALVKVDCSNNCLTDLPVSLARCLELSELNASNNTISVLPDELAGCSKLFRLNLEGNKLVTLSDKMFMSWTMLTEMNAEITLIPPSIKDCSSLAEFYMGNNLLTSIPEDIGMLSNLGILDLHSNQLKEYPVGACRLKLSFLDLSNNSLSGLPAELDHRADSFFPWGICFENLACSMQVCYYLNELSKLWTLTYASACYIQGTMTTLRKLLLTGNPMRTLRSSLVSGPTTALLKYLRSRLSSDEGASGSGSTPTKDDQIAAARRLSLSSKELDLSGLGVTSVPPAAWETNDVMKLDLSKNSIEDLPNELSLCSSLQSLILSNNKIKRWPGTVFSSLASLSLLKLDNNPLAEILATDLEALSKLEVLDLSGSASSLPEPSAVSKLPHLKELYLRRMKLHGFPDSLLGLKLLRILDLSQNYLTSVPEGIKDLTSLIELDLSDNNITTLPPELGLLEPNLQVLKLDGNPLRRVIDVKCWYLNANGLTPSLVPGKDRLNDLPDDVVLNILERLDTSDAMKTCILSKNMRATLPDMLSRIAVDVAAFSRPNHRRLTLREVVRTNGAVADLTAAVLEFRRPEIPVHHLALRFYLRSAADDLVYFAGQFHTLFTAYPAVFAGLTRLWFGDSDIAGILLTCKNLRFLRLFNCKSVRRSVLQIWVEPEGWKRLAPVLGELRHVTLVDLPEGCDIAWTMFIVEAAPRLESLSIRVWDHCCKMERDETTRQENGYCDKSNVEWQPSVANLEHRNLAKLTIVGFQPDEHFVGFIRRVMESAVNLEEISLYDRVVGRCCSYLDPKTKSKVVPSRYPRTMKEQVLLRKEDDQGVIIGDGFVSCNSLQVLVVNYYKLEFGI

SEQ ID NO: 7594 - protein, 522 aa, Ostreococcus tauri
MLLAQFSTQRCGFLKTHGQVALRLATNTKKAFSTRSVNTNAMVRKTYQLNFSKLTAVSGGGSGGVRASRLASTAGAKVGLCEMPYDPVSSEQTGGLGGTCVIRGCVPKKLFVFGSEFSAQFEDATGFGWDIASSKFDWQRLLNAKMQEIQRLNGIYKKLLHGSGVTTFEGAGKLIDEHTVEISGKKSTERITARDILIATGGRAHVPDIPGAHLGITSDEALSLLELPEKILIIGSGYIAVEFAGIFAGLDVTVDLVYRQPLPLRGFDDDLRRTVKTNLQSRGITQHADCQVFSLSKDDTGRLAVETTTGVLKTDVVLFATGRVPNTSRPSLGLDTVGVDISVTGAIKVDEYSRTNVSNIWAVGDVTNRVNLTPVALMEGMAFVDTVVKGVPTKPEYDNIPCAVFSQPPVASVGLSEQDAIARGHKCDIYTSAFTPMKYSLSGRNEKALMKLVVETYSQRVLGVHMVGPDAAEIMQGFATALKCGATKQQFDQTVGIHPSSAEEFVTMRTMTRQVGGDAQRD

SEQ ID NO: 7595 - protein, 589 aa, Clostridium tetani E88
MNFKKTIAILIIRIAMVFKICKKRGVYMIKEIKLEKLFPGSKEGKVGKIHKSIGDGIKSGEVLVEVEGKKGNIPIKAKEEGKIHSIEIEEGTTVKIGDVLLKIEIEEVTLDEFVIDKDEFAKKSELKSLECDVAILGAGPGGYVAAIQAAKLGAKVVIVEKDKVGGTCLNRGCIPTKAFVRSSEVYSNVKNSEKYGISLENPSIDIKKVVARKDNIVDKLVGGIQYLIQKHNIELISGNGKLIDRNTIETKDALIKAKNIVIASGSKASVLPIKGSNLKQVITSEEALDLKEVPEKIAIIGGGVIGMEFAFIYANMGVEVSVIEYFDNILSMLDEDVIKEITDIGKEKGIKFYTSSKVEEILEDENEGCIVKFTNKGEEKFIFCDKVLMSVGRQPYMENMGVEELGIELNQNKRGIKVNTKMETSVSNIYAIGDVTNVIQLAHVASHQGIVAVKNIMGKDIQIDYSAVPSVIFTEPEIAVVGVCEKIAKENNLDVEVGKFPFSANGKALTLGEDRGFIKVIKEKATGKVVGASIIGAHASDLIAELTLAVKNGLTSEQIAETIHAHPTTAEVVHEASLAVEGGALHFAE

SEQ ID NO: 7596 - protein, 518 aa, Burkholderia xenovorans LB400
MRRNLFSARGIADLNLLIRPGMSTPSLDFDPSAVPLPQGHFIGGAYYSTGEAQIAVHRPSDGALLGHVPDATDATVDHAVSNALAAWKTSGWGTRSPRERAKVLRRWADLIDRDAVSLAQLETVSSTRPVAESYASDVPFTAEAIRFFAELADKLGGDIAATRRDSLGFVASEPYGVIGAITPWNFPLSMCSWKCGPALAAGNAVVLKPSEMTPFSTLRLAELAIEAGMPPGIFNVVNGRGATTGAALTRHPGISKMSFTGSTRTGAAIMSDAAMHGTKPVTLELGGKSPQLVFEHVRDLDFTAGCIARGFTANGGQACVAGTRLIVHKRIAEPLVGAIQRQLQSIKPGPLWDSRTTYSPIISPAQARRIETLIDQSRDSGAEVIFGGGFFDGTDEGFFHRPTLLANVTDATPAVREELFGPVLTVQTFDDEDEGIALAGHPIYGLAAGIHSSDIGQALRAMRRIAAGTIWINRYGRSGDMIIPTGGFGQSGIGKDLGREAMVASMRHKSVLIDFETL

SEQ ID NO: 7597 - protein, 275 aa, Ostreococcus tauri
MRMNASNLRTRDVWAHNLDEECTLIREIVSAYPFVAMDTEFPGIVARPVGSFKHQSEFQYQTLRCNVDMLKLIQLGLTFTDADGNLPLIDGYHCIWQFNFREFSLKDELYAQDSIELLKHSGIDFNTLEERGIDVVQFGESLMVSGVVLNEDIRWLTFHSGYDFGYLLKLLVNAPLPENETEFFELLRCYFPYIIDIKHLVQCVGNMHGGLSKLAEHLSVARIGPQHQAGSDSLLTAHTFFKLQKTHFMNVDLNQFVGTLYGLGQDRELMSSSQV

SEQ ID NO: 7598 - protein, 348 aa, Neisseria gonorrhoeae FA 1090
MKMQAVVVNKNVAGDVEVVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGTHVVAIDINDDKLAFAKETGADLVVNAAKEDAAKVIQEKTGGAHAAVVTAVSAAAFNSAVNCVRAGGRVVAVGLPPESMDLSIPRLVLDGIEVVGSLVGTRKDLEEAFQFGAEGLVVPKVQLRALDEAPAIFQEMREGKITGRMVIDMKKECGCDHHH

SEQ ID NO: 7599 - protein, 362 aa, Burkholderia xenovorans LB400
MTRKYRIAVIPGDGIGNEVMPEGLRVLDAACRRFDIGIEYRQIGWASCDYYAQHGQMMPDNWKEQLQDCDAILFGAVGWPEKVPDHISLWGSLLKFRREFDQYVNLRPARLFEGVPCPLANRKPGDIDFMIVRENTEGEYSSVGGTMFEGTEREVVMQQSIFTRHGTERVMKFAFDLAQRRAKKITVATKSNGIAISMPWWDARADEMAARYPDVKMDRQHIDILCARVVLNPDRFDVVVASNLFGDILSDLGPACTGTIGIAPSGNLNPDRRFPSLFEPVHGSAPDIAGKGIANPVATIWSTAMMLEFLGNGARVERDAHDAIVAAITEVLKDGPHTGDLGGRASTTEVGAAIAARVAQAG

SEQ ID NO: 7600 - protein, 255 aa, Escherichia coli
MRHPLVMGNWKLNGSRHMVHELVSNLRKELAGVAGCAVAIAPPEMYIDMAKREAEGSHIMLGAQNVNLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 7601 - protein, 492 aa, Burkholderia xenovorans LB400
MSTNLEQLARALIRTDNFINGQWIAAASGRRFAVTDPATGNLIADVADSGPADARAATDAAAKALPAWRALLASERAAILHRWHALIVANRDALGALISLEQGKPLTEGRGEVGYGASYVAWFADEATRIYGDLIPQQQRGKRMSAVKEPIGVVAAITPWNFPLAMIARKIAPALAAGCTVVAKPAEDTPLTAIALVMLAHEAGVPDGVLNLISASRAAAAETVGDWLADSRVRKITFTGSTPVGKHLARESAGTLKKLSLELGGNAPFIVFDDADLDAAVNGLLAAKFRNGGQTCVCPNRVYVQHGVYEHFAALLRARVAELRVGPASDPTSQIGPMINVRAVDKIARHVDDAVEHGAVVLTGGRRLTELGPHYYAPTVLGNASASMALCGEETFGPVVPLFPFDTEQDAVQAANDTPFGLASYFYSENMRRIERVSRALEAGIVGINEGALASEAAPFGGVKESGYGREGSKYGLDDYLSIKYLCQGGLQ

SEQ ID NO: 7602 - protein, 439 aa, Oryza sativa (indica cultivar-group)
MNLCDGVTELPDGSIVFRFARPRDDDDEEQQQRRADAVAPEAGAVVESGLDGDAAAAAEPEARDGGGEGEVTATATGLDAEEVVASGGAEATATSGLEDAGEEASDGSTARDSDTDVDTESSASTAADDDQPAEFAVPPPPAEEVCNKVDWEKDTSEVKNTDRMVPVASSTLVLASGAAILPHPSKLIIASTFYILFFGTPFDNTITAATGGEDAYFIACDGWFGVADGVGQWSFEGINAGLYARELMDGCKKFIMENQGAADIKPEQVLSKAADEAHSPGSSTVLVAHFDGQFLNASNIGDSGFLVIRNGEVYQKSKPMVYGFNFPLQIEKGDNPLKLVQNYTIELEDGDVIVTASDGLFDNVYEQEVATMVSKSLQADLKPTEIAEHLAAKAQEVGRSAAGSTPFSDAALAVGYLGFSGGKLDDIAVVVSIVRKSEI

SEQ ID NO: 7603 - protein, 122 aa, Zea mays
IPVRRYAERIYRYAGCSPACYVVAYVYLDRLARGQCDAGAGEDEDEDEAAVVGIDSYTVHRLLITSVLVAAKFMDDRHHNNAYFARVGGVDVAEMNALELRLLFALRFRLNVVPDTFARYRS

SEQ ID NO: 7604 - protein, 314 aa, Burkholderia thailandensis E264
MKASYVWKNGELVPWERAQVHVMSHALHYGTSVFEGVRAYEIGEKAAILCGREHFERLLFSCKVARIPSPMSVGQWMEATVETLRANGQRSAYIRPLVYRGAGESLGLDARQCPAEALLITTPWGAYLGDEALQQGVDVQVSSWRRNGGGAASTLAKIGGQYVNGQAIVMEAHENGMSEGIALDANGFVSEGSGENVFLVYKNEIFTPSIGSSILSGITRNCVIRIARDLGYTVTETSIPREMLYLADEIFFTGTAVEICPVRSVDRMPVGSGKRGAVTKAIQDQYFGIVRGTHADKWNWLTPVPVPSRDGARA

SEQ ID NO: 7605 - protein, 264 aa, Oryza sativa (japonica cultivar-group)
MARALELSAAFFALPDEEKAKARPVEGSEAPLPAGYARQPAHSADKNEYLLAFDPQLGFNLYPDEPSGFREALYELYGKLTELGVLIQEILNKCMGLPPGFLKEYNGDRSFDFIAALRYSPATAEENNGVSEHEDGNCITFVLQDGVGGLEVLKDGAWVPVDPVEGSIIVNIGDVIQVLTNGKMKSATHRVVRKPAVHRHSLVFFFNVHGDRWVEPLPEYTEKIGEAPRYRRFLYSEYQQLRMRNKTHPPSRPEDVVHITHYAI

SEQ ID NO: 7606 - protein, 750 aa, Pseudomonas amyloderamosa
AINSMSLGASYDAQQANITFRVYSSQATRIVLYLYSAGYGVQESATYTLSPAGSGVWAVTVPVSSIKAAGITGAVYYGYRAWGPNWPYASNWGKGSQAGFVSDVDANGDRFNPNKLLLDPYAQEVSQDPLNPSNQNGNVFASGASYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNATYYELTSGNQYFYDNTGIGANFNTYNTVAQNLIVDSLAYWANTMGVDGFRFDLASVLGNSCLNGAYTASAPNCPNGGYNFDAADSNVAINRILREFTVRPAAGGSGLDLFAEPWAIGGNSYQLGGFPQGWSEWNGLFRDSLRQAQNELGSMTIYVTQDANDFSGSSNLFQSSGRSPWNSINFIDVHDGMTLKDVYSCNGANNSQAWPYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIAFRKAHPALRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 7607 - protein, 77 aa, Citrus sinensis
DSLDYGGNFSHMLGFDDPKMLELMRLYVTIHSDHEGGNVSAHTGHLVASALSDPYLSFAAALNGLAGPLHGLANQEV

SEQ ID NO: 7608 - protein, 473 aa, Burkholderia thailandensis E264
MDLEEGIKRLYPYATEFGAMHGFPEHGLSRERLLDELRSMAVREDRKWESGRCSGTMYCGDHEHYAFLNEAYGLFSHVNALQRDLCPSMSRMESEIVGMTVAMLHGEAVAGHGGAHRACGVLSLGGTESILNATLAYREKARAERGIDRPRMIWPASAHPAFRKAAHLFGFDVTVAPVDPDTMQVDADFVRDAIDANTVMLVGSACNYPYGTVDPIEALSEIAVEKEVWLHVDGCLGGWMLPWGEELGYPNIPAFDFRLPGVTSISADTHKFGYGPKGGSVLAWRDASFRRYQYFLMTDWVGGVYGSPGLAGSRSGGLIAATWAALRGLGREGYRARARAIFDTAFDMQAAVRAIPELRVLGKPTFCFAFASDAFDIYHVNDFMRRQGWRFNGLQHPDALHMCVTGPQTQPGVAKRFRQDLGAAVDYARRHTHARAQSSGVYGGDSAGLDLRDDAQARAFFTQVLDLFTDCPL

SEQ ID NO: 7609 - protein, 471 aa, Xanthobacter autotrophicus Py2
MADSYDIIVIGGGPGGYVAAIRAAQLGFKVAVVEKSHLGGICLNWGCIPTKALLRSAEIYHYMEHAKDYGLSAEKIGFDAAAVVKRSRGVSAQLAGGVAFLLNKNKVDVIWGKATFTAPGKIKVEASQNPPKGAKGGGDYTAKHIIVATGARPRALPGLEPDKKLIWTYFDAMVPEKMPKSLLVMGSGAIGIEFASFYRTMGTEVTVVEVLPQILPVEDEEIAAVARKRFEKLGMKILSGAKVTGVTKHADSITAHVEDAKGAKHDITVERMISAVGVVGNVEGLGLEAIGVKIERGCVVIDGYGRTNVPGVYAIGDIAGPPMLAHKAEHEGVICVETIKGLHTHPMDKNKIPGCTYCTPQIASVGLTEKKAKEAGREIKVGRFSFIGNGKAIALGEPDGLVKTIFDAKTGELLGAHMVGAEVTELIQGFVVAMNLETTEEDLIHTVFPHPTLSEMMHESVMSAYGRAIHS

SEQ ID NO: 7610 - protein, 515 aa, Brucella melitensis
MSREKYYITTAIAYPNGKPHIGHAYELIATDAMARFQRLNGMDVYFLTGTDEHGIKMLQSARKEGITPRELADRNTSAFRRMAEVLNSSNDDYIRTSEERHYKASQVIWQAMVANGDIYKGGYAGWYSVRDEAYYGEEETEVRADGVRYGPQGTPVEWVEEESYFFRLSAYQDKLLDLYENNPGFIMPAERRNEIVSFVKSGLKDLSISRTTFDWGIPVPGDEKHVMYVWVDALTNYITALGYPDTTDERWAYWPANAHIIGKDISRFHAVYWPAFLMSAQLPLPKRVFAHGFLFNRGEKMSKSVGNVIDPFELVERYGLDQLRYFLMREVPFGQDGSYSHEAIVNRTNADLANDLGNLAQRSLSMIAKNCEGKVPQPGAFSEADKAILDQADAALETARKAMDDQALHLALGAIFAVVAEANRYFAGQEPWALRKTDPARMGTVLYVTAEVLRRVGIMVQPFIPQSAEKLLDILAAPADKRQFADVLASPLAGGTDLPAPQPVFPRYVEADEQN

SEQ ID NO: 7611 - protein, 127 aa, Acidovorax sp. JS42
MNLIQILEQEEIARLNKTIPSFAPGDTVIVNVNVVEGTRKRVQAYEGVVIAKRNRGLNSGFTVRKISSGEGVERTFQTYSPLIASIEVKRRGDVRRAKLYYLRERSGKSARIKEKLPSRVKAAAVAA

SEQ ID NO: 7612 - protein, 541 aa, Arabidopsis thaliana
MVAKIDQVLFYMHTILLYNGLWLIELSGVHAGLHTDPGMDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTPDRRKRSSEITKELYERMYEADANHERGRDYSRERYEAEGNVTSRNRPSSPFHPSQSRSPPPHARTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 7613 - protein, 126 aa, Azoarcus sp. EbN1
MSRSIVSTPNAPAAIGPYSQAVRTGSTIYCSGQIGLDPATMQMAEGFEAQTVRVFENLKAVAEAAGGSLADATRLTIYLTDLANFANVNEVMARYFAEPYPARAAVGVKELPKGALVEADAILVLG

SEQ ID NO: 7614 - protein, 101 aa, Ostreococcus tauri
MSCTTADTRFLLKKWSAVAVWSWSICTDTCAICRNSLHEGSIEYQANPAASSDDGLSIAWGNCGHVFHLDCISKWLRTRSNCPLCNKEWEFSKVEKVLNFI

SEQ ID NO: 7615 - protein, 417 aa, Arabidopsis thaliana
MAATAATTTSSHLLLSSSRHVASSSQPSILSPRSLFSNNGKRAPTGVRNHQYASGVRCMAVAADAAETKTAARKKSGYELQTLTGWLLRQEMKGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 7616 - protein, 60 aa, Zea mays
  misc_feature (20)..(20): Xaa can be any naturally occurring amino acid
  misc_feature (31)..(31): Xaa can be any naturally occurring amino acid
  misc_feature (40)..(40): Xaa can be any naturally occurring amino acid
VQTNCIDFTLPAEAFFAAEXEELRAYQFKPXYHFTFYPYXRDHACVGGGYRGPNKHKGTS

SEQ ID NO: 7617 - protein, 127 aa, Zea mays
FWEAISPARAIPIGGEEGEEGGRRPPRFDFAMPKPIFFGFCQGACPVDVFFGGPNFEFALGPPGEFFFAKEKLFENGDRWGGGIVENLNFESLFPGIFFPFWLIKGVFPFSFFFSTSGGISKRGFLI

SEQ ID NO: 7618 - protein, 715 aa, Escherichia coli CFT073
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAESAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRVAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 7619 - protein, 316 aa, Burkholderia thailandensis E264
MCCRIIGIYPDVCRTQNSIHLAMDARRRATQVMDAFDFRSQIPGTSAESARVRPALAVSDVVIGGYAQDIVLRLYRRPDKSALPVVLYFHGGGFVRGALDDAERAARHLAEHVPALVVSVDYSLAPRHPFPAAPEDAYCAARWVEARARAFGGNPRKIGVAGHDAGGQLANCLAFIARDRGEIRIAAQVLIGPMLDPSLTRLADATRLASSDTTAQECAACYRAYLPQPSQRMHPYAAPLESARLAGLPPTLVATAQNDVLHVEAEKYASRLIDAGVPTQVVRYRDVSHAALADHTGALEEAARFFQLRFSSGSPG

SEQ ID NO: 7620 - protein, 437 aa, Zea mays
  misc_feature (213)..(213): Xaa can be any naturally occurring amino acid
IPGVGVSKLSHLSKLARDNNTASRTVEADRLHTMLLAMADARAVLIKLADRLHNMETLEALPCAKQERFAKETMEIFVPLANRLGVASWKDQLENLCFKYLNPEEHEELSSKLRESFDEELITSAVDKLDKGLRDAGVSYHSLSGRHKSLYSIHCKMLKKNLTMEEIHDIHGLRLLVESEEDCYEALCVVHRLWPRVTGRFKDYISRPKLNGXESLHTVVMSEGVHPFEVQIRTREMHLQAEYGFAAHWRYKEGTCRHSFVLRMVEWARWVLTWQCEAMDRERTASLGSDDGTVSVRPPPACPFPQHAEDCPYSYTRQCNHDGPLFVILLEHGKMSVQEFPANLTVMDLMDRVGANSSRWSPYSIPMKEDLRPRVNGEPICDPDRRLNMGDVVELTPALPRKSLSGYREEIQRMYDRGGFALSARGGGGGGGGARRC

SEQ ID NO: 7621 - protein, 223 aa, Magnaporthe grisea 70-15
MSDAWIIEWAFGKRMTPAERLRKNQRLLDKAIRELDQQRVKLEKQEKTLVTQIKQSAQKNQMGACKIQAKDLVRTRRYIEKFYGMRSQLQQISLRLQTHRTNEQMMQAMKGATMALGSMNRTMNLPSLQRIAAEFERENDIMEQRQELMDDAVDDAMDVGVEEEGDELVEQVLEEIGVDLKNSLGETPQGLQSETVAETRIAQAVGGGSDDDLQARLDSLRPK

SEQ ID NO: 7622 - protein, 1073 aa, marine gamma proteobacterium HTCC2080
MPKRHDLESILILGAGPIVIGQACEFDYSGAQACKALREEGYRVILVNSNPATIMTDPAMADATYIEPVEWQTVARIIERERPDAILPTMGGQTALNCALKLAAEGVLNKYGVEMIGASKDAIDKAEDRELFDQAMKRIGLETPRASTVHSMDEAFKVLGDLGFPCIIRPSFTMGGSGGGIAYNRDEFEAICQRGFDLSPTNELLIDESLIGWKEYEMEVVRDRKDNCIIICSIENFDAMGVHTGDSITVAPAQTLTDKEYQVMRDASLKVLREIGVETGGSNVQFGLCPDTGRMVVIEMNPRVSRSSALASKATGFPIAKVAAKLAVGYTLDELENEITGGITPASFEPSIDYVVTKIPRFAFEKFATADARLTTQMKSVGEVMAIGRTFQESVQKALRGLEVGSSGFESQITVTDADTRAELIDALTNPCAERIWFVADAFRSGFSLEEVAGYSGIDPWFLVQIEDLVAAEGRLAGRALSSLSYAELRVLKRKGFSDARLAVLLVASEAEVREYRHSLGLRPVYKRVDTCAAEFATSTAYMYSTYEEECEAATSDRRKIVVLGGGPNRIGQGIEFDYCCVHAALAMREDGYETIMVNCNPETVSTDYDTSDRLYFEPVTLEDVLEIVALEKPEGVIVQFGGQTPLKLARALESAGVPIIGTTPDQIDRAEDRERFQHMIQKLGLRQPENTTVRSVDQAIAAAAAIGYPLVVRPSYVLGGRAMEIVYREEDLLRYMRDAVRVSEDSPVLLDSFLSAAIEVDIDAVSDGKTVVIGAIMQHIEQAGVHSGDSACSLPPYSLDADVQDQMRDVVRAMAIELGVCGLMNVQLAYQDEEIYVIEVNPRASRTVPFVSKAVGISLAKIASRCMAGQSLADQGVTREVVPPYFAVKEAVLPFNKFPGIDPILGPEMKSTGEVMGTGDTFAAAFARAQLGAGDEPPQSGLALFSVRDADKPAAIDVARRLVDRGFTLAATGGTAKALESAGLQVRRINKVREGRPHIVDLIKNDEASLVVNTTEGRTAIQDSAPIRASAEQHRVFYTTTLAAAEAVCMALEQETDISVRRLQDLHESITA

SEQ ID NO: 7623 - protein, 477 aa, Burkholderia thailandensis E264
MRVARIAAVADCAYGADGASARPFPSHVGRGQADVGFWTLAPLARGLPSEGSLQVRPMRVRAGRATRGAPPTRHGDEAMSSNRGVVYQGPGKVEVQKIDYPKMVDPSGRAIGHGVILKVVSTNICGSDQHMVRGRTTAPVGLVLGHEITGEVVEVGRDVETLRIGDLVSVPFNVACGRCAMCKEQHTGVCLNVNPSRAGGAYGYVDMGGWIGGQAEYVLVPYADFNLLKFPDRDRAMTKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAEEAPATVLNSLMEITRPAGAIGIPGLYVTDDPGAADAAAKHGSLSIRFGLGWAKSHSFHTGQTPVLKYSRNLMQAILFDRLPIAQIVNVTVISLDDAPEGYRKFDGGAPRKFVIDPHGMLKAA

SEQ ID NO: 7624 - protein, 561 aa, Magnaporthe grisea 70-15
MFGGSSKADSPTLTSPTSSLPATATPAPGSKSPSPDASESTLSSSPTKAAEQATSREKRSGNGSPPDSAGAAEQKKRRSSGVSSKASSLLASAKNTLNFGQGSSRSNTDNGSSTQTALQKLGKQDPALVVPQGQQNNSAGESLPGPKSTFRVGVWEDRNKKCRRTMEDTHAFLYNFLHTPAATPASSSNATDGETKTTATPGDEIVESDNGYFAIFDGHAGTFAADWCGKKLHLILEETIRKKPNVPIPELLDETFTTVDAQLEKLPVKNSGCTAAIAVLRWEDRVPSSQSATGSQPVAAAKASDEGLKPEDGKSNDGASLRASDAAPPRPKPAVTKQRVLYTANVGDARIILCRSGKALRLSYDHKGSDENEGRRITNAGGLILNNRVNGVLAVTRALGDTYMKELVTGHPYTTETVIQPELDEFLIIACDGLWDVCDDQEAVDQVRNIEDPAAAAKLLVNHALARFSTDNLSCMIVRFDKQAVLDGHSRKDAATKGDPASKPSEADRNVQLATNAAGRSNDPIPSISEEPAAAAAAAAGDSSGGTKGQDDETSQPATSS

SEQ ID NO: 7625 - protein, 535 aa, Chlamydomonas reinhardtii
MSVASAHQHAVVLILDYGSQYTQLITRRVRELSMFSVLFPGDASLDRIKGVNPRVVILSGGPNSVHVEGSPRVPDGFFEYCAEKNVPVLGVCYGMQMITHLLGGEVKPAVHGGEYGRMPMDIAPSSQLFDFLSSSTVNVWMSHGDEAVKLPAGFTAVAKSHQGAIVAIENSERRIYGFQFHPEVMHTEHGMEMIKHFLIGIAAVPADWNMGQVLEEQMAKIKAQVGPDDHVICALSGGVDSTVAATLVHKVLGDRLHCVFVDNGLLRYNEQQRVMDTFKNHLHLPVLCVDHSKPMLDRLRGLSDPEAKRKAIGAEFIEVFKNYANELEKTLGRKPKYLVQGTLYPDVIESCPPPGSGQKHSHTIKSHHNVGGLPKDLQFELVEPFRELFKDEVRAIGRLLGVPDQFIKRHPFPGPGLAVRVIGDVTEDGKLDTLREVDEIFINTIREYGLYDEIWQAFAVFLPIKSVGVQGDQRSHAHVVALRAVTSGDGMTADWYSFTPAFLRDVSNRICNKVRSVNRVVYDITSKPPGTIEWE

SEQ ID NO: 7626 - protein, 316 aa, Pseudomonas putida GB-1
MHEHDVLCFGETMAMFVAEQTGDLASVEQFGKRIAGADSNVAIGLARLGFNVRWLSRVGDDSLGRFVLDSLRREGLDCSGVEVDASYPTGFQLKARCDDGSDPSVEYFRRGSAARRLSPALIHSDVLQARHLHATGIPPALSDSCRALSHALLDAMRAAGRSISFDPNLRPSLWPDQSSMVREINALATKADWVLPGLEEGRLLTGQQTPADIAAFYLDQGVELVVIKLGEAGAYFRSAKGEGQVAAVPVSHVVDTVGAGDAFAVGVLSALLEGRAVVEAVARGNWCGSRAVQSRGDMEGLPLRHELEAHNLRRSA

SEQ ID NO: 7627 - protein, 540 aa, Bacillus thuringiensis serovar konkukian str. 97-27
MSYEKVWANNEKLNQTEKNKLKKDGLEIFNDIPYYAENGFESIPKEEWDAFKWAGLYLQRPKEAGYFMMRVNIPSGIITNAQAEVLASIAEDYGRDVIDITTRQAIQFHWLEIHQIPDIFKRLARVGLSSAGACGDITRNITGNPLAGIDANELFDTTHIVKEVYDYFQHNEEFSNLPRKFKMSISSNIYNAANAEINCVAFTPATKEIDSEKKDGFHIKVGGGLSARPYLADELDVFVLPEEVKAVAIAIATIFRDFGYREKRHLARLKFLVADWGAEKFKEKLIEYTGPLQSKGESALKGWNAGYFYGVQDQKQEGLKYVGFNVPVGRLHAEEMFEIARIAKQYGNGQIRTCNSQNFIIPNVPPENVTGLLTEPLFEAISANPKSFIGHAVSCTGIEYCNLALVETKERLRKIAEYLDTQIALDVPVRIHMVGCPNSCGQRQIADIGLQGVKMKTKEKGIVEAFEIYVGGTLLDGGAYNQKLKGKIDGEDLPDVLASFISYFKENKLPAETFYDFVGRVGVETLQIALNNVLEEVIAS

SEQ ID NO: 7628 - protein, 352 aa, Nocardioides sp. JS614
MKALRFYAPEDVRLEEVPEPTCGPDEVKLRVRNCSTCGTDVKILHNGHQNLTPPRTIGHEIAGEVVEVGADVNVTYGSSWAAGDRVQVIAAVPCGECYECQKGWMAVCQNQTSMGYQYDGGFAEYMIVPRQVLKVDGLNRIPDNVGYDEASAAEPFACAINAQELLGIEPGDTVVVFGAGPIGCMHIRIARGVHQAGPVYLVDVNADRLKMSADAVQPDETINAAEVDVVARVMELTGGRGADVVITATAANITQEQAISMAARNGRISFFGGLPKTNPTITCDSNLVHYRQLHIHGANGSAPEHNKRALEYISTGQVPVKDLITRHIPLSDVLDAFTIVQNGEAIKVTVEP

SEQ ID NO: 7629 - protein, 355 aa, Verticillium dahliae
MSRSNAPNPSGSRKISFNVSEQYDIQDVVGEGAYGPPSSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDTLSKEQLKQLIYQEIMR

SEQ ID NO: 7630 - protein, 437 aa, Nostoc punctiforme PCC 73102
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 7631 - protein, 324 aa, Picea sitchensis
MAIPVIEMGNLKGNEKERFMAEMGKACEEVGFFQLKGHSVPLELMERVKKVCSEHYNRVREPKFKTESVPVKLLNKSLTEAELSNSSEPKKVENVDWEDCFVLQYAQEDYPWPSEPSEFKETMMEFGKEITKLAETLLEILSENLGLEKGYLKTTLAGGDGPDDKAFFGTKISHYPPCPRPELVEGLRAHTDAGGLILLFQDDEVGGLQVLDNTGRWIDAPPMKDTLVIDIGDQLEAISNGRYRSAWHRVLATDNGNRMSVASFYNPSFDAVISPAPQLLLQPKEGSELSLYPKFVFGDYMNVYAQQKFLPKEPRFQAVTALQY

SEQ ID NO: 7632 - protein, 850 aa, Ralstonia solanacearum GMI1000
MSSRQLQLRVLAPLSGRVVPIEDVPDPAFAQKMVGDGLSIDPATDVVLAPIDGRVIDFHDARHAIVIADASGVEIMVHVGLDTVMLAGQGFEALVGKGDTVRAGQPLLRFDAALVAAKASALTEIVVVNGERVRQMDKAAGSVEAGRSVLLTLHLEAADVADVAGDAPGHAQEEALLQSPPIVLPNPAGLHARPAARLASEARGFAARLTLWYGQQQADAKSAVAIMALATRCGDEVRLSGSGSDAAQALAALADLLRSGCGESAGTAALPQAKAAAFALHERSPVFEPAPAAGSLRGVGASPGVAVGQIVRWSGIAPEFDETGGPFEQEHARLHAALQIAASQIKSLVTADTLPDTPQAQIMDAHLAFLEDPMLIEAAEAGLRSGASAAGAWHLACQSVEQHLRLHANPQVRERAADVRDVGVRVLTVLTGAAERPRSLPERSIIVADDLTPSDTITMDRSKVAGLCTVSGGPTSHVAILARSMGIPAVCGVPAQALSLRDGTPAVLDGTAGVLQADPDPALRAEVERRLAAARQQLQADRQTAHRPGRTRDGHRVEVVANVRDAAEAREAVAAGGEGVGLLRSEFLFEDRTAPPDEDEQAAAYQAVAAALGPERPLIVRTLDIGGDKPLRYLPLPKEDNPFLGLRGIRVSLAYPELFRSQLRAMLRAAPGGNLHIMFPMVSDLDEVLVAKRILREEQARYPIPVKIGVMIEVPAAVAIVEALAQEVDFFSIGTNDLTQYTLAIDRGHAGLAARVDALHPAVLRMIALTVEGAHAHGKWVGVCGALASDLAAVPVLVGLGVDELSVSVPAIASVKAALSRLDFEDCRALARRVLPLGSAARVREALAQG

SEQ ID NO: 7633 - protein, 344 aa, Solanum tuberosum
MMSSRFAGTALRQLGPVLFASAPGARAAAEPAYALLAGAPAAAPTRAAVWLVRFPLSRAASTMSAPAAPEGETAAKGDVDVTKKAEGDTEQKAVVSYWGVPPSRVTKEDGSPWRWACFRPWEAYESDMSIDLKKHHAPTTFLDKMAFWTVKSLRWPTDIFFQRRYGCRAMMLETVAAVPGMVGGLLLHLKSLRRFEHSGGWIKALLEEAENERMHLMTFMEVSQPRWYERALVLAVQGVFFNAYFLGYLLSPKFAHRVVGYLEEEAIHSYTEFLKEIDKGTIDNVPAPAIALDYWRLPPGSTLRDVVMVVRADEAHHRDVNHFASDVHYQGHQLKEAPAPLGYH

SEQ ID NO: 7634 - protein, 419 aa, Thermococcus waiotapuensis
MVELDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPWSDIPAPDVYTNPKIMGWMMDEYETIMRRTGPAFGVITGKPLSIGGSLGRGTATAQGAIFTIREAAKALGIDLKGKTIAVQGYGNAGYYTAKLAKEQLGMKVVAVSDSQGGIYNPNGLDPDEVLKWKNETGSVKDFPGATNISNEELLELEVEVLAPAAIEGVITEKNADGVKAKIVAEVANGPVTPEADEILREKGILQIPDFLCNAGGATVSYFEWVQNINGYYWTEEEVREKLDKKMTKAFWDVYNTAKEKNIHMRDGAYVVAVSKVYQAMKDRGWVKH

SEQ ID NO: 7635 - protein, 460 aa, Glycine max
  misc_feature (330)..(330): Xaa can be any naturally occurring amino acid
MAEEFQAAICCESWWNIINPTRSVFPLMPSTCSVAAADAGNYSTWQSTTDFVDLKGTRSCAEETDINLVSSDTSLSFLDAEKPHQSGTGSILIDSTLQMMGFGMSSSTSPNWSQSLLGSSFDSVLQEETGIGGGGSSNDSQIQKDWSPKNFSSDGGSEQVSTVDAFKPMNQEFSLNQQSLNSVVTSTDGSLSGGNFPVVSASYGYPSTLIQSLYEHQPQPQNSLFTNPSMSYGTCSNELSPTWSKVSSFLKPSMPKQQLRGLHFSNNTTPFWNSSAEALNDIRAGVFASSQAQYQTPKFEEKPNWPHTLLKKLKREESPDAAKKNSPEPXAFKRQRIETPSPLPTFKVRKEKLGDRITALQQLVSPFGKTDTASVLHEAIEYIKFLHDQVSVLSTPYMKNNGAPIQHQQDCDNLKDSEGAKQDLRSRGLCLVPISSTFPVANETSVDFWTSTFGGALIGR

SEQ ID NO: 7636 - protein, 233 aa, Triticum aestivum
MKILRRRYYLVEKAKDANIVGILVGTLGVAGYLDIVEQMKNLIKAAGKKSYTLVMGRPNSAKLANFPECEVFVYVSCAQTALLDSKEFLAPVITPFEAVLAFSRGREWTGEYLLDFKELISSEKPEVASKSEEARFSFIKGGYVEDDCPQENEEHSETSLALAELTEKALSTQNQNSDAVLYQGGAKSAIEYLKARSYRGMTGEYEGPAPDSVLIGRTGRAAGYSDEKTKSPQ

SEQ ID NO: 7637 - protein, 533 aa, Nostoc punctiforme PCC 73102
MQRQEKISQVIVTAGQMRDIEDRIFAAGMPVVALMEKVAGLVARRIQEIPQIPCKKAGYVASNSLLKKGLPQAVGSRVGILVGPGHNGGDALVVARELHFRGYEVWIYSPFSKFKELTSQHLQYAQSLGIPIYQTIEQLPDSDLLVDGLFGFGLEKNLTDPIASAINQLNELSVPIYSIDLPSGLHTDTGVVLGTAIRATHTFCLGLWKLAFFQDPALEYVGKAELIDFDIPLADVEAVLKDAPSIKRITPTTALATLPLPRPPVTHKYKEGHLLLICGSRRYAGGAILTGLGARASGVGMLSIAVPESLKSLLVSHLPEALIIGCPETESGAIAQLQLPEKTDLTSFNAIACGPGLTRDATPIVQEVIESERPLILDADGLNILAQMGAIATLKKRLAVTVLTPHAGEFQRLFPDIADAKHDRVKAAQEAALQSGAVVLLKGARTAIANPQGAIWMITESTPALARGGSGDVLTGLLGGLLAQAATKQISVEDIVATAAWWHSQAGILAAQERTELGVDAFTLTQYLLKVLS

SEQ ID NO: 7638 - protein, 403 aa, Ustilago hordei
MSNAPLNGVKLNPLDDPNKVIKVLASDSKTAEQREIAYTNCKVIGNGSFGVVFQAKLVAPAGSESAEGSSKESDEVAIKKVLQDKRFKNRELQIMRIVKHPNVVDLKAFFYSNGDKKDEVFLNLVLEYVPETVYRASRHYAKLKQTMPILLIKLYMYQLLRSLAYIHSIGICHRDIKPQNLLLDPSTGILKLCDFGSAKILIAGEPNVSYICSRYYRAPELIFGATNYTTNIDIWSTGCVMAELMQGQPLFPGESGIDQLVEIIKVLGTPSREQIKTMNPNYMEHKFPQIRPHPFSKVFRPRTPPDAIDLISRLLEYTPSARLTAVEALCHPFFDELRAGEVRMPNGREVPPLFDWTKEELSVRPDLISRLVPQHAEAELLSRGIDVHNFQPIPLESMKVTLD

SEQ ID NO: 7639 - protein, 294 aa, Rickettsia typhi str. Wilmington
MYNIFKGLITALITPFKNNKLDLYAFESILNQQIKHEVDAVLIAGSTGEANSLSFEEYKLLLKTSVEIVNNRMPIISGCSSNNTAYAIELAIASKKIGVDGFMASPPSYVKPTQHGIYKHFEALHEACNLPIMLYSAPTRSGVDFSDETILRLSKLPRILALKDCGVDLERPMRIRAIVKEDFNILTGNDEVVLAFHAQGVIGWISVTSNIAPKICKELLDKWYNNDIQGALEMHQKLLPLYKALFLESNPIPVKYAAHYLGLCENEIRLPLTEASDSAKKQIKKIITSLSIKI

SEQ ID NO: 7640 - protein, 275 aa, marine gamma proteobacterium HTCC2080
MVFELEALAVARGFSYPRAPDLAGAGLMAGLVIANWKMHGSLALIEEFSQQWRGLPQLSEVDAVLCPPTPYLVAVGEAFEGLLLLGAQNCAEQVEGAFTGEVASQMLAEMGCKYVIIGHSERRSLHRESDAQVAIKARTANAAGLNPVVCVGEALEQREAGQQDAVVSEQLLGSLAQVPCDNLVVAYEPIWAIGTGRTASPVQADDMHGVIRQRLQEHFGAAGSEIPIIYGGSVKPENAGVLFGCDNIDGALVGGASLEAKSFWQIASAASAGRA

SEQ ID NO: 7641 - protein, 456 aa, Zea mays
MAWRCNDRAKAHASSLNEHIQDVRNFWSVLDKGPSPSVLSLGLQPTGPIPSSHVDRLAGNFQSSDPFHAAATILLLYSLPFAGADERQTLFSSASAATGQESSIWVGCCCRCDRWGANDGRRRVTATNGDSRLSVAATTYQSTSPAAATYEASLPVVDDYSTMQSGYYTSLLNQDPENVFIFEENMDNANEVMASPASNCLNSQSKSRGRSKNFNEPEDILLISAYLNISKDAITGRDQKDGRFWERVEKYFHVNKTFETDRNWSSLKHRWSIIQKEVSIFQGFHDSIERRNQSGKTSSDKLAEANAMFHEMKGKAFSLFHAWNILRHEPKWTEDKVSKEGLGCNNAIGGAQPNAQRPTGRKAEKENMKEKKRRDDEADPFIEEVKKMRESREQIAMGRKDRDDKLIELENKKLQLEQDQHDEKIMTTDTSNMDDQAKKYFKLMKDEILARRFGSG

SEQ ID NO: 7642 - protein, 221 aa, Gloeobacter violaceus PCC 7421
MLAALFFDLDGTLADTDPLHFQAWQELLDELGLAIDRTFYRTRISGRLNPDIVKELLPALSPEESNQFIERKEGRFRELATGLAPLAGALDVLNWANGRGLKYALVSNAPSENARFMLGALKLEKAFATMVLGEEVAAGKPDPLPYRVALERLGVSASRSLAFEDSPSGVRSAVGAGIPTVGIATTHPPENLLELGAKLVIPDFDDPRLWVLLRSAGSLEC

SEQ ID NO: 7643 - protein, 237 aa, Glycine max
MLCRYNLKSLIHTIVGVGKQVHTPNSISKLHQLQRSSKSLKEGERLVGPMRRPDETLCKPIRIRAGYTPQDEVTIYQPKGALLKKEMGSVGPPGYEPDADSKPKTKSVKRNERKKEKRIQAALEKEKNVSEVEDSGKQESLEALTSQISDMVAIAKIMKATLVFPTLDHDSFWTNSSDFKQIFDWKNFTEVLKDDVQIVESLSPEFATIKPVLKAPAGYNAGEVLQLLKKHKVIKFT

SEQ ID NO: 7644 - protein, 297 aa, Arabidopsis thaliana
  misc_feature (222)..(222): Xaa can be any naturally occurring amino acid
RTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNEXIAKEVNGFTIHALASHLRPDSKGNGTAPPADSSHSHTNIICTCEKVPLASSLAPSLHDQCHQTHLSCYPTSSKCK

SEQ ID NO: 7645 - protein, 261 aa, Brassica napus
MAQMATLTAKQANEYLNARPKYPTIWYKVLAGRTSNHKVAWDVGTGNGQAALGVADYYEKVVATDINEKQISLAKPHPKVTYLHTPASMSDDDLVAKLGGENSIDLIVAAQSLHYFDLKRFYAIVRRVLRKEGGIIAVWVYNDLVVTPKVDAIMKRLVDSTKPYRTPTMNLAFDGYKAIEFPFKNIRLGTQGRPKALEIPHKLSLDGYLGFFKSWQPLVKAKEQGAELLKPSMINEFKEAWGDQNQVKDVAYRAFMLAGKL

SEQ ID NO: 7646 - protein, 394 aa, Cryptococcus neoformans var. neoformans B-3501A
MEPKPLTAYQQTYHWRNKNCAPFAYDWIKQSLPGLKVDDGQQSAEISSVTSVSGDCDLGQRKGKLLTIYDLEVQASWIGKTKDGNEVKGTLKIPEVSHEAIDGVSDYVYEFSITGGGSSASEELLFYIRKSFPPLLSDKFNSFRPALLAAHGSATADAASAPDSGASTPAAYTPAPPTKGADEPINEEQKKEKKSVGATVTVEVKADLQASADDLWGLLTDENKIPMWSRSAAKLSLKAGSPYELFGGNVRGKVITADPPKKLVQTWQVKSPSWPSEHYGTMTLSLSQGSDTTAATFTLDGVPAGTQADVEKALNSFYIQGLKQMGLVSSSISTSFITPIRPKQKKLRRKRPSSSWFNSPIIGGAAVVGLSALLIGVVYTSFPSSTFLSGMRQQ

SEQ ID NO: 7647 - protein, 368 aa, Streptococcus thermophilus
MQNKEKHSQVAILGLQHLLAMYSGSNLVPIMIAGALGYSAHQLTYLISTDIFMCGVATFLQLQLNKHFGIGLPVMLGVAFQSVAPLNMIGKSHGSGAMFGALIISGIYVIFVSGVFSKFANLFPSIVTGSVITTIGLTSLSLSLSEIWGTTLTNQLVKAFFLAAITVLIILLVNIFTKGFIKSISILIDLVIGTVIAASMGLIDFSPVAAEPVVHVPTPFYFGMPKFELSSIIMMCIIATVSMVESTGVYLALSDITKDPIDSTRLRNGYRAEGMAVLLGGLFNTFPYTGFSQNVGLVKLSGIKKRLPIYYTAGFLVLLGLLPKFGAWLKSSQAPSTWWCYASHVQFCFYFKGCKFLTRVDFANNEHN

SEQ ID NO: 7648 - protein, 359 aa, Staphylococcus carnosus
MSEKVKFEKREDLKQKPDPKNLGFGQYFTDYMLSYDYDSEKGGWHDLKITPYAPIELDPAAQGLHYGQLVFEGLKAYKHNGEVVLFRPDQNFARINQSLDRLEMPQIDEEELLEGLKQLVDVERDWVPEGEGQSLYIRPFVFATEAGLGVHPAHNYKLLIILSPSGSYYGGDSLKPTRIYVEDEYVRAVRGGVGFAKVAGNYAASLLSQSNANEQGYDQVLWLDGVERKYIEEVGSMNIFFVENGKLVTPKLNGSILPGITRKTVIALAKELGYEVEERHISIDELLESYDKGELEEVFGTGTAAVISPVGTLKYEDREITINNNETGPITQRLYDEYTGIQSGKLDDPQGWRVVVPEY

SEQ ID NO: 7649 - protein, 234 aa, Streptomyces carzinostaticus subsp. neocarzinostaticus
MILAGGKGTRLRPYTSRLPKPLVPIGDEFSILEIVLSQLSQRGFDTVTLAIGYLGHLIRSFVGDGSRWNMHITYASEDTPRGTIGPVLGILDQLPEHFLVMNGDILTDLDYADVLAHHTRGEAPLTVATCTREVRIDFGVLTTTSNRVVHFVEKPTVDYRVSMGVYGLSRTTLETYPSHMPFGFDDLVLDLLARGVQPAEYPFDGYWLDIGRPDDYDRANAEFDSIKGTLLKGA

SEQ ID NO: 7650 - protein, 386 aa, Shigella flexneri 2a str. 301
MTNNPLIPQSKLPQLGTTIFTQMSALAQQHQAINLSQGFPDFDGPRYLQERLAYHVAQGANQYAPMTGVQALREAIAQKTERLYGYQPDADSDITVTAGATEALYAAITALVRNGDEVICFDPSYDSYAPAIALSGGIVKRMALQPPHFRVDWQEFAALLSERTRLVILNTPHNPSATVWQQADFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTLDDVEFCQWLTQEHGVAAIPLSVFCADPFPHKLIRLCFAKKESTLLAAAERLRQL

SEQ ID NO: 7651 - protein, 445 aa, Oryza sativa (japonica cultivar-group)
MEVSASAAAEAGMMVGHGEWRDDDGRARRMGTVWTASAHIITAVIGSGVLSLAWAIAQLGWVAGPAVMLLFAFVIYYTSTLLAECYRSGDPCTGKRNYTYMDAVRANLGGSKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGTGVTSMQKDTIKAPPPSEAKVMKRATMVSVATTTVFYMLCGCMGYAAFGDKSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVAAAAGSIADVVDALKVYRPFSG

SEQ ID NO: 7652 - protein, 463 aa, Arabidopsis thaliana
MLTTTTDEEIDLSCDGGVTEPQKVAIIFAFCGVGYQGMQKNPGAKTIEGELEEALFHAGAVPESIRGKPKLYDFARSARTDKGVSAVGQVVSGRFIVDPLGFVNRLNSNLPNQIRIFGYKHVTPSFSSKKFCDRRRYVYLLPVFALDPISHRDRETVMASLGPGEEYVKCFECSERGRKIPPGLVGKWKGTNFGTKSLDFQSDISSNNSSALRSDIKIEALSSNLAGLCSVDVEVGRIQEDSCKLNTNSSETKVKSKFCYGEKEKERFSRILSCYVGSYNFHNFTTRTKADDPTANRQIISFTANTVINLDGIDFIKCEVLGKSFMLHQIRKMMGLAVAIMRNCASESLIQSAFSKDVNITVPMAPEVGLYLDECFFTSYNRNFEDSHEEVSMEAYKEEAEAFKLKHIYSHIGATERKYGNMALWLHSLNYRNYPDLNFGSCGQNTDQVLVHKKIDERASHSL

SEQ ID NO: 7653 - protein, 183 aa, Brassica napus
MLSSLKVTGPKPNSPEQKFESNIVISDEEGVEENDSPIEEVRLTVPITDDPSQPVLTFRTWFLGMSSCVVLAFVNIFFGYRSNPLMVSSVVAQIVTLPLGKLMATTLPTRKFRLPGTSWSGSLNPGPFNTKGHVLITIFANTGAGGAYATSVITIVKAFYHRNLDLTAAMLLLQTTQEKKKKK

SEQ ID NO: 7654 - protein, 1112 aa, Pyrococcus abyssi GE5
MDREEIIERFLRFLREYAEEGEEPLYIGKIKDLLAITPKRSIAINWMHLNSFDPELAEEVLENPEECILAAEDAIQIILKEDIMREDVPRIHARFYNLPKTLMVKEIGAEHINKLIQVEGVVTRVTEIKPFVSSAVFVCKDCGHEMVVQQKPYEGFVAVKKCEKCGSKNVQLDVEKSKFVNFQMFRIQDRPETLKGGQMPRFIDGILLDDIVDTAMPGDRVVVVGILRVVQEKREKVPTFKKVIEVNYIEPVSKEIEELEITPEEEQKIRELAKRKDIVDAIVDSIAPAIYGYREVKKGIALALFGGVPRTLPDGTRLRGDIHVLLVGDPGVAKCVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHNSQLLRYIANLAPRAIYTSGKSSSAAGLCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNTAAVVRDEFTGGWVLEAGALVLADGGYALIDELDKMNDKDRSVIHEALEQQTISLSKAGITATLNARTTVIAAANPKQGRFNRMKRISEQINLPPTLMSRFDLIFVLVDEPDEKIDSEIARHILRVRRGESEVVTPKIPHDLLRKYIAYARKNVHPVISEEAMEEIEKYYVKMRKSVKKSSEEEIKPIPITARQLEALIRLSEAHARMRLSPIVTREDAREAIKLMEYTLRQIAVDETGQIDVTILEVGQSARKLSKVERILDIIEKLEGTSEKGAKIDDILEEAKKFGIEKQEAREILEKLLEQGQIYMPENGYYRTV

SEQ ID NO: 7655 - protein, 253 aa, Zea mays
  misc_feature (219)..(219): Xaa can be any naturally occurring amino acid
MNYRFQNLLGAPYRGGDAVFAGDSSVLLSAVGNRVATTDLAASTSLTLPFESSANIARLATSPSGDFLLACDDKGRALYANLRRRAVLHRVSFKAAPSAVRFSPDGELIAVAVGKLVQIWRSPSFRKEFFPFHLLRTFPGFAAGVTSFDWSPDSASLLVACKDLTARLLPVKRGTGNKPFLFLGHRAAVVVAFFATDKKTGKVHGVYTVSKDGAIFTWXNLVEGNDAASPPSPGTPEQESEQNGEPELDAGSR

SEQ ID NO: 7656 - protein, 492 aa, Burkholderia thailandensis E264
MSAMSVYGLQRLYIAGAYADATSGKTFDTFDPATGELLASVQQASADDVERAVASAREGQREWAAMTSMQRSRILRRAVELLRERNDALAELEMRDTGKPIAETRAVDIVTGADVIEYYAGLATAIEGLQVPLRPESFVYTRREPLGVCAGIGAWNYPIQIACWKSAPALAAGNAMIFKPSEVTPLSALKLAEIYTEAGVPAGVFNVVQGDGSVGALLTAHPGIAKVSFTGGVETGKKVMSLAGASSLKEVTMELGGKSPLIVFDDADLDRAADIAVTANFFSAGQVCTNGTRVFVQQAVKDAFVERVLERVARIRVGKPSDPDTNFGPLASAAQLDKVLGYIESGKAEGAKLLAGGARLVNDHFASGQYVAPTVFGDCRDDMKIVREEIFGPVMSILSFETEDEAIARANATEYGLAAGVVTENLSRAHRAIHRLEAGICWINTWGESPAEMPVGGYKQSGVGRENGITTLEHYTRIKSVQVELGRYQPVF

SEQ ID NO: 7657 - protein, 920 aa, Oryza sativa
MAAPPKAWKAEYAKSGRSSCKSCRSPIGKDQLRLGKMMWNHASCILRIDTLRWDDQEKIRNYVGSAPATASSAAAISDKCTIEVAKSARTSCRRCGEKIKKGTVRVSSKLEGQGWYHASCFLEMSPAATVENFSGWEILSHEDKRAVLDLVKKDAPSSGQTSSKGSKRKNNQNDIHDCKAPKIIRSISEGTAEDKGKAVVSHDSNANSSDLQEKLKEQSDTLWKLKDELKKHVSTAELRNMLEANGQDTSGPERHLLDRCADGMLFGALGTCPVCSSFLYYHGGQYHCSGYVSEWSKCTYSTTEPVRSKKKWKIPDEMDNGYLTKWFKSQKAKKPERVLPPMSPEKSLCQSTQQNRSFLSEGLDKLRVSIVGQSKDVVDGWKQKLKDAGANFNATVTKDSSCLVLCSELESENAEVKKARRLKIPILREGYLGECIRKNRVLPFDLYKVEAALESSKGGTMTVKVKGRSAVHESSGLQDTGHILEDGKSIYNTTLNMSDLTREDNGSDCYVFRKWGRVGNEKIGGTKLEEMSKIHAIQEFRRLFLEKTGNPWEAWEQKTNFQKQPGKFYPLDIDYGVRQGPKRKDIDKMKSSLPPQLLELMNMLFNIETYRAAMLEFKINMSEMPLGKLSKENIQKGFEALTEIQNLLGNTNNQELAVRESLIVAASNRFFTLIPSIHPHIIQDEDDLMVKVKMLEALQDIEIASKLVGFDSDNDESLDDKYKKLRCAITPLPHDCEDYKLVEKYLLNTHAPTHKAYSTIQTIVSVFFCIGSRLTNYVGILSQGLRIAPPEAPVTGYMFGKGLYFADLVSKSAQYCYVDRKNPVGLMLLSEVALGDMYELKKATSMDKPPRGKHSTKGLGKTVPLESEFAKWRDDVVVPCGKPVPASIKTSELMYNEYIVYNTSQVKMQYLLKVRFHHKR

SEQ ID NO: 7658 - protein, 168 aa, Brassica napus
NNKIDVYAYGVVLLELLSGRKPINSESPKARESLVMWAKSILEDGDYSQLLDPSLLDDNDGDQMERMALAATLCIRHNPQSRPDMGMVLNLVKGDMEILKWAKEEISSGLEDSKLLKDEKLHRSNLQSHLNLAFLDMEDDAHSMVSMDQGISVEDYLKGRESRSSSFN

SEQ ID NO: 7659 - protein, 393 aa, Ralstonia eutropha JMP134
MDPQRLATASRLANIDAFHVMELAKQANELERVGRHIIHMGIGEPDFTAAEPVVRAAEAAMRRGVTQYTGALGIHALREAIAGYYKTMYGLEIPARRVIVTAGASGALLLACAVLVEIGAEVLMPDPSYPCNRHFVAAFDGAARMIPSGPAERFQLTAAQVEAHWNERTRGVLLASPSNPTGTSILPDELGRILQAVRARQGFAILDEIYQGLSYDAPPVSALSLDDNVVTVNSFSKYFNMTGWRLGWLVVPDALVADFEKVAQNLFICASAVAQHAALACFSPEAMAIYDERKAEFRRRRDLIVPALESLGLHVPVMPDGAFYVYADCRQVNHPAAGDADKLTQAMLHDAGVVMVPGQDFGPHTAQDYIRISYATSRQNIEEAMARLQKLFR

SEQ ID NO: 7660 - protein, 577 aa, Bacillus thuringiensis serovar konkukian str. 97-27
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLDNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQMPYARKEAEVSEWKENGVIGLAEVVKQVKPTILIGTSTVAGAFKEEIIKEMASHVERPIILPMSNPTPLAEAKPADLIKWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVTI

SEQ ID NO: 7661 - protein, 792 aa, Mesorhizobium loti MAFF303099
MTILSELERKVLWLAVWMIHHANHVRGSDDGLKIGGHQASSASASTLLTALYFQILRPEDRVAVKPHASPVFHAIQYLFGKQTLEQLQNFRGYRGAQSYPSRTKDIDDVDFSTGSVGLGVAQTLFSSLVQDYVRAKGWNADKPDGRMVALLGDAEMDEGNIFEALLEGWKHGLRNTWWVVDYNRQSLDAVVREGLWQRFESIFRNFGWDVVILKHGTMQKAAFEEEGGEKLRSWIDACPNQLYSALTFQGGAAWRRRLLDDLGDQGPVTRLIEKRSDDDLAALMANLGGHDLASIIDAFEQARGHDRPTCFIAYTIKGFGLPLAGHKDNHAGLMTPAQVDALRQGMGVREGREWDLFEGLAYDEAAIRSYLASSPFAQAATRRHKTPAVPVPQIPWGAQASMSTQQGFGLLMHEIAKSDSDFSKRVVTTSPDVTVSTNLGAWVNRRGLFARGGQADLFREERIPSTFNWTFSPSGQHLELGISEMNLFTMLSALGLSHTLHGERLLPVGTLYDPFIERGLDALNYACYQDARFILAATPSGVTLAPEGGAHQSIATPLIGMAQDGLAAFEPAYVDELAVILRWAFDYIQRSGEAEPDNHSWLRDQTGGSVYLRLSTRSIEQPARQMEDPLARAIVDGAYWLRKPGPNAAVVIAYSGAVAPEAVQALGLMAGDRRDVGLLAVTSADRLNAGWSAAARARQYGHPRATSHVERLLAGLPASCAIVTVLDGHPATLAWLGSVHGHRTRALGVEHFGQTGTIADLYQYYGIDAQGIMAAAQSVSVGRPLRHLGSAA

SEQ ID NO: 7662 - protein, 434 aa, Synechococcus elongatus PCC 7942
MDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDANGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 7663 - protein, 403 aa, Acidovorax sp. JS42
MLFDGAAWNTALDWLAHGVWDLAWWQIVLYTLATTHITIAAVTIFLHRSQAHRALDLGPVPAHFFRFWLWLGTGMVTKEWVAIHRKHHAKCETPDDPHSPQTRGLRTVMWRGAELYRAEAANAETLKKFGHGTPDDWMERNVYSRFTWQGVGLMLVINLVLFGAVGAAVWAVQMAWIPFWAAGVVNGVGHYWGYRNFEAQDASTNLVPWGLVIGGEELHNNHHTYPTAAKFSVKPYEFDVGWLYISALQRLGWAKVKKVPPKLRLGAVKPVADEKTLEALIANRYEVMAGYARGVRQACKDEIAALKARKADVSALKRAKRWLHRDAEKVPAQAQPTLAEVRAAHPVLDKMVTMREELRQLWLNTSQSRDQLTADLQAWCQRAEASGIAALKEFSLKLRAAHA

SEQ ID NO: 7664 - protein, 397 aa, Synechococcus elongatus PCC 7942
MAANLLEQLRGMTVVVADTGDIQSIATFTPRDATTNPSLITAAAQMPQYQSIIDDTLRQVRTELGAEAPVEAIVAEAIDELFVAFGLRILEIVPGRVSTEVDARLSYDTEATIAKARKLIGLYERAGIRRDRVLIKIASTWEGIRAAEVLEKEGIHCNLTLLFGFHQAVACAEAGVTLISPFVGRILDWYKKESGRDAFPGAEDPGVQSVTQIYNYYKKFGYATEVMGASFRNISEIIELAGCDLLTISPGLLEELRQTEALLERKLDPAIAESLELEQIHLDRDRFAELHQADRMANEKLDEGIRGFCKAIDTLEGLLKQRLAVLEGKAVFHHAAHEVFSVCDLDGDGFITREEWLGSDAVFDALDLNKDGKLNEEDLLAGLGATLQMAGRAVATV

SEQ ID NO: 7665 - protein, 412 aa, Shigella flexneri 2a str. 301
MKALTYHGPHHVQVENVPDPGIEQADDIILRITVTAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNVQIQQGSSVAVYGAGPVGLLTIACARLLGAEQIFVVDHHPYRLRFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLTFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 7666 - protein, 525 aa, Ralstonia solanacearum GMI1000
MPTPPPDALDASPQPVNRGNALLVLAVFVVASCGLAYELIAGALASYLLGDSILQFSSIIGAYLFAMGIGSWVSRYVADDALLARFVDLELLVGLFGGVSAAALFLLFALESAPFRLVLYALVTVIGVLVGMEIPLVMRMLHRRQAKFSDLVSRVLTFDYLGALAVSLLFPLVLAPRLGLVRTGFLFGLCNTAIAVWTLWHFRAELGLSARLRGAMAWRAGMVGAALLAGFAASDRLTHWSERALFGDEIIHAISSPYQRLVVTRWKDDLRLYINGNLQFSSRDEYRYHEALVLPALESVRGARRVLVLGGGDGLALRQILKYPQVEHVTLVDLDPRMTSLFSHAEALVALNQHAFSDPRVTVVNADAGQWLQTAADMFDVAIVDFPDPSNFSIGKLYSVPFYRLLSRHVADTGLVVIQATSPYFAPRSYWCVDATLKEAGYRTWPYHALVPSFGEWGFILAAPGRADFRPPTTYRVPTRFLDADTTHQMFSFAPDMPRPQVEPNRLNNQSLVRYFEEDWHGVLR

SEQ ID NO: 7667 - protein, 368 aa, Zea mays
MISPTNLLPARKITPVSNGGAATASPSSPSVAARPRRLPSGLQSVTGRGKVSLAAITLDDYLPMRSTEVKNRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEARF

SEQ ID NO: 7668 - protein, 112 aa, Zea mays
  misc_feature (20)..(20): Xaa can be any naturally occurring amino acid
  misc_feature (22)..(22): Xaa can be any naturally occurring amino acid
  misc_feature (38)..(38): Xaa can be any naturally occurring amino acid
  misc_feature (79)..(79): Xaa can be any naturally occurring amino acid
ACTLQTDLYLWIMKSSGGPXYXYIDIDGDTLDELMLSXTHMKGLRPLLTFSTNFDEQAHWKLVKEMITQICASSKDHRXAKTFHDHVFVLSFDDGNVLFSNYQILVPHNEID

SEQ ID NO: 7669 - protein, 270 aa, Schizosaccharomyces pombe 972h-
MSTLDLNHLADLYDRKDWNACKKELLKLKVELAKQNLFVPTSDKEKASFARNVFEYGVLVSIQTCDIESFARYASQVIPFYHDSLVPSSRMGLVTGLNLLYLLSENRIAEFHTALESVPDKSLFERDPYVEWVISLEQNVMEGAFDKVASMIRSCNFPEFSYFMKIVMSMVRNEIATCAEKVYSEIPLSNATSLLYLENTKETEKLAEERGWDIRDGVIYFPKEANALETEDGMLIDEEDELELPPTASKHTISSIRQLLSYTSELEQIV

SEQ ID NO: 7670 - protein, 133 aa, Oryza sativa (japonica cultivar-group)
MEIQQQKGVGNSKVVKVEKEESWDLFVNQASNEGHPVVAHFGASWCVTSLSMNYKFEELAQTHPEILFLYVDVDDVQSVSSKLGVKAMPTFFLIKDKEVVNKIVGANPDEVKKMVDASAESFGVTAPPDIVVE

SEQ ID NO: 7671 - protein, 497 aa, Zea mays
MSPPPPPPLLRNELSRRTAVLGLRLWVLVGIAVGAAFVLLLVLISLHLAAARRRRPRKGVAHAPAGAPPLSPSTIPPVSKEIQEVAVHVGSLRHYLETGHAFLKDGGDGDGDGESVAHGSQRVHIEAGKGQRMVAAASDALSAAVGPEVSHLGWGHWYTLRELEEATAAFAPEHVVGEGGYGIVYRGVLADGYQVAVKNLLNNRGQAEREFRVEVEAIGRVRHKNLVRLLGYCAEGAQRILVYEYVDNGNLEQWLHGDVGAVSPLTWDVRMNIVLGMAKGITYLHEGLEPKVVHRDIKSSNILLDRRWNPKVSDFGLAKLLGADSNYVTTRVMGTFGYVAPEYASTGMLNERSDVYSFGILIMEIISGRSPVDYARPAGEVNLVEWLKNKVTNRDYEAIVDPKLPEKPSSKALKKALLVALRCVDPDSQKRPKMGHVIHMLEVDDFPYREDRRTLRPGNGSPLEKARNPAAGSCDGSSCYGGDTTTASTPSRLVQDM

SEQ ID NO: 7672 - protein, 398 aa, Streptococcus pneumoniae TIGR4
MRKSIVLAADNAYLIPLETTIKSVLYHNRDVDFYILNSDIAPEWFKLLGRKMEVVNSTIRSVHIDKELFESYKTGPHINYASYFRFFATEVVESDRVLYLDSDIIVTGELATLFEIDLKGYSIGAVDDVYAYEGRKSGFNTGMLLMDVAKWKEHSIVNSLLELAAEQNQVVHLGDQSILNIYFEDNWLALDKTYNYMVGIDIYHLAQECERLDDNPPTIVHYASHDKPWNTYSISRLRELWWVYRDLDWSEIAFQRSDLNYFERSNQSKKQVMLVTWSADIKHLEYLVQRLPDWHFHLAAPCDCSEELTSLSQYTNVTVYQNVLHSRIDWLLDDSIVYLDINTGGEVFNVVTRAQESGKKIFAFDITRKSMDDGLYDGIFSVERPDDLVDRMKNIEIE

SEQ ID NO: 7673 - protein, 138 aa, Cucurbita ficifolia
MGMGMLEVHLISGKGLHAHDPLNAPIDPYVEINYKGQERMSKVAKNAGPNPIWNEKFKFLAEYPGSGGDFHILFKVMDHDNIDGDDYIGDAIIDVKDLLAEGVIKGWSELAPRMYQVLAHKLYFKGEIEVGVSFKRQA

SEQ ID NO: 7674 - protein, 467 aa, Pseudomonas aeruginosa UCBPP-PA14
MGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIIEPLIQGAGGMRMYHPVYLKLLREACDRYGVHLIHDEIAVGFGRTGTMFACEQAGIAPDFLCLSKALTGGYLPMSAVLTSETIYRGFYDDYQTLRAFLHSHTYTGNPLACAAALATLDIFEEDKVIEANRALSTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 7675 - protein, 150 aa, Cucurbita maxima
MGMGMLEVHLISGKGLQAHDPLNKPIDPYVDINYKGQERMSGVAKNGGPNPLWDEKFKFLAEYPGSGGDFHILFKVMDHDAIDGDDYIGDVKIDVKDLLAEGVRKGWSEIPPRMYHVLAHKIHFKGEIEVGVSFKLQGGGGCGGCNPWEN

SEQ ID NO: 7676 - protein, 138 aa, Cucurbita maxima
MGMGMLEVHLISGKGLQAHDPLNKPIDPYVDINYKGQERMSGVAKNAGPDPVWNEKFKFLAEYPGSGGDFHILFKVMDHDVIDGDDYIGDVKIDVKDLLAEGIRNGWSELPPRMYQVIAHKRYFKGEIEVGVFFQRQG

SEQ ID NO: 7677 - protein, 622 aa, Burkholderia thailandensis E264
MCGITGWIDFSRDLRNEAPIVGTMTDTLARRGPDARGVWLDTHAALGHRRLSIIDLERGAQPMLTPERGPRGLPRAVISYAGETYNFRELRAELGALGHRFDTHCDTEVVLRAYLEWGAAFVDRLNGMYSIAIWDTARDELLLVRDRLGVKPLFYYPTADGVIFGSEPKAILAHPDVRARTSSEGLCDALLFLRTPGQVPFSGMREVKPGHLLRVRRGGLVEERYWALEARPHTDDLPTTIATIRALLDDIVSRQMISDVPLCALLSGGVDSSTVAALAQKQRRANGGGALATFCVDFTGHTRNFRADPIRPTADAPFALEVARHIGSDHHTIELDQAGLLDPQVRETVLRAWDLPFNFADLDVSLYRLFAEVRQHASVALSGEAADEIFGGYLWFSDPVARRAQTFPWLKLGAHRGLDPRALFHRAFIDELKLGEYEAQLYRAALAEVPRLDGESAEDRRTRELHYLTLTRWLPVLLDKKDRMGMASGLEGRVPFCDHRLVEYVFNIPWSMKTFSGQEKALLRAAAADLLPDSVLSRKKAAYPSIQTPGYDRGLIERLNRAIAAGRAPLEPFIDAGALRNLTAKTATGSLSEFERILLESSSRLNDWLDLYRVELDGVPAG

SEQ ID NO: 7678 - protein, 709 aa, Magnaporthe grisea 70-15
MPLVMVAGYPTSGKSTRAKQLYDDFSERLKTPAGSKYRLHLISDETLSISRCVYDLSPDKVPEHTRSANASEKDARAAIYAAVRRVLSPRDIVILDHLNYIKGWRYQLFCEAKNISTPSCVLQIGCSVDRARAVNEERLARRDGSRSDEAGAEDAPVVEPYEPANWDNLVFRYEEPNAMSRWDSPLFALVWDDDEARAKEVFQDIWEGIAGDGREKVVPNKVVIQRGKDAGGDYLYTLDRETQAIVKRILELQPEEGGGEIKIPKASGDGDLTLELPGRKLLLPQLQRLRRAFLGMNRGGIGLEGLGNIFWDKRRRKITSRPVSPRLLHMSGDQAMIKRYRLSIGRRCHFGIMALLTQTFTAAPTNSIDLRLTELDRLLSRLQQSALRASAERQRLLLSNAFAREKLSTSIEHARAQLSGLERDALGVKIHAHRQGLQADLNRKREVVEELVERMRDLEEMAGSMSNGDKDGDEDEDDGGDDVLSAIGVSTSSGTDEIIPTPSESMDSTSVDSAIHGGEPAAATIPSPVQRHDEGSKGAAQAAAPPVYKGPETTTTQSIRSRGANQSSSGGGHDAKTTAAAATTGHNLFGTREREAGALTTATTEAILDQQRAEQDQLSESMVKMARSLKESSRAFAASLEEDQAVMQRAGEGLNKNELGIEAATRRMGTLRKMTEGEGWWGRMRLYAMVYGLMVVLILFVFVIPKLRF

SEQ ID NO: 7679 - protein, 334 aa, Oryza sativa (indica cultivar-group)
MPRSHHLLAAAVAAVVVVVMGWSARPCEASLYQPPPPAMAYHDGAVLEGAVPVSVLYYGAFPPHHRAVVADFLMSLSPRGRDHQPHTFGAPGPAPPPTVARWWGTVERYVRKAGRGGGAGVARVVLASQVDDEGCSLGRRLSRAQVERLAARLGVAPGGVAVVTDRRRRRRRGVLLQRLRRARLVGAGGGAVHVWVGDASAQCPGRCAWPFHAADYGDADAGRHRRAHGHDVALRAPNGDAGVDGVVINLAALMAGAVTNPYGRGYFQGDAAAPVEVAGACPGVYGRGAYPGYPGAVRVDAATGAGYNVVGRNGRRYLVPALVDPDNYSCLIMT

SEQ ID NO: 7680 - protein, 471 aa, Bacillus cereus E33L
MSNLLKKKSVTQLLEHNQSKTLTKTLGAFDLIMLGVGSIVGTGVLVLTGLVAARDAGPAVIFSFVLAAIICGFIALCYAEIASTLPASGSVYTYSYATMGEFVAHLVGWSLLLIYIVATAAVAAGWTGYFHNLIKGFGLEIPKALVTIPSHGGIVNLPAVIITLILAWMLSRGTKESKRINNIMVLIKIGMILLFITVGIFYVKPMNWIPIAPYGLSGVFTGGAAILFAFTGFDILATSAEEVKDPKRNLPIGIIASLIICTIIYIMVCLVMTGMVSYKELNVPEAMAYVMEVVGQGKVAGAIAAGAVIGLMAVIFSNMYAATRVFFAMSRDGLLPKSFAKVNKKTGAPTFITGLAGIGSSIIAGFIDLKELVNLVNIGSLVTFALVCLSVIMLRKSHPNLKRGFMVPFVPVLPCVAIVCCVFLMLNLPLSTWVYFSIWITIGGVIYFLYSIKHSNLNEETISKLHDKIAR

SEQ ID NO: 7681 - protein, 105 aa, Magnetospirillum magnetotacticum MS-1
MDTDVSSTDRPDDAGNQPLPQHLVVMGVAGSGKTTVATLLAQRLGTEYAEADRFHPQANIDKMSAGTPLTDDDRWPWLEAIRDWLSSEAEAGRSGVVTCSRSSAP

SEQ ID NO: 7682 - protein, 102 aa, Gloeobacter violaceus PCC 7421
METAMSDAFSAQISERICRHMNEDHGDAIALYARAFGGAGDCEAARMLSIDAQGMNLLVSDKDAQVPVRVTFERPLKDAEDAHQTLIGMVKTARARLSGQPS

SEQ ID NO: 7683 - protein, 550 aa, Xanthobacter autotrophicus Py2
MATNNLAKIEKAPKSNLSGLNLLHDPVRNKGTAYTRDDRRQLGLEGLLPHAVETLDRQVERVLDHLDHVKDELDQYSYLMDLEARNETVFYKAVMSDPKRFIPILYDPTVADACEAFGNLYRRPRGMYITRHMKGRMAEVLRNWPQKDIRFVCVSTGGRILGLGDIGANGMGIPIGKLQLYTACAAVPPDVLLPVLFDIGTSNEHLRADPFYLGTREAPVSEAELDELTEEFVQAVNEVFPGCCVHFEDWKGTDAIRMLDRYKDKILCYNDDIQGTASVALAGIAAAMKQTGGKLKDQRILFLGAGSAGLGISKLIAAELQTLGLSAEEARKRVRLFDVNGLIESSRTDLTETQKLWAQNEKPTNNFLEVIESFKPTVLIGVSTKPRAFTKEVIEAMSRLNDRPVIFALSNPTHKAECTAEQAYTWSKGKALFAAGVQFDEVAYDGKTYRPGQANNFYIYPAIGLATYAARPKLLNDECFIVAAHATADQVGPSLQAKGMLFPSQEHILETEVTTATRIVEYMFDAGLATVERPREIRSWVESLLYAPAY

SEQ ID NO: 7684 - protein, 146 aa, Arabidopsis thaliana
MAWDLFLWIVSFFVSLALVASVFYQVICLTDLEADYLNPFETSTRINRLVIPEFILQGSLCLLFLLTWHWVFFLVAVPVTVYHAMLYKERRYLIDVTEVFRGISFEKKLRYTKLGFYVFLFIMVVFRLTLSAVYSFTEDDDLLHLF

SEQ ID NO: 7685 - protein, 824 aa, Oryza sativa (indica cultivar-group)
MSVPAIAVYTSPPGAVYTSSSSSELEASSRGSAPCATAAPPSPASSHRHQAIAGGLSCLFSSPTAAPRAAAAQDELGALWHDRSGEATAVGGGGGGGGYSYPQPSSPFKWRDMLHHSPVPLFHSPASSPASRSPSASWLAGRERERLFSSFVRNALGSCVDYAPVAALPLGVSAAVGVGAGELAFELDEHLSEAEPSCEPYARDLLAGAQARHRIFHDELVVKAFFEAERAHRGQTRASGDPYLQHCVETAVLLAKIGANATVVSAGLLHDTIDDSFMDYDQIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVISFDEALLTSTLDKLDKGLRDEGISYHSLSGRHKSLYSIYSKMIKKNLTMDDVHDIHGLRLVVDTEQDCYQALDIVHKLWPRVAGRFKDYILHPKLNGYRSLHTVIMCEGIHPFEVQIRTKEMHLQAEYGFAAHWRYKEGGCKHSFVLQMVEWARWVLTWQCEAMSKERSSGLGRSDAIRPPCPFPSHSEDCPYSYTRQCNHDGPIFVIMLEHDKMSVQELPANSTVVDLMERVGANSPRCSPYSFPLKEELRPRVNHKPISDPNRKLCMGDVVELTPALPHKSLTEYREEIQRMYERGGFALATTRDVFVGQKLCAQLVDEPRIVGSGGDSSPGKASGQEAVLNEEKAEENSQLSCRNHESNQTCYQNGDRDLEGTSQSGWIAGLEPWRDATRRSDIEGMAGRWSSIFRVIFGSGVD

SEQ ID NO: 7686 - protein, 184 aa, Brassica napus
MAEETLTRTDSAEPTDKKRVRDESDGAVLDSPEVKRLRDDLFDVFDDSDPEPVSQDLDSVMKSFEDELSSAQPRGETQPDLGYLLEASDDELGLPPPPPPVSVVEEVETTETVADLVRASSDSSGIDELWGFEDHVPDYGSLDFGSGVGDGGDYVTVEGLFDFSGECFDSGDLFSWRPESLPAE

SEQ ID NO: 7687 - protein, 383 aa, Glycine max
MEVCEPVKSENRLKHRPLTPFRLLRGLICLVVFLSTALMCLVYFVPVAVVGLRLFSVRCSRKTVSFIFGLWLSLWPSLFEKINKTKVVFSGDSVPMKERVLLIANHRTEVDWMYLWDLALRKGRLGCIKYILKSSLMKLPIFGWGFHILEFIAVERKWEIDEQILQQKLSTFKDPQDPLWLALFPEGTDYTDQKSKTSKKFAAEAGLPVLTNVLLPKTKGFHACLEALRGSLDAVYDVTIAYKNQCPSFLDNVFGVDPSEVHLHVRRIPVEEIPASETKAASWLIDTFQIKDQLLSDFKIQGHFPNQLNENEISRFKSLLSFMVIVSFTAMFIYFTFFSVIWFKLYVGLSCAYLTLATRFNFQLMPLSSYVHALHNSKNQKSE

SEQ ID NO: 7688 - protein, 58 aa, Metrosideros excelsa
LVMTDPDVPGPSDPYLREHLHWMVTDIPGTTDATFGKEVVEYEMPRPNIGIHRFESLV

SEQ ID NO: 7689 - protein, 356 aa, Rhodococcus sp. RHA1
MNTSPTTASHAIEVPTHAQAVVAHGAQDLRVEEVPIAAPKPDEAVIRIAYGGICGSDLHYWQHGAAGESILRAPMRLGHEASGTVLIGATDGSGPGAGTPVTIHPATPGGDSAKYPADRPNISPGCTYLGSAAHFPHADGLFVSHVAVPTRMLRVLPDGLDLRLASLAEPASVAWHAVARAGEVKDRSVLVIGAGPIGALVVAVLKRAGAGKITAVDMHEYPLRIARAVGADETLTATDADAVAAVEADVTIECSGNHRGLASAIHGTARGGRVVMVGLLPSGDQPVPVSIAITRELDLVGSFRFNDEIDEVVAALADGSLVVDPIVTAEYDVADALTAFASARDASSSSKVLLRF

SEQ ID NO: 7690 - protein, 812 aa, Thermobifida fusca YX
MLEGDPSGKPWTAERAPGRGPARLEEDGLTGLNLAADSGAELALLGMDLTLVIVVLAVALLALAVAGTLVREVLAASQGTERMQNIARAVQEGAAAYLKRQFRTLAVFVIIIPLLLLLLPADTEAVRWGRSIFFAIGALFSAMTGFLGMWLAVRGNLRVAAAARAGEARAAMRIAFRTGGVAGMFTVGLGLLGAALVVLIYRADAPIVLEGFGFGAALLAMFMRVGGGIFTKAADVGADLVGKVEHHIPEDDPRNAATIADNVGDNVGDCAGMAADLFESYAVVLVASLVLGRVAFGTEGLVFPLLVPMIGVITAIIGIFVVSPRARDANAMAAINRGFFISAVISAVLVVGAALLYLPDTFAELEGVPADIAALDGNPQLIAIGAVLIGLLLAAAIQLLTGYFTETNRPPVREIGESSRSGPATVVLAGVSVGLESAVYSALLIAGAVYAAFLLGGGNITVSLFAVALAGTGLLTTVGVIVAMDTFGPVADNAQGIAEMSGDVEGSGAEVLNSLDAVGNTTKAITKGIAIATAVLAATALFGAFRTAVEAELGATEFSLSVDQPDVLVGVIIGAAVVFLFSGLAIMAVGRAAGRVVHEVREQFRTRPGIMDGTEKPEYGRVVDICTRDSLRELITPGLLAVLTPIALGFALGYAPLGAFLGGGIAAGALMAVFLANSGGAWDNAKKLVEDGHYGGKGSEAHEATVIGDTIGDPFKDTAGPAINPLLKVMNLVALLIAPSVVIYADNLALRLGITVASVALLVGVIVWSKRRSTDGSFAAEATKTQPEAPAADQGAAKEEPVSQGGGASSQE

SEQ ID NO: 7691 - protein, 312 aa, Rhodococcus sp. RHA1
MTVLTFGETMALTRAVDTGPLAHTSTLHVGIGGAESNFAIALRRLGVDVTWIGRVGQDSLGDLIERELRAEGITADVIRDPDAPTGLMVKERRTATATRVWYYRTGSAGSRLTMSDIADDRLESASLLHVTGITPALSDTARKTTLHCAERARALGIPVSFDLNYRRALWSPDDAAPVFRELIALSDIVFAGEDEAAIAVGDGTPAELVARVRDLGPRESILKLGAQGCLAMIDGETYSLPAVPVSVVDSVGAGDGFVAGYLAERLAGVAPADRLRTAVTVGAFACTVSGDWEGMPRRDELGLLTTAEPVTR

SEQ ID NO: 7692 - protein, 450 aa, Streptomyces carzinostaticus subsp. neocarzinostaticus
MNGRRPVSPPLRALPGLLRKLAVDRLGMMRDAAALDDAVLVSMGPKKLFVFNRPDYAKHVLADNAANYRKGIGLIESRKMLGDGLLTSEGELWREQRRTVQPAFRPARVAAQADAVAEETMNLRDLLMRRGADGPVDVLQEVTGFTLGVLGRTVLNTDLGGYGGIAHAFEAVQDQAMFDMVTQNMVPTWAPLATQRRFRRARRELIRTVDELVADRSARMTDGEEADDAFSLMIAAARRQTDPRTGQGRLRDELVTLLLAGHETTASTLAWTLLLLARHPHMRDLVREEARGVLADGRAPDAGDLRKLTYTTQVVQEAMRLYPPVWILPRVARQSDEVGPYSVSAGADVLICPYTLHRHPDLWERPEQFDPGRFDPARVADRPRYAYIPFGAGPRFCVGSNLGMMEAVFVTALLTRDLVLEVVPGDERTPEPMMSLRMRGGLPMTVRPVR

SEQ ID NO: 7693 - protein, 58 aa, Metrosideros collina
LVMTDPDVPGPSDPYLREHLHWMVTDIPGTTDATFGKKVVEYEMPRPNIGIHRFESLV

SEQ ID NO: 7694 - protein, 489 aa, Synechococcus elongatus PCC 7942
MNSSAPLPETAFLRPDGSNREAIAAVAQLALEQLLNLGSQADQRSPVPTWQGSERHVGIPAQSVPLPDLLQQLEPLLAQAMNPANPGYLGHMDPVASTASVIGDAIAALLNNNLLSVEMSPSFSRLETAVLRELAQRFGLGDEAGGLLLSGGSLANLQAIALARNWALQVQETGLAGLTQRPILFASEAAHTSIQKAAMLLGLGSQAVIPIATDRRGRMQVAALTEAIASARRQGQRPFCLVATAGTTVTGSIDPLPELSAIARTEGLWFHVDASYGGAVIFSPRYAHKLQGIEQANSVTFNPQKWLCVAKTSASLLLRDWSLLTEHFRIAAPYMGEADDLINLGEVSVQGTRPADILKLWLTLQHFGDRGCAALVEHGLRLCRCFVAELRQRPQIQVATPPDLNILCFRLASDRLTAELQQFLLDRYFFLSLPRFRDRLWLKAVLVNPFTTPEHIRQLFGAIDAFCRDRQIQPDPQSQDNEITYSQSL

SEQ ID NO: 7695 - protein, 274 aa, Thlaspi goesingense
SYAPAIFRHSSSSSAQLLRPAALGSIRQRTSIASSVTPSLRFLRMASQSQHHESVSCASVPGDNGFPAIISPPIESARIGEVKRETKETNVSVKINLDGNGVADSSTGIPFLDHMLDQLASHGLFDVHVRATGDTHIDDHHTNEDVALAIGTALLKALGERKGINRFGDFTAPLDEALIHVSLDLSGRPYLGYSLEIPTQRVGTYDTQLVEHFFQSLVNTSGMTLHIRQLAGKNSHHIIEATFKAFARALRQATESDPRRGGTIPSSKGVLSRS

SEQ ID NO: 7696 - protein, 495 aa, Sphingomonas sp. KA1
MVDMSKSLDLNFNQLGLRGLFYGGGWHKPVAVGYAPTLSPGSGRSICDVAQATAPDVDAAVAAARSAFPAWQAVLPLERARILRSIADVIRRHSRELVEIDAENCGNPVSELMGDAATAIAMLEFFAGLVTEMKGQSIPSGPNAVNFSLRQPMGVVARILAFNHPFMFCAAKIAAPLAAGNTVIVKPPEQAPLSALRLAELLEDVLPPGVFNVLPGGSEAGSALAEHPHVAKVSVIGSVAAGRNVMRAASETIKPVLLELGGKNALIAFPDADPEAVADAMVQGMNFGWCGQSCGSTSRAYVQEAIYETVLGLLPDRIGRYKPGVPTDPGTTMGALISENHLDRVLDYIASAKAEGARLLTGGGRPSDPVLSGGYYLEPTVFCDVTSSMRIAREEIFGPVLSVLKWTDEQEMLAQVNALDFGLTCSIWSRDIDAACRTALAVEAGFVWINEVSKHYLGAPYGGVKQSGIGREECLDELISFTQEKNIHIRISPAS

SEQ ID NO: 7697 - protein, 985 aa, Ustilago maydis 521
MSRPKTANTRPATSTGQLDQSFRPTTSGGPRADSAYDNEEDTSSGYSSADESCKGVQPHQGEDDDDDVFAFAPPGLATHIVQVVPTPSELSAQLPAASAEDSRLAPPGRNEPARESVYYFDQTSGAVYSARGSLVQVQAPNPPAAAVLSPEASRKQDLNENQKPQQTLQRSTSIKWHPSTRCENEAWSGRSDFSAKDSQRAVSPSLSYHDATSLNGHSTFTPSSDSVDLLRALPRPSFSRAVELELEEEDDSPYAEVRASVSNVDDPSMPSITFRSVVLGVILSAFTSAVNTFLSQRNPPIQIVAIIIQILSHPLGSVMANILPIRSFTFRLPNWSSNRNTARSTKSYTWSFNPGPWNIKEHTVVLIAATTGLNPSYSLSILLTQDLARFWNDRRSFLYGFLSVCAPQLVGLALSGFVRAVLVEPASMIWPQNLAVSTVLNTLHAEEDSAATHGSKQMSRFRFFSLASLISFVVFFVPGYLFTALSIFNWVCWIWPNSVPINTVFGIASGLGASFLTFDWTQINFLGSPLVMPWWAQANLFGGFVVGIWIAVPIIYFTNSLHTAYLPIISASSFDRFAQPYNVSIVSPDHMTLRKDAYANYSQVYISAGLVVAYFGGFALITAAAVHTALYHGRFIWNRLRTKRTLPDDVHARLMRRYAAVPSWWYAVALVSGIGMLVFLTTAYSTQLPIWALCLAILIPAVYLLPFGFIFAMSGLPAGVNLVSELLASWLLPGKPLPVMMLKTISQQTTTFSLLFAQDQKLAHYMKIAPRKIFFVQVLSILVNSVMQILAKDYLRDHIQGLCDPNQPQRFTCPTVNIFYTASILWGAIGVERSFGPRSPYYSLFYGLIVGAIVPLITWYTSRKIKWAPLTALSAPVIFVGMSLSPPASGINFTSAIVVGYFFQYWMRKHRVHWWSRYNFVLAGALDFGTVLSSVVIYFLLQMPKNGALELQWWGNQVYMETADAQQMPLLVAPENGFAPPPGAS

SEQ ID NO: 7698 - protein, 446 aa, Oryza sativa
MRALLPRLPRRQRRPGPELRVPARGLLEARVPWVRDRALDHVVERERHLVPFLLAKDALLSAAPPPHAVPLHSLPSTIPFPFRPLRFLRLYTSAFALSPHPVAVSPTPRLAGIHSAEAQVLDSTRADAADHLLRLLMLAPARALPLHLVARLRLDLGLAPDFPRSLLPNYPDYFALSRDGALLELVCYRKDLAVSAMQSYAQRTGGYKVGDAVPFPLSFPRGFELDKKVRKWLDDWQRLPYISPYEDGSHLTPRSDITEKRTAAVLHEVLSLTVGKKMEKEVLVKLGEALRLPPGFRKVLARHPGIFYLSHKLRTQTVVLRESFRRHMLVDKHPMMGIRYQYLHLMHMGQEEAGKRKGKGRKTVRGEQMIGEEFGAEGENDDEEDEEYDDDEEEDMEAGVASGDEDSDDDDDDEEGEKEDMEAGVASRDEDSDDEDADDTDHAAKG

SEQ ID NO: 7699 - protein, 548 aa, Yersinia pestis CO92
MKNINPSQTAAWKALQQHFEQMKDVTISSLFAKDDQRFNRFSATFDDQMLVDFSKNRITSETLEKLQDLAKETDLAGAIKSMFSGEKINRTEDRAVLHIALRNRSNTPIVVDGKDVMPEVNAVLAKMKQFCDRVISGDWKGYTGKAITDVVNIGIGGSDLGPYMVTEALRPYKNHLNMHFVSNVDGTHIAEALKPLNPETTLFLVASKTFTTQETMTNAHSARDWFLSAAGDPAHVAKHFAALSTNAKAVGEFGIDTNNMFEFWDWVGGRYSLWSAIGLSIALSVGFEHFEQLLSGAHAMDKHFAETPAEKNLPVLLALIGIWYNNFFGAETEAILPYDQYMHRFPAYFQQGNMESNGKYVDRNGHPVDYQTGPIIWGEPGTNGQHAFYQLIHQGTKLIPCDFIAPAISHNPLSDHHAKLLSNFFAQTEALAFGKSLEDVEAEFAAAGKTPEQVAHVAPFKVFEGNRPTNSILLREITPFSLGALIALYEHKIFTQGVILNIYTFDQWGVELGKQLANRILPELADDQEVTSHDSSTNALINRFKNWR

SEQ ID NO: 7700 - protein, 459 aa, Rickettsia typhi str. Wilmington
MQEFDLVVIGSGPAGYTGSIRAAQLGLKVACIEKNDTLGGTCLNIGCIPSKALLNTSKKYEETLRYFENIGIIADTKLDLQKMLSNKDKIVLDLTKGIESLFVKNKVTKIKGEAKIISNNIVEVNKEHIKASNILIATGSSVIGIPTVIIDEEFIVSSTGALKLSKVPEHLIVVGGGYIGLELGSVWRRLGSKVTVIEYASSIVPMLDKEIAKQFMTIQQKQGIKFKLNTKVVASEVRSGKVNLTIEEADKRSIITSDVVLIAVGRKAYTKNLGFESIGITTDNQGRIEINEYFQTAVSNIYAVGDVVKGAMLAHKAEEEAIAAVEIIAGQAGHVNYNLIPSVIYTYPEVASVGATEQQLQEQGIHYKVGKFPFLANSRARAIGSTEGMVKILADSKTDRVLGAHIIGSDAGTLIAELIAYMEFGASTEDIARTCHAHPTLSEAIKEAALSVDKRTINI

SEQ ID NO: 7701 - protein, 393 aa, Gloeobacter violaceus PCC 7421
MSMLETRAERMVINLGPHHPSMHGVLRLIVTLDGENVVDCVPVLGYLHRSMEKIAESRTIIQYLPYVTRWDYLATMFTEAITVNAPEQLAGVQVPRRARYIRVIMLELSRIASHLLWLGPFMADIGATSPFFYIFREREMIYDLFEAATGMRMMHNYFRVGGVAVDLPYGWVDKARDFCNYLPPKIDEYERLITNNPIFRGRVEGLGYIGREDAINWGLSGPMLRASGVNWDLRKVDHYEIYDELDWNVAWDTGGDTLARYVVRIQEMRESVKMIRQALDQLPGGPYENLEAQRLSGGPKSEWNGFDYQFIGKKSSPTFKMPRGEHYVRVEAPKGELGVYLIGDDSTFPWRWKIRPPGFINLAVLPKLVQGTKLADLMAILGSVDIIMGEVDR

SEQ ID NO: 7702 - protein, 153 aa, Triticum aestivum
  misc_feature (152)..(152): Xaa can be any naturally occurring amino acid
MDPCPFSRLTVRNLALKIPVASKPARSVVHPSSSPCFCKIQLKNFPLQSAVVPFIPPDSLFPDSLVHPIAATFHLSKSDLDKLAGKSIFSAKLCLKISIYTGRRGSTCGVSSGRLLGRVSVPLDLTGTVAKTTVFHNGWIRIGKDAKGSSAXF

SEQ ID NO: 7703 - protein, 496 aa, Synechococcus sp. WH 8102
MTSSGKVRIYELSKDLGLENKDVLDAAEKLSIAAKSHSSSISDAEAGQIRSLLKSKGNGSKASAPAPAKPAPGKAILSVKKAAPAKPAPAQAKPATPAKPAASASKPAAPAKPAAPAAPARPAPARAAAPAAPAKPVPRPAAAPPPRPQPAKPEVVSKPKPATPATASAPSKPTAPPARPTVVKPTVAKPTVAKPTVAKPTVAKPAPAKPAAAKPAPARPAPARPAPARPSADQPKPRPAAAPSRPTPGAGQKPQIVSRPGSAPRPGAPTRPGAPAPARPGAPVKAGPPTRPTPRPELVGKPVPRRPGTGAPTRSGAGAPQRPGTGVPQRPGSPGRPTRPGAPARSGGNTLELVGKPIRRDGSSTGSGGRPAPPTRPGAGSPQRPGMPSGMRKPVAPGELMQLQKPVGRPAAPAPRRPDAPTKAGDGAGTATPPVARPTPPTAPRRPGGFRPGAPGGQRRLDVRTGMTAPSWKPCAAVRHRSSARRSTSSARTTMR

SEQ ID NO: 7704 - protein, 355 aa, Burkholderia thailandensis E264
MKIAVLPGDGIGPEIVNEAVKVLNALDEKFELEHAPVGGAGYEASGHPLPDATLALAKEADAILFGAVGDWKYDSLERALRPEQAILGLRKHLELFANFRPAICYPQLVDASPLKPELVAGLDILIVRELNGDIYFGQPRGVRAAPDGPFAGEREGFDTMRYSEPEVRRIAHVAFQAAQKRAKKLLSVDKSNVLETSQFWRDVMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMLLRYSLNRAEQADRIERAVKTVLEQGYRTGDIATPGCRQVGTAAMGDAVVAAL

SEQ ID NO: 7705 - protein, 179 aa, Pseudomonas putida GB-1
MNSPLSAIVVMGVAGCGKSCIGAAIAARSGGRLIEGDAFHPAENIRKMSAGIPLDDSDRAGWLVRLGEELQTTTQAGERPILTCSALKRRYRDTLRDAMPGLVFVFLELTPAEAEKRVLARPGHFMPASLIDSQFAALESPRGEPLTLALDATQPIEALAEAVDRWLKRCGEPGLAQTA

SEQ ID NO: 7706 - protein, 125 aa, Ralstonia solanacearum GMI1000
MTIEYFAESNPATRTLPRSLATKAGDLVFVSGQVARGEDGGIISGGIEAHTRQTLENVAYVLALAGCTLADVVKTTVWLEDARDFEAFNRVYGEFFRDNKPSRSTLQAKNMVGTKIEIEAIAYKP

SEQ ID NO: 7707 - protein, 354 aa, Ralstonia solanacearum GMI1000
MQFSNTSTTRPTPIEQRKEALRVPKLGKVFTDHMVTIQWTSEDGWHDARIRPREPFSLDPASAVLHYAQEIFEGMKAYAQPDGGVVLFRPVDNARRFNASATRMTMPTIPETVFVEAIEQLLRVDGAWVPSGEGTSLYLRPFMFASESFLGVRPATQFTFCVIASPAGAYFKGGAEPITVWISEHYSRAAKGGTGAAKCGGNYAGGLIAQAEATRNGCDQVAFLDAAESRWIEELGGMNVFFVVDGVLVTPPLGTILPGITRESIISIAEKKGIKVEERPYSFDQWREDAATGRLTEAFACGTAAVIASIGKVRFKDGEFSISGGQLTDALRDELVGIQRGVIADDFNWTWRVK

SEQ ID NO: 7708 - protein, 368 aa, Arabidopsis thaliana
MSSLPDDLLLSIFARISRLYYPTLSLVSKSFRSLLASPDLYKARSLLGHTESCLYVCFHFDSGPNTHWFTLCRKPDGTLTNDTSKKKKSNGYVLATVPIPHSPPANFSSLVAVGSDIYNIGGSIYLGPSSSSVSILDSQSHMWREAPSLRVELMSHSASVLDRKIYVAGSYKDGNGDSNSCKNLFEVFDTKTQVWHPEPIPCSKTKGIFYSKSACIDGKFHVETTHGVVYAYKEGRWDKAIPTMFGMRASYSFCEINNVLFYIHRGVFRWYDTKLRMWRILKGLLGLPSLPENMFVRLADYGGKMAVLWEEDRPSCGAGGRDEMMIWCAVIALKRHLNFSFWGKVEWFDHVLTVPKQHVFVKALTASL

SEQ ID NO: 7709 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFFNDLERCERITKALEVGAVWVNCSQPCFVQAPWGGIKRSGFGRELGEWGIQNYLNIKQVTQDISDEPWGWYKSP

SEQ ID NO: 7710 - protein, 337 aa, Synechocystis sp. PCC 6803
MTRVAINGFGRIGRNFLRCWLGRTDSQLEVVGINDTSDPRTNAHLLRYDSMLGKLDGDISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 7711 - protein, 207 aa, Oryza sativa (japonica cultivar-group)
MAIATTTLPLAPLALAPPSSPISQCSLLLLRPRAPAALSLRPSARLLVAVAAREPELGGSGGGGAGDGSGSGGGGDSEKPRGGGGDEEGEGEEEKMGQGLSMSQKITLAYAALVGAGGAMGYMKSGSQKSLAAGGISALVLYFVHTQLPVRPVFASSIGLGISAALLSVMGSRFKKSGKIFPAGVVSLVSLVMVGGYIHGILRSTHA

SEQ ID NO: 7712 - protein, 394 aa, Gloeobacter violaceus PCC 7421
MVTIETRADQMVLNLGPHHPSTHGVLRLIVTLDGENVVDCRPVLGYLHRGMEKIGENRTIIQYLPYCSRWDYAAAMMNEAPVVNAPEAMAGVKVPRRASYIRVIMLELSRIANHLLWVGPFLLDMGAQSPFFYILRERELILDLFEAATGLRMVGNNYFRVGGVTVDLPYGWVDKAHDLCDVIPGKIDEYERLITNNPIFRRRIENLGYISREDAINWGLSGPMLRASGVKWDLRKVDHYEIYDELDWDIAWDTGGDCLARYIVRIKEMRESVKIIRQALDQLPGGPYEQLEARRLAEGPKSEWNSFDYQFIGKKSSPTFKIPTGEYYARSEEAKGELGIYVVGRDDTTPWRWKIRTPDFANLAILPMILQGTKVADLVVVLGSIDIIMGSVDR

SEQ ID NO: 7713 - protein, 364 aa, Aspergillus oryzae
MSSYNIVVFGGDHCGPEVTAEAIKVLRAVEKNRDVTFNLQDHLLGGASIDATGSPLTDEALNAAKNADAVLLGAIGGPKWGTGAVRPEQGILKLRKEMGTFGNLRPCNFAAPSLVESSPLRADVCRGVNFNIIRELTGGIYFGERKEDDGSGYAMDTEPYSRAEIERIIRLAAHLALQHDPPLPVWSLDKANVLATSRLWRKVVTEVMAKEFPQLKIEHQLIDSAAMIMVKNPRQLNGIVVTSNLFGDIISDEASVIPGSLGLLPSASLSGIPDGNSKVNGIYEPIHGSAPDIAGKGIVNPVAAILSVAMMMQYSFGLFAEARAIEQAVSNVIESGVRTGDIGGKATTAEVGDAVAAELEKLLK

SEQ ID NO: 7714 - protein, 239 aa, Synechococcus sp. WH 8102
MADLQTQMKQAVADAAVEQIKDGMVLGLGSGSTAALMIKALGAKLASGELKDIVGVTTSFQGEVLAAELNIPLLSLNAVDRIDLAIDGADEVDPGFQLIKGGGACHVQEKLVAARADRFVVVVDSTKLVERLNLGFLLPVEVLPGAWRQVQQQLAALGGKAELRMAQRKAGPVVTDQGNLVLDVTMNGGISDPAALESTVNNIPGVLENGLFVDLVDEVLVGEITDGSAGVRSLEKRLS

SEQ ID NO: 7715 - protein, 132 aa, Oryza sativa
SQFFMSQAALPHLKQGSSIINTSSVNSFKGNSSLLDYSSTKGANTAFTYSLAGNLAEKGIRVNQVAPGPIWTPLIPSTMGATFEEFNKANVFLKRCGQPEEVAPAYVFLASQDASYITGQTIHVNGGTVVNA

SEQ ID NO: 7716 - protein, 507 aa, Symbiobacterium thermophilum IAM 14863
MLSAFSPPLPCDPARSHPTPEFPSSLQDYCEIRGIQSQPPARRDPTMDWLASLRSQIKPYRDRFPSHARLPRAGLPRAEILAEIAAMGAAESPAWRDGYASGAVYHGDEHHIAFLNEVYALQSQSNPLHPDLWPSTAKFEAEVVAMTAHMLGGDAAGGTVCGTVTSGGTESLLLAMKTYRDWARATKGITAPEAVVPVSAHAAFDKAAQYFGIKLVRTPLDADYRADVAAMREAITPNTVVVAGSAPGYPHGVVDPIPEIAALAAEHGIGCHVDACLGGFILPWAERLGYPVPPFDFRLEGVTSVSADTHKYGYGAKGTSVILYRRPDLLHYQYFIAADWPGGLYFSPTFAGSRPGALSATAWAAMLSLGEEGYLDATRRILQAADRLKAGVRAIPSLKILGDPLWVIAVASDELNIYQVMEEMAGRGWRLNGLHRPPAFHVALTLRHTEPGVVDRFLADLQDAVAQVRAHPEKATGMAPVYGMAAAAPPELVRQVLTGFIDLLYEV

SEQ ID NO: 7717 - protein, 318 aa, Thermobifida fusca YX
MPLDPETRALIDELVSGSPPGEAVGVPDASLHSSLRERRIVGPGVALVRDLTIPSPAGGIPARLYHPAPDNPATGCAVFFHGGGYVFGNLDTHDHIARLLAAESRAAVVAVDYRLAPQHRFPAAVEDAFTATRWVAEHATRLGVDAARLAVVGDSAGGGLAAAVALLVRDGGPPLAAQVLIYPVIDLTGYPVTADTPYPSRIAHGEGCFLTTAAMQHVVEQYLADPADAADFRASPIRAADLSGAAPALVVSAEFDPLRDEAEAYARALAAVGVPATTVRINGGVHGMFGLGPVLPLSRHAELPVIALLRDTLQPPQR

SEQ ID NO: 7718 - protein, 510 aa, Ralstonia solanacearum GMI1000
MNRGNALLVLAVFVVASCGLAYELIAGALASYLLGDSILQFSSIIGAYLFAMGIGSWVSRYVADDALLARFVDLELLVGLFGGVSAAALFLLFALESAPFRLVLYALVTVIGVLVGMEIPLVMRMLHRRQAKFSDLVSRVLTFDYLGALAVSLLFPLVLAPRLGLVRTGFLFGLCNTAIAVWTLWHFRAELGLSARLRGAMAWRAGMVGAALLAGFAASDRLTHWSERALFGDEIIHAISSPYQRLVVTRWKDDLRLYINGNLQFSSRDEYRYHEALVLPALESVRGARRVLVLGGGDGLALRQILKYPQVEHVTLVDLDPRMTSLFSHAEALVALNQHAFSDPRVTVVNADAGQWLQTAADMFDVAIVDFPDPSNFSIGKLYSVPFYRLLSRHVADTGLVVIQATSPYFAPRSYWCVDATLKEAGYRTWPYHALVPSFGEWGFILAAPGRADFRPPTTYRVPTRFLDADTTHQMFSFAPDMPRPQVEPNRLNNQSLVRYFEEDWHGVLR

SEQ ID NO: 7719 - protein, 514 aa, Oryza sativa (japonica cultivar-group)
MDLLRDRRLGALLVVVLVLVSGAAVEASIHTYDREPFREVGNAFLLSGGSEGVVADGADLAAQASSFIKFTNVTFWRTPESAESHAKMAHSTGLVQAILFEAADRDNIGGSAYGGQRSICCTPDLAKLEGCKQGEVIRRPSSDDPDWPYVLDTHFSGSHLSVKLEDEVVRITKTGMYNLFFISCDPKLRGLSMSGKTVWRNPGGYLPGRMAPLMKFYVFMSLAYLLVMVVWSSQYIRFWRDIMPIQNWITLIIALGLFEMTLWYFEYLNFNSSGVRPIGITTWVVTVGAIRKTISRLLILSISMGYGVVRPTLGGLTSKVLLLGLTYFLASELLDIAENVGTINDISGKARLFLVLPDAFLDAFLILWIFTSLSRTLEKLQARRSSVKLDIYRKFTNALAVSVIASVAWIGYEVYFKATDPFSERWQSAWIITAFWDVLAFVLLLVICYLWAPSQSSQRYAYSGEAADDDDEESQSLTKGTDGDVGMVKVDKDRSGGVSSAFSLEDEAEEDKRE

SEQ ID NO: 7720 - protein, 662 aa, Candida albicans SC5314
MSARKLQQEFDKLNKKISEGLQAFDEIKDKINATESASQREKLENDLKKELKKLQRSRDQLKQWLGDSSIKLDKNVLQENRTKIEHAMDQFKELEKSSKIKQFSNEGLELQSQQKRSRFGDDAKYQEACTYINEVIEQLNGQNEELEQELDSLSGQSKRKGGSSIQSSIDDVKYKIERNNSHISKLEEVLENLDNDKLDPARIDDIKDDLDYYVENNQDEDYVEYDEFYDQLEVDEEDDVEVQGSLAQMAAETEDERRRDEERKREEKEKEKQQQNPPRTSSSVSSSSSSNQNNIGNNTPPATQIKPSVVTVAAIGDQNNNSASSASSTSTPVKKLKPTLAPAPAPPPITSGTSYSNAIKAAQTASTSSTSNSSIAHTANDNNNTNKGNRSVSPLASTDNHTHAPAAVSTPVKVLPPGLNHDTSMNSTLRSESSSPLVGHAKVNNNHELQISRSQSPMVSNENKVFSDTISRIVNVAHSRLNDPLPLQSITGLLETSLLNCPDSYDAEKPRQYNPVNVHPSSIDYPQEPMYELNSSHYMKKFDNDTLFFCFYYGDGIDSISKYNAAKELSRRGWVFNTEFSQWFSKDSKNGGKNRSMSVIQREEENGNIIGDNSNGNEELREKIDDNGGIPSNYKYFDYEKTWLTRRRENYQFATENRQIFQ

SEQ ID NO: 7721 - protein, 686 aa, Pyrococcus abyssi GE5
MAEKLIPVVCPWCSVGCRLYIVSVDGYPRKIEFDYNPKTPNKGKLCPKGVSSYQHYVHPDRLKKPLKRVGEKGEGKFEEISWEEAIEIIAKKFKEILESHGPEALAFLGSERCSLEDNYLLQKLARALGTNNVEFAGRLCQSSNFVARSKIFGGPAQTNPFDDIVKSKVILIWGYNPAATNPVLFGQYFEKAILDNGAKLIVVDPVKTETAKYAHIHLQPYPGTDLAIALAMLHVIIKEELYDKDFVAERVNNFDALARAVEKYTPEWAEKISGVPASLIHEAAVLFATGGNATVVLNEGINQHANGSITAMAISNLIAITGNIGKEGVFSGVIPGAHCGLCAAVPGVNCAQLPGPVPLNEETAKKFSELWGFEVPSKPGLHYQAIFDAMLEGKIKGIYIMGQNPARSLANSSKIEEALKRAFVVVADIFPTETTKYADIVLPAAAWYEKTGTVITQNRRVMRSFQAVKPPGEAKPDWEIIVMLAKSIGLGEYFNYSSVDDVLREINNVIPALKGATPERLAKNLEGCMYPCPDENTETPRLFLKGFPTKSGKAELIPVEWKPPGEVPDEEYPFWLTNFRLVGQFHTGTMSNRTKSLKKRWPGPYVMINERDAKRLGIRSGDLVRVETRRGSLVARAEVTENIREGVVAMPWHWGFNYLTKDDAIDEFSKMPELKTAACRISKVEG

SEQ ID NO: 7722 - protein, 251 aa, Bacillus megaterium
MRKPIIAGNWKMNKVLSEATSFVEEVKGAVPSPESVDSVVCAPALFLDRLVEATKGTDLKIGAQNMHFEENGAFTGEVSPVALADLGVNYVILGHSERREMFAETDETVNQKTIAAFKHGLTPIVCCGETNEEYEQDQTKTVVANQVQKALAGLTDEQVKQTVIAYEPIWAIGTGKSSTAEGANEVCAYIRSVVAEQFSQDVADAVRIQYGGSVKPANIKEYMSQSDIDGALVGGASLEADSFLQLLEAGK

SEQ ID NO: 7723 - protein, 681 aa, Yersinia pestis CO92
MSNNTTSLPAENSSHPRKGTPIRKKQREEAQQFINTLQGVTFPNSQRIYLQGSRPDIQVPMREIQLSPTQIGGSKNEPRYEDNEAIPVYDTSGPYGDPQAKLDVHNGLPKLRAAWVADRQDTEALASVSSGFTQQRLADEGLDHLRFEHLPRPRKAATGQCVTQLHYARQGKITPEMEFIALRENMGRERIRGEVLLQQHPGQAFGAHLPENITAEFVRQEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGVAENLTWEMFRDTLLEQAEQGVDYFTLHAGVLLRYVPMTAKRLTGIVSRGGSIMAKWCLSHHQENFLYQHFREICQICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPATARAYHDETLPQESGKVAHFCSMCGPKFCSMKISQEVRDYAAAQEQAAAQAQAATPTTAAQPIDITQPINMLQSGMEKMSAEFRSRGSELYHRPANLSAEANNEPT

SEQ ID NO: 7724 - protein, 327 aa, Rickettsia typhi str. Wilmington
MNIIVKIQQDLKEEVTQLNDLIISCLKSDTELIEKVGKYLLEAGGKRIRPLLTIITAKMFDYKGDNHIKLASAVEFIHAATLLHDDVVDDSTLRRFKPTVNVIWGSKTSILVGDFLFSQSFKLMIASGCIKAMNVLARASVIISEGEVVQLVKLNERRIITIDEYQQIVKSKTAELFGAACEVGAIIAEQVDRVSEDVQDFGMLLGTIFQVIDDLLDYLGSDKQVGKNIGDDFLEGKVTLPLIFLYHKLEQDKKLWLENMIKSDKRTKDDFIKIRDLMLKHAIYNETVNYLSSLENEANNLLNKIPVQNIYKYYLFSIIRFILYRSY

SEQ ID NO: 7725 - protein, 407 aa, Gloeobacter violaceus PCC 7421
MTDRRYDVVLYGATGFVGQQTAQYFTRHTRPGAVHWAIAGRNRQKLESLKAQLGTNVDVLIADSTDQPALDAVAAQTRVILNTAGPFALYGDAIVDACVRLRTHYVDITGETPWVRDLIDRYHERAASEGTRIIPCCGFDSVPSDLGSYLMVRHLQREWGVSCRAVKAYFQMYGGLNGGTLASGLNLYDSGRAARVSDLFLLDPPGEHSSTELERNRDPEAPEYDAGVDTWVGPFFMGLVNTRVVRRSRALYDQWQEPYGPQFVYQEYLKFDPPLAWLQATVVTVGTALFAGIMQQAPLRPLLQSLLPEPGSGPSEQTMNEGWFRCELLGVAEDGRRVKGLICDQGDPGNRATVKFLCESALSLVLNTDELPGGQQRGGVLTPATGLGEVLAERLRSAGMTLKVGVV

SEQ ID NO: 7726 - protein, 344 aa, Synechococcus sp. WH 8102
MLLGRSAAELESWAVAQGQKPFRGRQLHDWLYAKGARSLSEITVLPKAWRESLKEDGVEVGRLKEVHRSVAADATTKLLLSTDDGETIETVGIPTDQRLTVCVSSQVGCPMACRFCATGKGGLQRSLRTHEIVDQVLSVREVMDRRPSHIVFMGMGEPLLNSQAVLDAIRCLNDDLGIGQRRITVSTVGVPKTLPQLAELALATLGRAQFTLAVSLHAPNQALREELIPTAHAYPYEALLEDCRHYLAVTGRRVSFEYILLGGLNDAPEHAAELADRVGGFQSHVNLIAYNPIEEEEFQRPTRARIEGFQRVLERRGVAVSLRASRGLDQNAACGQLRRRRQGS

SEQ ID NO: 7727 - protein, 397 aa, Mycobacterium tuberculosis H37Rv
MTVSRLRPYATTVFAEMSALATRIGAVNLGQGFPDEDGPPKMLQAAQDAIAGGVNQYPPGPGSAPLRRAIAAQRRRHFGVDYDPETEVLVTVGATEAIAAAVLGLVEPGSEVLLIEPFYDSYSPVVAMAGAHRVTVPLVPDGRGFALDADALRRAVTPRTRALIINSPHNPTGAVLSATELAAIAEIAVAANLVVITDEVYEHLVFDHARHLPLAGFDGMAERTITISSAAKMFNCTGWKIGWACGPAELIAGVRAAKQYLSYVGGAPFQPAVALALDTEDAWVAALRNSLRARRDRLAAGLTEIGFAVHDSYGTYFLCADPRPLGYDDSTEFCAALPEKVGVAAIPMSAFCDPAAGQASQQADVWNHLVRFTFCKRDDTLDEAIRRLSVLAERPAT

SEQ ID NO: 7728 - protein, 262 aa, Brassica napus
MSLSMSSSSAASAAAAAASTPKSSSSPAAASSTTSWFSGIVRGRGDKPNTAKLSKSASAAGGGSGDYGGGPIKGKNQFRGVLFKYGPKSIQVAFKTGEYKQQVIFIGGLTDGLLATDYLEPLAIALDNEKWSLVQLLMSSSYSGFGTSSLKQDAQEIDQLVSYLINKENSEGVVLLGHSTGCQDIVYYMGTNAACSRAVRATILQAPVSDREYKATLPETPALMDLAAKMISEGRAEELMPKEADPCAPISAYRYHSLCAYM

SEQ ID NO: 7729 - protein, 570 aa, Oryza sativa (japonica cultivar-group)
MGTRRRRHQHHGRWVVPAVAPAAAAFTAAGLLLVVVAFHCFLSPPLGGGGGGGGGHRVVRRPNPPFLLNKPSELRRNVVGTVDFAVPSGGSKLGEELWASKLASNFFGCSNATKAFADAKAVTEPNRYLMIATSGGLNQQRTGIIDAVVAARILNATLVIPNLDQKSFWKDASDFADIFDVESFISSLSNDVKIIRQVPDRNGKTPYPYKMRIPRKCTAKCYENRVLPALLKKHVVQLTKFDYRVSNRLETNLQKLRCRVNYHALQFTDPILKMGEMLVQRMRAKSGRFIALHLRFEPDMLAFSGCYFGGGEIERRELGAIRKRWKTLHASNPDRERRHGKCPLTPEEVGLMLRALGFGKDVHIYVASGEVYGGEETLAPLKALFPNFHSKETLASKEELAPFLSFSSRMAALDYIVCDKSDVFVTNNNGNMARMLAGRRRYFGHKRTIRPNAKKLYSLFLNRTSMSWETFSSKVQTLQKGFMGEPNEIKPGRGEFHEHPMDCICAKTKGRSGHSKPHPSNRIGEAMEKRANDGEFDWRDLDYGENTPLGRDSSNETDSDMHELEDMVSD

SEQ ID NO: 7730 - protein, 704 aa, Oryza sativa
LFFYLNFFLFVVFWFFDVSTALCFDYATLTLGSLKLLGDAHLKNGTIRLSRDLPVPNSGAGRALYATPVALRGGFSTQFAFTVATLNADSVGGGLAFVLASDGVTLGDAGPYIGVSAASDVAAVEFDTLMDVQFGDVNGNHVGLDLGSMVSAAVADLDGVGVELTSGRTVNAWIEYSPKSGMEVFVSYSPKRPAEPVLSAPLDLGEYVKGDAFVGFSASTQGSTEMHAVEWWTFSTPTSSSSSPSKPSPPSPPQLPGVSTTTPSPPASTVSMPPTNSVAVASAPANSTAGISNAGSPHPPAHAAVAGAATAGAFVAVSFAGFALWALARRARARRRGTTSAAALARSPREFTYKELSAATRGFDASRVIGNGAFGTVYKGIIPDTGAMVAVKRCTNASADGAQARSEFLSELSIIAGLRHRNLLRLQGWCHEKGEILLVYDYMRNGSLDKALFDASSPVLPWSHRREILAGVASALAYLHHECERRVIHRDVKSSNVMLDDAYRARLGDFGLARQAEHGESPDATAAAGTMGYLAPEYLLTGRATEATDVFSFGALVLEVACGRRPIGATEGRCNNLVEWVWSLHGAGQVLDAVDARLRGEYDEAEMRRAMLVGLACSSPEPALRPGMRAVVQMLGGEADPPFVPAARPSMSFSANHQLLLSLQDSVSDYNALGLNDLSDDSSSDSLSSSSLTSTLRKGGHDIA

SEQ ID NO: 7731 - protein, 127 aa, Hordeum vulgare subsp. vulgare
MARTKQTARKSTGGKAPHKQLATTAARKSARTTGRLKKLHRYRPGTVALREIRKYQKSTELLIRKLPFQRLVREIAQDFKTDLRFQSHAVLALQEAAEAYLRGLFEDTNLCAIHAKRVTIMPKDIQL

SEQ ID NO: 7732 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 7733 - protein, 470 aa, Photobacterium profundum SS9
MIQFGTGGWRAFIGEEFTRENVRLVAQALANIMHNENVIDNGFVIGYDRRFLSDKAAAWFAEVLAGNGITVSFIDKYVPTPVVMFESKEIGATYSACITASHNPADYNGIKIFIEGGRDADEIITQKIEQQVQGLTNSDVKHIDFDEALNAQTIKIINPMNAFVDSIINFIDIEAIKKANLRVLIDPMFGVAKNALQTVLISGRCDVDVIHDDQNPSFGGLMPSPNAATLYRLKHLVAHEGYDIGIGTDGDADRLGIIDEKGNFIHPNEVLLLLYYYMLEYKGWKGSVVRNIATTHLLDKIAAAHDEKCFEVPVGFKHISSQMEADDSLIGGESSGGLTIRGHIKGKDGVFASSLLVEMISVTNKKLSEMLDEIYSKYGYAYTAEDDCIFKISDRERLYNKIYIDKELPEFNYDIEKISYADGAKVYFKNGGWALARFSGTEPLLRLFVEMEDKIKAKAVLLQLKEFLKV

SEQ ID NO: 7734 - protein, 219 aa, Ageratina adenophora
MATLIPFNTPYTSLSADNIPTTESSSTSDYSTGTSFSDEEVMLASKNPKKRAGRKKFRETRHPVYRGVRRRDSGKWVCEVREPNKKTRVWLGTYPTADMAARAHDVAALAMRGRSACLNFADSLWRLPIPESSNVKDIQKAAVKAAEAFRPTETDVAVIEESNELTGNVFCVDDESIFEMQGFLADMAEGMMLPPPRTIEYDNCQDDLEFFVDASLWSF

SEQ ID NO: 7735 - protein, 405 aa, Shigella flexneri 2a str. 301
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEEPTRLLLDV

SEQ ID NO: 7736 - protein, 677 aa, Candida albicans SC5314
MPSLDELTISTIRGLSVDAVSAANSGHPGAPLGLAPAAHVVWQKMKFNPKDPNWINRDRFVLSNGHACALLYSLLVLYKFELTVDDLKQFRQLGSKTPGHPEATDTAGVEVTTGPLGQGISNAVGIAIAQKQFAATYNKPDITLSDSYVYTFVGDGCLMEGVSSETSSLAGHLQLNNLIAFWDDNRISIDGDTAVSFTENVPDRYRAYGWNVLEVPDANTNIEAIAAAVDEAKKSTDKPTLIRLVTTIGYGSLKQGSHDVHGSPLKPDDIKQLKKSWGFKEDVDFFIPEEVSEYLAKHVSENQKVQKEWEAKLAEYKKKYPTEGAEIQRRLDGKLPEGWKEYLPKYTPADKPLATRKLSENVINALHGKIPEFIGGSADLTGSNLTRAEGSVDFQPPSTGLGNYDGVYIRYGVREHGMGAIMNGIAAFGANYKNYDGTFLNFVSYAAGALRLSALSHHPVIWVATHDSIGLGEDGPTHQPIETLAHFRAIPNLSVWRPADGNEVSAAYAAAIESTSHPSVIALTRQNLPQLEGSSIENALKGGYTLVKKDNPDVIIVSSGSEVSISVAASEELAKQGVKANVVSLPDFFTFDQQSDEYRLSVLPDGVPILSVEVMSTFGWSKYSHEQFGLNRFGASGKAADLYKYFEFTPEGIAERAQKTIKYYEGKQLLSPLDRAF

SEQ ID NO: 7737 - protein, 513 aa, Arabidopsis thaliana
MAMMRTSPRDSISNLPDEILGKILSLLPTKVAASTSVLSKRWRNLLGLVDNLCFDESMVVYPNEEEETSGSLRFCDFVDKTFALLSNSHIKKFSLSRVYKYNDDVDGMVRRWIRTVMERGLLEIHLHATPMSFVAIETKLLTSNTLVKLTLSARCFVEVERVFFPALKSLSLFSILGDYTNYIRLIDGCPVLEELYMRDGDYPFLRLTCGTNVESASLKRLVIFTHNPNEMIWHELIYFEAPSLVYLDYSSYVSAKYDVVDFDLLVEARLSLRLWVSTNDYDYSDDDDDDDDDDDDDDDDDDDDDDDDDDDDDDDDDDDDDDDDDGDYYIVEPKAPIFGDVTELLAAIRNITTLHLSPDSLEVFHFCCKSMPVFNNLLNLSIESNKDKGWQVMPLLLKSCPNLHTLVIKGLVHRVTSRCGDACACIPKKQRKIVQKEEALCCLRTCQVKVLQISEYGGYFQELKQMRHFLGKLECLETVKVGVHAENNNNSEFLRANVLTLPRVSAKCNVHFI

SEQ ID NO: 7738 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 7739 - protein, 880 aa, Rickettsia typhi str. Wilmington
MNKLIYYFGNNGSDGNASMKNILGNKGAGLAEMSNLKLPIPNGFTITTELCNYFYKHNNNLPKNFQNELQQAITKLEITTGKIFGSTTSNPLLLSVRSGSTVSMPGMMDTILNLGMNNEVCNALADSCGNKLFALDSYRRFLEMYGSTVLSIPSDLFEQIYEKHKVQADIYKDSDITVELLEKIIDDFKRLHIKYTKQLIKDPYEQLESAIKAVLYSWKNNRAIVYRKLNNISEDFGTAINIQEMVFGNLGKTSATGVVFTRSPSTGEKKLFGEFLINAQGEDIVSGTRTPMPIIANDSNSMQAMMPEVFTKLSQIAKKLEEHYLDMQDIEFTIENNKLYILQTRTAKRTAIAAINIAVQMVEEKLISKEQALMRIDPESLNQLLHTRIDYSKKLTAIAEGLPASPGAATGIVVFSPYDAEKLSHHHKVILVRHDTSPEDINGMHVASGILTIRGGMTSHAAVVARGMGKPCVCGTNNLSIDEQKQILIAGDIVIKQGDIITIDGGSGKIFLGEMPLIQPTFSEESTLILDWADEISSLKVRANAETVNDALVSIKFGAQGIGLCRSEHMFFDKNKIPLVREMIIAPDIERRQCALQKLLPLQTEDFKALFRVMKNKPVNIRLLDPPLHEFLPTTDEDKKNLAHSLNLPLSMIHQRLHAMHEVNPMLGHRGCRLGICLPEIYQMQIEAILTAIFELHKKEHIESNLELMIPLISNVAEIKKLKMDIYAVVKKLEQRYSYKFSFTLGTMIELPRAALGSKKIAKEVDYFSFGTNDLTQTTYGISRDDIASFLPYYLEEKIFESDPFTTLDEEGVGELIKIAIKRGKSSNANLKLGACGEHAGNPTSIAFFHKMNLNYVSCSPYRIPIARIAAAQAKIKQGS

SEQ ID NO: 7740 - protein, 496 aa, Escherichia coli B
MITAFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGGLNTLVDTQGEEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 7741 - protein, 368 aa, Parvularcula bermudensis HTCC2503
MKTRAAVAFEPKKPLEIVDLDLEGPKAGEVLIELKATGICHTDAYTLDGLDSEGLFPSILGHEGCGIVREVGPGVTTLKPDDHVIPLYTPECRECKSCLNPKTNLCTAIRSTQGQGLMPDGTSRFSYKGERIYHYMGCSTFSNYTVMPEIAVAKIRKDAPFETTCYVGCGVTTGVGAVTNTAKVEPGSTVVVFGLGGIGLNVIQGAKMVGASQIVGVDLNPEKAEWGRKFGMTDFVNPKDVDNLVAHLVALTDGGADYSFDCTGNTEVMRQALECCHRGWGESIVIGVAEAGKEISTRPFQLVTGRVWKGTAFGGARGRTDVPTIVDWYMSGQIQIDPMITHRFALDEINKAFDLMHQGQSIRSVVVY

SEQ ID NO: 7742 - protein, 844 aa, Oryza sativa
MRLLALAVASIVLANLHLLGVHGRDLLLSCGSNATVDADGRRWIGDMAPGLNFTLSSPGIAASQAGSSNANEIFGLVYHSARFFSTASWYNFSVLPGNYCLSLHFFPYTFGNFSGNDSLFDVTANDFKLVSKFNVSEEIVWRSTVSNSAINAVVKEYFLLVGSRGLQVEFDPSPGSFAFVNAIEVMLTPDNLFNDTVNKVGSAGNGQLPLGLSNRGLETMYRLNVGGHALNSSSDQYLHRPWYTDEAFMFSANAAQIVSNTSSVSYLSNNDSSISPIDVYETARIMSNNMVVDKRFNVSWRFYVHPNFDYLVRLHFCELFYDKPNQRVFKIYINNKTAAEDYDVYVRAGGINKAYHEDYFDNLPQQVDSLWLQLGPDSLTSASGTDPLLNGLEIFKLSRNGNLAYVLGHIDMGNQRGISKDRNRKILWEEVGIGSASFVTLTSVVLFAWCYIRRKRKADEKEPPPGWHPLVLHEAMKSTTDARAAGKSPLTRNSSSIGHRMGRRFSISEIRAATKNFDEALLIGTGGFGKVYKGEVDEGTTVAIKRANPLCGQGLKEFETEIEMLSKLRHRHLVAMIGYCEEQKEMILVYEYMAKGTLRSHLYGSDLPPLTWKQRVDACIGAARGLHYLHTGADRGIIHRDVKTTNILLDENFVAKIADFGLSKTGPTLDQTHVSTAVKGSFGYLDPEYFRRQQLTQKSDVYSFGVVLFEVACGRPVIDPTLPKDQINLAEWAMRWQRQRSLDAIVDPRLDGDFSSESLKKFGEIAEKCLADDGRSRPSMGEVLWHLEYVLQLHEAYKRNNVDCESFGSSELGFADMSFSLPHIREGEEEHHSKPSSIREDPDT

SEQ ID NO: 7743 - protein, 145 aa, Brassica napus
  misc_feature (144)..(144): Xaa can be any naturally occurring amino acid
MAELESPGVMPKLIAFLSSLLERVAESNDLTRRVTTQSQSVSVFHGLSRPTITIQSYLERIFKYANCSPSCFVVAYVYLDRFTQRQPSLPINSFNVHRLLITSVMVSAKFLDDLYYNNAYYAKVGGISTKEMNLLELDFLFGLXF

SEQ ID NO: 7744 - protein, 398 aa, Fulvimarina pelagi HTCC2506
MLKRDDNRRGWRPATELVHGGTMRSNFGEVSEAMFLTQGYVYATAEQAEARFKGEEPGFIYSRYSNPTTRMFEERMMLLEGAEDARSTASGMAAVSTALQCQLQAGDHVVSARALFGSCRYVVETVLGRMGVTSTFVDGRNLDEWQAAVRPNTKVFFMETPTNPTLELIDIAAVAEIAHQAGARLVVDNVFATPLFQHPLELGADVVVYSATKHIDGQGRCLGGVVLSSKDWIDENLHDYYRHTGPAMSPFNAWTLLKGLETLPLRVKQATASAARIADYLADHPKIARVFYPGRDDHPDAAVAKKQMTGGSTLIAFEMKGGKREAFAFANGLELVLLTNNLGDAKTLTTHPATTTHKNLSQEARDQLGISDGLMRLSVGIEDTDDILEDIEGALKRV

SEQ ID NO: 7745 - protein, 202 aa, Solanum lycopersicum
MSNEYDYLFKLLLIGDSSVGKSCLLLRFADDSYVDSYISTIGVDFKIRTVEQDGKTIKLQIWDTAGQERFRTITSSYYRGAHGIIIVYDVTEMESFNNVKQWLNEIDRYANESVCKLLVGNKCDLVENKVVDTQMGKALADELGIPFLETSAKDSINVEQAFLTMAGEIKKKMGNQPAGAKRTGSTVQIKGQPIEQKGNCCG

SEQ ID NO: 7746 - protein, 432 aa, Photobacterium profundum SS9
MSKSADLFAKAQKIIPGGVNSPVRAFAGVGGSPLFIERADGAYIFDADGKAYIDYVGSWGPMILGHNHVAVRDAVIKAAQQGLSFGAPTEMEITMAELVSKLVPSMEQIRMVSSGTEATMSAIRLARGFTNRDKIIKFEGCYHGHADCLLVKAGSGALTLGQPNSPGVPADFAKHTLTCTYNDLETVREAFAAHPEQIACIIVEPVAGNMNCIPPVPGFLEGLRTICDDFGALLILDEVMTGFRVSEGGAQGYYNIKPDLTTLGKIIGGGMPVGAFGGRKDIMQYIAPTGPVYQAGTLSGNPVAMAAGHACLSVLTEEGNEKRLANTTKILANGFKSLADKYNIPLAINQVGGMFGFFFTEQKTVTSYADVTKCDIERFKRFFNLMLKSGVYLAPSAYEACFTSLAHGDKEIEATLNAAERAFATLAKEANA

SEQ ID NO: 7747 - protein, 371 aa, Brassica rapa
MEKPNRMSESQNVVVSEAARSIIPNNSSAPPGFISISKKKLLKNLEIINDGERINAWVDSMRASSPTHPKSLPSSISSEQQLSSWIMQHPSALEMFEKITEASGGKQIVIFLDYDGTLSPIVDDPDRAFMSSKMRRTVKKLAKCFPTAIVTGRCLDKVYNFVKLAELYYAGSHGMDIKGPAKGFSRHKRVKQSLLYQPASDYLPMIDEVYRQLLEKTKSTPGVIVENNKFCASVHFRCVDEKKWSELVLQVRSVLNEYPRLKLNQGRKVFEIRPMIEWDKGKALEFLLESLGFGNSNNVFPVYIGDDRTDEDAFKLLRDRGEGCGVLVSKFPKDTDASYYLQDPSEASDEFLATIGGVETNAAKSVKRMYV

SEQ ID NO: 7748 - protein, 486 aa, Candida albicans SC5314
MTTVEQLETVDITKLNAIAAGTNKKVPRVVAAGLGGKLMGTSDLVKVTAEEITKDSMESLAEKDAREKAKYANKKHISEEPWTLDNFAKKINWLNMILVVFIPVFGAYCAWNYPPQWKTLVLTFVMYAFSGISITAGYHRLYSHKSYDAALPVRLFFAFFGAGAIEGSIKWWGHSHRIHHRYTDTPRDPYDARRGFWFSHMGWMLTKANPKNRARADISDLVADWVVTFQHRHYLLLMITAAFIFPTLVAGLGWGDYWGGFIYAGILKGFAIQQATFCVNSLAHWIGVQPFDDRRTPRDHVLTAFVTFGEGYHNFHHEFPSDYRNALKWYQYDPTKVTIWCLSKLGLAWNLKKFSQNAIEQGLVQQQQKKLDRMKNKLNWGAEIEKLPVWTREEFNERAKQEGLIIISGIIHNVKNFIKEHPGGQALVRASLGKDATKAFNGAVYAHSNAAHNLLATMRVAVVKDGEVNADTFDLQEQMMEKEKQS

SEQ ID NO: 7749 - protein, 561 aa, Oryza sativa (japonica cultivar-group)
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 7750 - protein, 608 aa, Brassica rapa
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYLGTRHHELHFTVQEGIDAIEEVIYHVETYDVTTIRASTPMFLMSRKIKSLGVKMVLSGEGSDEIFGGYLYFHKAPNKKELHEETCRKATPLEFLDHDVSCAYLLCLNLVCLLLMQIKALYQYDCLRANKSTSAWGVEARVPFLDKAFLDVAMGIDPEWKMIRPDLGRIEKWVLRNAFDDEKNPYLPKHILYRQKEQFSDGVGYSWIDGLKDHANKHVSDAMLTNANFVFPENTPLTKEAYYYRAIFEKFFPKSAARATVPGGPSVACSTAKAVEWDAAWKGNLDPSGRAALGVHVAAYEGDKAEAPRPEKVQKLAEKTAEAIV

SEQ ID NO: 7751 - protein, 216 aa, Brassica rapa
MAAVTPLAKFKLVFLGDQSVGKTSIITRFMYDKFDTTYQATIGIDFLSKTMYLEDRTLRLQLCLWCLICAFQDTAGQERFRSLIPSYIRDSSVAVIVYDVANRQSFLNTSKWVEDVRTERGNDVIIVLVGNKTDLVDKRQVSIEEGDNKARDFGVIFIETSAKAGFNIKPLFRKISAALPGMDTLSSAKQGDMVDVNLKSSNHSSQAEQQSGGCSC

SEQ ID NO: 7752 - protein, 323 aa, Prochlorococcus marinus str. MIT 9211
MATVTELLQPVEIDLEHLLTDLRSLIGAGHPILQAAAEHLFSAGGKRIRPGIVLLLSRALSVDGELSSRHRRLAEITEMIHTASLVHDDVVDEASTRRGVPTVHSRFNHRVAVLAGDFLFAQASWHLANLNNLDVVKLLSRVIMDLADGEIKQGLYRFDAGQSFSTYLEKSYCKTASLIANSSQAVGVLNDLPKEKLNSLYHFGKQLGLAFQVVDDILDFTGNDKQLGKPAASDMASGYITAPVFYAIEENPSLEALIVREFSSQGDLENALEIVRNSKAIARSRHLAESLAKESHEALNWLPDSPSQQALLELPNFVLSRLY

SEQ ID NO: 7753 - protein, 435 aa, Burkholderia vietnamiensis G4
MDSNSQNDPLPTRDPVVGPSKPRLFGFLGAGLITGASDDDPSGIATYSQAGAAFGYGLSWTLLFSYPLMVAIQMISARIGRTTGHGIAGVLRRHYPDWLLQWVVVLLLIANIINLGADLGAMADAMALLLPGPKWLYVLLFSAICIAMQLLLQYTRYVAVLKWFTLSLFAYFAVLAIAHIEWARLASHLFVPHLSWTSSYLTLVVAIFGTTISPYLFFWQSEEEVEDMHAHPTRRDLFSAPAQAPTALHRIEMDTVTGMGLSNLVALAILATTAATLNAGGITDIQTSAQAALALRPIAGHFAALLFTVGIVGTGLLAVPVLAGSAAYAVGEARDWPVGFSRKVQEAKAFYATIAIATLIGMVINFTSINAIKALYWSAVLNGVIAVPVMIVMMLIASRTDIMGAFSVKGWLRALGWLATIVMFVIAVGMVVTSF

SEQ ID NO: 7754 - protein, 398 aa, Burkholderia vietnamiensis G4
MSSNRGVVYLGPGKVEVQKIDYPKMVDPTGRAIGHGVILKVVSTNICGSDQHMVRGRTTAPVGLVLGHEITGEVVEVGPDVETLKIGDLVSVPFNVACGRCAMCKDTHTGVCLNVNPSRAGGAYGYVDMGGWIGGQAEYVLVPYADFNLLKFPDRDQAMAKIRDLTCLSDILPTGYHGAVSAGVKPGSTVYIAGAGPVGMAAAASARLLGAAVTIVGDMNAERLAHARAMGFETVDLSKDASLGEQIAQILGVPEIDCAVDCVGFEAHGHGSSGSAEEAPATVLNSLMEITRPAGAIGIPGLYVTDDPGAKDKAAQHGSLSIRFGLGWAKSHSFFTGQTPVLKYNRNLMQAILFDRLPIAKIVNVEVISLDQAPEGYKKFDGGAPRKFVIDPHGLLAA

SEQ ID NO: 7755 - protein, 921 aa, Candida albicans SC5314
MSTEKPIPALPVTSITSHVDVAAHEVNLQAITSNPLSIGEVGTTLTNGQKDFILKRLHYDSLVSFDKLPPQATFIFEKIEHISIEEALAILEKAVVEHENDVNILDNDEELWTKLINYKQGKIPSDTDFSEKAHPSNFTAKDKLSAFIHEKRVSEETSSLDNSASENLNEPYYKIVDWELQVKLEAVLIAYWSPYPQVRGVTDPYDDPTIPVETVRVYIVAIIWTAIGAVINQFFSERQPSIGLGMSVVQVFLYPTGLICEWILPKWKFKVWKYTIDLNPGPYTFKEQMLATIFCGVSSGTSYVSSNILMQKSELFYDNKWVDFGYQVLLTLSTNFLGFGLSGIMRQFAVYPEKAIWPSILPNVRLNKTLMSPEVKARINGWSISGYNFFFITAGISFLYFWIPDYLFQALSQFNWMTWIKPDNYNLAVVTGSFGGLGLNPIPSFDMNVIGTGGFIAPFYNTLESYIGMVLALFCILGVFYSNYKWTGFLPINSNRLFTNEGKPYHVTAVVNSNSLFDEEKYKEVGPPFYSAGNLVLYGAFFAIYPFHFVYEIAMNYKQMWEALQSLYKGIRNFKRSTYEGFDDPHSVMMRAYPEVPEWAYLIILVISLVLAILCVKLYPAETPVWGIFFALAINFVFLIPLTTVQSRTMFGFGLNVLVELIVGYAIPGNGLALAFIKALGYNIDGQAQNFINDLKQGHYAKLPPRAMYRCQLLSVFITSFIQLGILNYQITGIKDYCVPGNKQKFTCPGTTTFYNASVLWGVIGPKKVFNGLYPILAWCFLIGFLLAFPCIAFKKWAPRKYSKYFEPSIIIGGFLGYAPYNLSYNTGGLYVGYAFMHYVKRKYEAWWQKYDYLLATGIDAGIAFSSIIIFFAVMYHEKDISWWGNNVPFEGWDASMTNGYLNATLQAPDGYFGPRVGHFP

SEQ ID NO: 7756 - protein, 697 aa, Burkholderia vietnamiensis G4
MRDAESRNAGDPSRAADRRDAALDRRGRPARHDARVGRAAREDLDGHRQSLLRRQGRPARSHDAARAARSVGGHHAPPRRRAQGSAREAARDRRRQLRRHAGQRAGDEDLARVLVAEHARAEAQAPAARQHAAPALEPVRRIREAPAAREGARSGQRPRRADRRPVAARRARRRPDRYPGGLEARPRLHRPAARVRVTRRAVANLEILMSVYGLQRLYIGGAYVDATSGKTFDTFDPATGELLAQVQQASAADVDRAVASAQQGQREWAALTAMQRSRILRRAVDLLRERNDELAAIETRDTGKPIGETLAVDIVTGADVIEYYAGLATAIEGLQVPLRAESFVYTRREPLGVCAGIGAWNYPIQIACWKTAPALAAGNAMVFKPSEVTPLTALKLAEIYTEAGVPAGVFNVVQGDGSVGALLTGHPDIAKVSFTGGVETGKKVMSLAGASSLKEVTMELGGKSPLIVFDDADLDRAADIAVIANFFSSGQVCTNGTRVFVQRSIKDAFTAKVLERVKRIRVGKPTDADTNFGPLVSAAQLDKVLGFIASGKAEGAKLLAGGTRLTDGHFADGQYVAPTVFGDCRDDMKIVREEIFGPVMSILDFESEDEVIARANDTHYGLAAGVVTENLSRAHRTIHRLEAGICWINTWGESPAEMPVGGYKQSGVGRENGITTLEHYTRIKSVQVELGRYNPVF

SEQ ID NO: 7757 - protein, 404 aa, Sulfolobus solfataricus P2
MKCEYLIIGSGIAGYNALKELLQIKPNSRIIMITSDKYYPYDRPPLSKDYLKGKLEKDMLFFESDDFYKRDNLEVMLNKSVERIDANLKEAILNDGSVISFDKALISTGGRPRRLNIPGSENALYLRSLDDADRIREAASKGKNALIIGAGFIGVEVASSLITLGVKTTVVEVMPYIWNTFVDEKVSRVIQQYLESKGINFILNESVKEIQGKIATTSSGRKIEADMFLIAVGISPNVELAQRSGMQVDNGIVVNEYLETSARDIYAAGDIANIFDPREGKRKRIEHWNNAEYTGKLAARNMAGSREAYNFISSIWSDIFDLHIESAGETRNYDEYIIRGKFELERPRFSVIYLKGGIIKGYLAINRNVKEIIALNKLIQKQADVSSKRDKLADESFDLQKLLI

SEQ ID NO: 7758 - protein, 121 aa, Zea mays
  misc_feature (12)..(12): Xaa can be any naturally occurring amino acid
  misc_feature (82)..(82): Xaa can be any naturally occurring amino acid
GLFEGLKAYKKXDGSILLFRPEENVKRMRTGAERMCMPAPSVEQFIDAVKQTVLENKRREGLAPINLIVEDKFHRATPGGTXGVKTIGNYASSEQVNAGIKAESLFCDSIVCTTLAIEYFL

SEQ ID NO: 7759 - protein, 473 aa, Prochlorococcus marinus str. MIT 9211
MSKKPREVLSQIKDEGIELIDLKFTDIHGKWQHLTVTADMVDEEAFKSGLAFDGSSIRGWKAINESDMAMVPDASTAWIDPFYRHKTLSLICSIQEPRSGEPYARCPRALAQKALSYLSSTGLADAAFFGPEIEFFLFDDVRYNSSEGNSFYSVDTIEAPWNTAREEEGGNLAYKIQYKEGYFPVSPNDTAQDIRSEMLLLMGQLGIPIEKHHHEVAGPGQHELGMKFASLINAADNVMTYKYVVRNVAKKYGKTATFMPKPVWNDNGTGMHVHQSLWKNGQPLFYGEGTYANLSQTAKWYIGGILKHAPSFLAFTNPTTNSYKRLVPGFEAPVNLVYSQGNRSAAVRIPLTGPSPKAKRLEFRSGDALANPYLAFSAMMMAGIDGIKNQIDPGDGVDVDLFELPSEQLSKISTVPSSLNDALDALKADNSYLTEGGVFDSDFIDNFIELKYEEVQQLRQRPHPHEFFMYYDA

SEQ ID NO: 7760 - protein, 319 aa, Rickettsia typhi str. Wilmington
MINTNNYHIIAKRIISNAANALDKLSNNIPADFNRIIEFLLSFKGRIILTGIGKSGYIARKIAASFSSTGMPSFYLHPSEASHGDLGTITRNDLVMMLSNSGETKELFNIIEYCNNSSIKIAAMTMNKNSTLAKRSDFLLIIPECQEASLIGAPTISSLIMLSLGDAVMTVIHEERGFTRDDFKIYHPGGTIGANLTKIKNIMRSGDEIPLVYEDTSFTETIIIMNKKRLGCTLVTDKEQNLIGIITDGDLRRNINDQIHLKTASSIMTKNPHHISSGIFAQEALNLMKAKNITNIPIVDNNMIIGIIHIHDLLRMGVS

SEQ ID NO: 7761 - protein, 909 aa, Synechococcus sp. WH 8102
MAASGLDPSKIFPFPLDDFQLEAIDALNQGHSVVVSAPTGSGKTLVGEYAIHRALAHGQKVFYTTPLKALSNQKLRDFREAYGDDNVGLMTGDLSVNREASIVVMTTEIFRNMLYAEASEQDDPLADVEAVVLDECHYMNDSQRGTVWEESIIHCPPSVQLVALSATVANAGQLTDWIQKVHGPTTLVLSDYRPVPLQFSFCSAKGLHPLLNDAGTGLHPNCKVWRAPKGHKRKGRSAKPPQPEPPPISFVVAQMAERDMLPAIYFIFSRRGCDKAVRDLGIQCLVNKEEQARIRARLKAYSSENPEAVRDGIHADALLRGIAAHHAGVLPAWKELIEELFQQGLVKVVFATETLAAGINMPARTTVIAALSKRTERGHRPLMGSEFLQMAGRAGRRGLDSRGYVVTVQSRFEGVREAGQLATSPADPLVSQFTPSYGMVLNLLQRHDLNKARELVERSFGRYLASLDLVEEEDVLSQLRLQLGQLEGVAGDIPWEDFEEYEKLRGRLREERRLLRILQQQAEETLANELTLALQFASTGTLVSLKSPQLRGRVTPAVIVDKIEGPGQFPLLLCLSDENLWLLLPCQSVVSIHAELSCLQVDGVTAPDLHKAGELRHGDQASGGLALAVAHVARRHDMTMPQYDLAGEVLTQARTVQALEQEQEAHPAHRWGDRKQLKKHRRRMEELEQEIEERQRLLHHRSNRHWETFLALLEILQQFGCLDELTPTEIGRTVAALRGDNELWLGLALMSGHLDDLSAPDLAAVFEAISTEVNRPDLWSGFPPPPAAEEALHDLSGLRRELLRAQERLGVVLPAWWEPELMGLVESWARGTDWSDLIANTSLDEGDVVRIMRRTVDLLAQVPYCEAISEQLRSHARQALRAINRFPVAEAEDLLKQAGDQNPATERAA

SEQ ID NO: 7762 - protein, 250 aa, Neisseria meningitidis Z2491
MGYMIDGTQAEYVRTQAEYVRTQAEYVRTPYADNSLVPLPDNVNEEVALLLSDALPTAHEIGVQYGDVKPGDTVFIAGAAPVGMSALPTAQLYSPAAIIVCDMDENRLKLAKELGATHTINPASGDVSKQVAAIVGEDGVDCAIEAVGIPATWNMCQDIVKPGGHIAVVGVHGQSVDFKLEKLWIKKLAITTGLVNANTTEMLMKAISSSSVDYTKMLTHRFKFSELEKAYDVFKHAAENQAMKVVLEAD

SEQ ID NO: 7763 - protein, 375 aa, Oryza sativa (indica cultivar-group)
MPASDPAPAAAAAAYDRTAELRALDATLSGVRGLVASGATHLPRIFHNVVHGDQEPPEATAPSSAATTTTTVPVIDISGSRAAVVDAVRRAAAEWGFFQVTGHGVPLAAMDAAAGAARAFHESGGGEGSDKARLYSREPGRAVKYHCNFDLYQSPVANWRDTLYLRMAPDPPPAADLPEICRDALFEYAKQVKNLGNTLFELLSEGLGLKPSYLTDIECNQGQIILCHYYPPCPQPELAIGTSRHSDSGFLTILLQDDIGGLQILHEDRWVDVTPTPGAFIVNVADLLQLISNDNYKSVDHRVVAKNTEPRVSIACFFSTHFHPISTRMYGPIKELLSDENPPLYREALVRDYTARYYSVGLDGKFKTTLSEFRL

SEQ ID NO: 7764 - protein, 228 aa, Leuconostoc mesenteroides subsp. mesenteroides ATCC 8293
MSSSQDLQKIIAGRRAADFVQDGMVVGIGSGSTIAQVITALGERVANENLKIVGVPTSEKTRRNAAKLGIPMYNVDDVDKIDLTIDGADQISDDFSAIKGGGAALLWEKIVAFNSRENIWVVDSSKRVSKLNQYLPVEIIPYGSDQLFKRFTADGFHPTWRLDQNGNPVRTDSANYLIDLHVPVIEDPRDLGQELINMVGVVEHGLFTDVVNRVVIGSDDGVEIIEAP

SEQ ID NO: 7765 - protein, 327 aa, Thermobifida fusca YX
MSGTELTLGKAINAGLRRAMENDPKVLVMGEDVGRLGGVFRVTDGLYKDFGADRVIDTPLAESGIIGTAIGLALRGYRPVCEIQFDGFFFPAADQTFTQLAKLRARSEGRLSLPVVIRIPYGGGIGAVEHHSESPEAYFTHTAGLRVVTVATPEDAYWMIQQAIACPDPVVFLEPKRRYWDKAPVRTDGSVDTATPMGEARIVRPGTDVTLVAYGPMVKVALHAAEADTERSIEVIDLRSLSPVDYDTVYESVRRTGRLVVTHEAPVTSGLGAEIAARVTEACFYHLEAPVIRVGGFDTPYPPSRLEEYYLPDLDRVLDGVDRTFAY

SEQ ID NO: 7766 - protein, 446 aa, Thermobifida fusca YX
MTHQGIQQFVLPDVGEGLTEAEILTWHVQPGDQVDVNQVICEIETAKAVVELPSPFAGRVEALLVEAGETVPVGTPIIAVDTGGAAGEPRPEPAPAAAPAEPPAEEKREPVLVGYGVKSGATKRRARRRTPSAVPAQTVGQRTVVLAKPPVRKLAKDLGVDLRTVVPSGPNGVITRDDVRRHAEQNQPQPSAPRVPEPAAPAPAASPAPERDVREERIPVKGVLKHMAAAMVDSAFTAPHVTEFLQVDVTKTVKVVQKLRQRPEFADVKVSPLLLVARALLIAVRRHPRINASWDEANQEVVVKHYVNLGIAAATDRGLVVPNIKEADRLPLPDLARALTDLTEKARAGQTAPADLTGGTITITNIGVFGIDGGTPILNRGEAAILALGQIRDMPWVHKGKIKIRKVTTLSLSFDHRLVDGELGSKVLRDVATILEDPEEMVLAWG

SEQ ID NO: 7767 - protein, 543 aa, Brassica rapa
MASMSMSSREKRRKRKREASPESTTPVSKPTPASTPRWSSPIPSLPYDLVLLCVARVSRLYYPTLSLVSKSFRSLVSSPELYKTRSLFGFTESCLYVCLQDLRGSSTWYTLCRKPDKTLKTGSSGYALSKVPVPSSPIWRCSNVVAVGSNIYNIAFPRSLNVLPRVSILDCKSHTWIEAPSLPVELHSFSASVVHQKIYVAGFDHRLKKNSFEVFDTETQIWDSVSTGNTSVEREGIEREGMFIKKTISIDGKFHVVTDEEVFAYDPKLAKWDMVGRGMRGLMYSEAYCVIGNVLYSAKEGVFKWYDTERRTWKDLQGLVGLPKITRHREFIRLGYYGGKMVVFWVHVIWPYYKKICFFEEAQLVLADLWFWSCNEKIREYTAQVLYFAVKTLKETGHEHVYDAVEKPLQLAQTAAVLEVQSHFLVASLVISWSITEIIRYSFFGLKEALGFAPSWHLWLRYSSFLVLYPTGITSEVGLIYLALPHIKTSEMYSVRMPNTLNFSFDFFYATILVLAIYVPGSPHMYRYMLGQRKRALSKSKRE

SEQ ID NO: 7768 - protein, 272 aa, Brassica napus
MTTIINSGGAIAIREVWAENLESEFELISGIIDDYPFVSMDTEFPGVIFKSDLRRGNPADLYRLLKSNVDALSLIQVGLTLSDADGNLPDLGDGRRFIWEFNFKDFDVARDAHAPDSIELLRRQGIDFERNRRDGVDSERFAELMMSSGLVCNEEVSWVTFHSAYDFAYLMKILTRRELPCALGEFQRVMKALFGERVYDMKHMMRFCERKLYGGLDRVARTLEVNREVGKCHQAGSDSLLTWHAFQRMRDLYFLQDGPEKHAGVLYGLEVF

SEQ ID NO: 7769 - protein, 105 aa, Arabidopsis thaliana
  misc_feature (22)..(22): Xaa can be any naturally occurring amino acid
FVESPVTRKTNKDMTNILSNGXRVSSMKVWPPLGKKMLETVCYLPDLSDVDAAKEVDYLIRNKSAPCVRIVLEHRFVYRDHRNTPGYYNGRYCTMWKSSLFRCTD

SEQ ID NO: 7770 - protein, 329 aa, Debaryomyces hansenii CBS767
MAFGAPRGRGGDRGGFGGRGGSRGGFGGARGGRGGSRGGFGGDRGGRGGSRGGFGGDRGGRGGRGGPRGGARGGRGGARGGARGGAKVVIEPHRHAGVFIARGKEDLLVTRNIAPGESVYGEKRISIEEPSKEEGAAPTKIEYRVWNPFRSKLAAGIMGGIDELGIAPGKKVLYLGAASGTSVSHVADVVGPEGMVYAVEFSHRPGRELIGMAKKRPNVIPIIDDARHPQKYRMLIGMVDAVFADVAQPDQARIIALNSHLFLKDQGTVVISIKANCIDSTVDAETVFAREVQKLREERIKPLEQLTLEPYERDHCIVVGRYVRSGLKK

SEQ ID NO: 7771 - protein, 555 aa, Arabidopsis thaliana
MESTNLAGGDGAESSSKKFQSSSYRSIDEFQAVALTIAAFLSGDPRSPIMDLGKLIQLSALLCPFLLSLHFRIAGASAHIYSSQPFHDVGNSLLLYGGSEGIFASSRSLIRFENITLWRTITGKGHRSNGLVQAVIFEASDRNNIGGSAYGGQRSICCTPDLAKLQGCKQGEIIRIPSPHDPQWPILLPVRFKGKRSSAKMADTEILITKTGIYNLLFISCDPQLKGLKMTGKTVWKNPDGYLPGRMAPLVNFYVYMSLAYLLLSAVWFFQYLRFRMDILPLQHCITAVILLGLLEMLFWYLDYANFNHTGMRPLALTTWVVTIGALRKTVSRILILCVSMGFGVVKSTLGGLTSKVLLVGVTYFIASEILDIAEHVGIIDDMSGRSKLFLVLPDAFLDAFLILWIFTSLSKTLEQLQMKRTSVKLEIYRKFSNALAVMVVASVAWIVYEVYFKATDPFNERWQTAWTITAFWDVIAFLLLCIICYLWTPSQNSQRDANMKLMMDRYAYSGDVDEENEEAQSLTGGKQDGDISLVKQEKNAESDREEDVEEDKRE

SEQ ID NO: 7772 - protein, 514 aa, Chlamydomonas reinhardtii
MALKMRVSQRQALGSQTFVCPHGSVVRKAVSSKARAVSRQAQVVRAQAVSTPVETKVANGVAASSAAGTGQNDPAGDISKTVLGIILGGGAGTRLYPLTKKRAKPAVPLGANYRLIDIPVSNCLNSNVTKIYCLTQFNSASLNRHLSQAYNSSVGGYNSRGFVEVLAASQSSANKSWFQGTADAVRQYMWLFEEAVREGVEDFLILSGDHLYRMDYRDFVRKHRNSGAAITIAALPCAEKEASAFGLMKIDEEGRVIEFAEKPKGEALTKMRVDTGILGVDPATAAAKPYIASMGIYVMSAKALRELLLNRMPGANDFGNEVIPGAKDAGFKVQAFAFDGYWEDIGTVEAFYNANLALTDPEKAQFSFYDKDAPIYTMSRFLPPSKVMDCDVNMSIIGDGCVIKAGSKIHNSIIGIRSLIGSDCIIDSAMMMGSDYYETLEECEYVPGCLPMGVGDGSIIRRAIVDKNARIGPKCQIINKDGVKEANREDQGFVIKDGIVVVIKDSHIPAGTII

SEQ ID NO: 7773 - protein, 271 aa, Clostridium perfringens ATCC 13124
MKLFGLIGEKLGHSLSPEIHNKVFKDNNIDGLYNLFSVKKDFENNIVESLKCLGVKGANVTIPYKEKVMDQLDIISHEAKAIGAVNTILIKDGKSYGYNTDYYGFGKMLERAKVNIEGNSFFVLGAGGAARSILKYLEDSKAKKIVLVSRDREKAFKKFKDFNINFMSYGELEEINEEFALINTTPCGMYPNINSVAVSEKVIKKFKVAVDIVYNPLETKFLKMAKDNGLKTVDGLFMLVGQGVKAEEIWNGIKVDKSTEEDIYEELKCRF

SEQ ID NO: 7774 - protein, 647 aa, Brassica napus
  misc_feature (324)..(324): Xaa can be any naturally occurring amino acid
MAFPIDHSLADLTKLNLLPKPHGHASDMFPFRLSVFPRVHLSLRTSTSRVLSSLGSKVDPNGSVLIETTTPPEPSPDVTGGVQDVYGEDAATEDMPITPWSLSVASGYTLLRDPHHNKGLAFSQRERDAHYLRGLLPPTVISQDLQVKKMMHTLRHYQVPLQRYMAMMDLQETNERLFYKLLIEHVEELLPVVYTPTRGEACQKYGSIFLRPQGLFISLKEKGKILEVLRIAPEKNIQVIVVTDGERILGLGDLGCQGMGIPVGKLSLYTALGGVRPSACLPVTIDVGTNNEKLLNDEFYIGLRQRRATGEEYSELMHEFMTAXVKQNYGEKVVIQFEDFANHNAFDLLAKYGTTHLVFNDDIQGTASVVLAGLIGALRFVGGSLANHRFLFLGAGEAGTGIAELIALEISKKCQIPLEEARKNIWLVDSKGLIVSSRKESIQHFKKPWAHDHKPIKELVDAVKAIKPTVLIGTSGVGQTFTQEVVETMAELNEKPIILSLSNPTSQSECTAEQAYTWSKGRAIFASGSPFAPVEYEGKTFVPGQANNAYIFPGFGLGLIMSGTIRVHDDMLLAASEALAEQLKEEHYEKGMIFPPFRNIRKISARIAAKVAAKAYELGLATRLPQPKELEKCAESSMYSPSYHSYR

SEQ ID NO: 7775 - protein, 339 aa, Thermobifida fusca YX
MTETDSYDVICIGETMGQLSPASAVPLVEQPPLLPRIGGAESNVACGLAGLGHRVAWMSRVGDDPFGAIITRTLARYGVDTSLVEVDQERPTGLYLKDPAPKGTRVYYYRRESAASAIGPRLAERPELRTARLLHLSGITPALSTSCAAFVQRLFVSRPAHGPLLSFDVNYRPALWPADDAAPVLLDLARAADLVFVGRDEAEQLWQASTADQVRALLPDVPLLVVKDADVGATSYTGARRVFVPAPRVDVVEAVGAGDAFAAGFLSGLLDDRTPEECLRLGHIMAAATLLSVADLAPFPPREARERLLALSPAAWAALCIPDPDLFPLDPSDPLFSGA

SEQ ID NO: 7776 - protein, 340 aa, Brassica rapa subsp. pekinensis
MDHEADAYRTDLMTITRFVLNEQSKYPESRGDFTILLSNIVLGCKFVCSAVNKAGLAKLIGLAGDTNIQGEEQKKLDVLSNDVFIKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 7777 - protein, 323 aa, Synechococcus elongatus PCC 7942
MTSVTSLFAPVEADLQLLTDTLKQLIGARHPILYAAADHLFGAGGKRLRPAVVLLLSRATMPGQEITPRHRRLAEITEMIHTASLVHDDVVDESSLRRGIPTVHSSFSNRVAVLAGDFLFAQASWHLAHLDSLTVVKLLSQVIMDLAEGEILQGLNRFDSSLSIEVYLDKSYYKTASLLANSARAAGVLSGSSETVCDALYDYGRSLGLAFQIVDDILDFTGSEEVLGKPAGSDLASGNLTAPALYAIEEHPALVPLIEREFSQAQDFEQAIALVHNSQGLARTRALAAEHAQKAVQALDVLPASDCKETLISLTSYVLSRLS

SEQ ID NO: 7778 - protein, 284 aa, Glycine max
MSSFLLTFPYFPNDASWQVKLCPSPQIRLVCVKTNLKTLTKASSQNCVESMSSLTSLAPLEAVLFDVDGTLCDSDPLHYYALREMLQELGFNGGAPITEEFFVETFSGKHSDDTALVVFPGDLERGLKFVEDKEAMFRRLASEQLNPLKGLDKVRKWVENHGLKRAAVTNAPRKNAELIISKLGLTDFFDAVIIGDECEHAKPHPEPYLKALEVLKASKDHAFVFEDSASGIKAGVAAGMPVIGLATRNPENLLMEAKPAFLIKDYEDSKLWAALEELDKAGAR

SEQ ID NO: 7779 - protein, 427 aa, Oryza sativa (japonica cultivar-group)
MASSGCSSNRLRQTIVVALLLLASSSCLASAKHRGNGTTTTVPFHGKDELRRYRKIMAQVARLKKASVKTIQSPDGDVIDCVPAHLQPAFEHPKLRGQKPEAEPEERPKVGGAAAAEAEEEAVFPQAWTDGGESCPEKTVPVRRTRRRDVLRSSSAVRFGMKQPRAAGVVRRDSTSDGHEHAVGYVTGDQFYGAKASLNVWSARVATAAEFSLSQIWVISGSFGNDLNTIEAGWQVSPELYGDNNPRFFTYWTTDAYQATGCYNLHCSGFVQTNNRIAIGAAISPTSVYNGRQFDISLLIWKDPRRGHWWLQLGSGPLVGYWPSSLFTHLGGHANMVQFGGEVVNTRPSGSHTPTQMGSGHFPREGFNRAAYFRNLQVVDWDNNLLPAAALRLVADHPSCYDIQGGYNRAWGNYFYYGGPGRNVRCP

SEQ ID NO: 7780 - protein, 476 aa, Symbiobacterium thermophilum IAM 14863
MAQRLASMRIIVRLEIENTGSIFSYIATAIGASGGDIVAVDLIQSRRDVVVRDITIAVENRAHGDRIVQALAALPGVKVVNVSDRIFLAHLGGKIEVKPRVQVKTRDDLSVVYTPGVADVCRAIAEDPAKAFTLTIKRNTVAVVTDGTAVLGLGNIGPAAALPVMEGKAMLFKQFAGVDAFPICLDTTDPDEIVRIVKAIAPAFGGINLEDISSPRCFEIEERLKEELDIPVFHDDQHGTAVVVLAGLMNAARVVGKELADLRVVVCGIGAAGVAISKMLMAAGITNIVGVDRVGIIERGKTYENPMWQWYAEHTNPENRHGTLDDAIEGADAFIGVSAPNVLKVEHVKKMAKDPIVFAMANPVPEIDPDEAAPYVAVMATGRSDYPNQVNNLLCFPGIFRGALNCRARQINEAMKLAAARAIASVVSDEELHAEYIIPSVFNKRVVEAVAAAVEQAAYETGVARRERQPRTGGDD

SEQ ID NO: 7781 - protein, 311 aa, Arabidopsis thaliana
MASLSDKLADAYQNARPRYPIDWFTKLAARTGQHKSAWDVGTGNGQAAIGLAEYFEKVTATDINEAQLKRAVKHERISYHHTPTTMSEDQMVALVGGDNSVDLIVAAQAVHYFDLAPFYNVAKRVLRKEGGLIAVFVYNDIIISPEVDSIMKRLVDSTFPFRTPVMNLAFDGYKTLPFPFESIGMGSEGKPIMLDIPHKLSLKGFIGFLRSWQPAMKAKERGVELVTEDLISKFEDAWGDDDDVKDIFYKAHMIVGKLSASDIERHRKRFDTNCVVTTLKDHNNSAVIASVTAAAFAGVAAYCAYSARKNS

SEQ ID NO: 7782 - protein, 226 aa, Triticum aestivum
  misc_feature (50)..(51): Xaa can be any naturally occurring amino acid
  misc_feature (61)..(61): Xaa can be any naturally occurring amino acid
ISVVAAEVTDAKKDDIQLAIRMPDGPSLQIKLTKEDVLRKVKTFVDENQXXGIGSYNLAMXMPRKVFTEQDLETTLYELGIETRQALVVVPNRQSVKVARHQSSLPSSDLDRTGDTDRSGGWGFLGAALSYVNPLSYLRGNPTPSNPDQLGNEGSQQYRPSSQSQPLRGDGSQQTATHSSGNTLRRRPQQFGGNIHTLSSEEQDPSDNRNVFWNGNSTEFGGDEKK

SEQ ID NO: 7783 - protein, 352 aa, Oryza sativa (japonica cultivar-group)
MAAVTRAARSRALLLLPRASAAAPHFSTTASSGAAAAAAAPVEAAAAGASDASAAAAAGAGEQPAPPPKRWGLLKFGAFAAVCGALGAAGYSSYAYTLEEVDQKTREFRKAMTTPRPVAEDASEFEKFQAMIYSTAMKAPVAAIEFYMDVRHTIEDHIRGFAEPTSDKLLPDLDPLNQHIFTLVLDLNETLVYSDWLRERGWRTFKRPGVDAFIEHMGKFYEVVVYSDQMPMYVDPVLERLDTKGFITGRLSRPATKYQDGKHYRDLSKLNRNPAQVIYISSHALESCLQPENCVQIKPWKLETDDTQLLDLIPFLEYVAMVRPSDIRTVLASYQGRDVAAEFIERSKEHQR

SEQ ID NO: 7784 - protein, 630 aa, Brassica rapa
MANSIFLFSFVSFLPFVCSVHFNIPRFGSDIPEVVYQGDARANGAVELTNIDYTCRSGWATYGKKIPLWDPEIGKPSDFTTSFSFRIDTRGVAFGNYGHGFAFFLAPAGIQMPPNSAGGFLGLFNETNVLSSSYPLVHVEFDTFTNTNWDPLDMTSHVGINNNSLVSSNVTSWNASTHSRDIGRVVIVYDSARRNLSVSWRYDTTSDPKENSSLSYIIDLSKVLPSEVTVGFSATSGGSTEGNRLLSWEYSSSLELIRDDDVEKTEKDRKGLIIGKRAEEIANLTSINEDLERGAGPRKFTYRELASAANNFSEDRKLGEGGFGAVYKGYLNGLDMMVAVKKFAGGSKQGKREFITEVKIISSLRHRNLVQLIGWCHEKDEFLMVYEFMPNGSLDAHLFGKKPHLAWPVRCKVTLGIASALLYLHEEWEQCVVHRDIKASNVMLDSNFNAKLGDFGLARLMDHELGPQTTGLAGTFGYMAPEYISTGRASKESDVYSFGVVTLEIVTGRKSVDPRQGRVEPETSLVERVWDLYGRGEVVTAVDDKLGVDSFDEKQAECLMVVGLWCAHPDRNSRPSIKQAIQVLSFEAPLPHLPSKMPVASYHVSSSSTGTSVSSGGAATATFSSAQLGR

SEQ ID NO: 7785 - protein, 400 aa, Thermoplasma volcanium GSS1
MYEFKLPDIGEGVTEGEIVKWDVAEGDEVKKDQDLVEVMTDKVTVKIPSPVNGKISKILYKEGQVVPVGSTLVQIDTGEETSQQTMAEEHAELKPQTTAAQQIAIETVPAGKVLASPAVRRIARENGIDLAKVKGTGDNGRVTLDDLDAYMRGETKAKAPEKPIEAAKPAEVPPVQRSPGREEILEMHGLRRIIFDKMTKAKQIMPHFTVVEKVDVTGMISIIESAKSSGKKVTITGYIARIVPIVLKQYPYLNAIYDEANRRYLIKKYYNIGIAVDTPDGLNVFVVKDADRKSMYEITAEITDKAERARNNQLKIDEVQDSTFTITNVGTIGGVLSTPIINYPEVAILGVHRVMDENGKKIMYLSLSCDHRLIDGAVATRFIMDLKKIIEDPNSLIYEM

SEQ ID NO: 7786 - protein, 190 aa, Brassica napus
ALAPDTITSANALKQIFTFSLKLAGGQGNPDVAKEAIEIAIRSVTENVDCFKQWDILYKENLEASVALLKKLVDEWEDHSFKLLSSSSSDALTVKHAIYRFRMKNEKTITKGVANSFLYEEADKSCKLILRKLSRGSGGRKITPCTTMVIAAAAAVAGAALVLQEAPHLLVSFILIFILIFFSFFLVSFP

SEQ ID NO: 7787 - protein, 698 aa, Tropheryma whipplei str. Twist
MEYNVSRERRVSALTVFVWDDKDDLAVNTARVLAADAVENVGNGHPGTAISLAPAAYLLFQKVMRHNPSDPSWAARDRFVLSCGHSSLTLYIQLFLAGYKLSLQDLRGLRQWGSLTPGHPEYGHTPGVEITTGPLGQGLASAVGFAYSARFQRGLFKTDIFDHYVYVIASEGDIEEGVTSEACSLAGLQQLGNLLVILDRNYISIEDNTDIALSEDIKSRYLSYGWQVIEVPWRRAGAEYREDVLSLYEALLEAQKDTDRPSLIILETVIAWPSPGKQNTGAAHGAALGVNEVKDLKRILGFDPEKTFEVPDGVLQHTKGALDRGQSQQDNWENVFSSWRQEHPIEAALFDRLQNGVTPDIDHVLPVFSSEKPISTRAASGQVINRIAEVMPELWGGSADLAESNNTTIKSANSFLPESVTVDHWKSDRYGRILHFGVREHAMAALISGIVLHGNTRVFGGTFLVFSDYMRPAVRLAALMKIPSIFVWTHDSIGLGEDGPTHQPVEHLWALRAIPGLSVIRPADANEVAWAWKEILERRDGPVGLVLSRQNLPVLDRTCLAPASELRKGAYILADGSRYPRLILIATGSEVSLAIGAREVLENRGIPTRVVSAPCLEWFDQQEKSYRNHVLPPDVETRISVEAGLSLGWSKYIGDKGASVSIEHYGASAAGDVLFERFGFTVENIVKTADALLGGCGE

SEQ ID NO: 7788 - protein, 456 aa, Triticum aestivum
MHTAYLKLLHSLCAAASPLLSPPLTLRGYSTRRRGGSGGGISSGRMNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNAQTMAWILDEYSKFHGYSPAVVTGKPVDLGGSLGRDAATGRGVLFATEALLAEHGKGIAGQRFVIQGFGNVGSWAAQLITEAGGKVIAISDVTGAVKNSNGIDIAKLMKHSAENRGIKGFDGGDAVDPTSLLTEECDVLIPAALGGVINKDNADAIKAKYIIEAANHPTDPEADEILAKKGVLILPDILANSGGVTVSYFEWVQNIQGFMWDEEKVNRELKTYMTRAFRDTKEMCRSHHCDLRMGAFTLGVNRVARATVLRGWEA

SEQ ID NO: 7789 - protein, 217 aa, Fulvimarina pelagi HTCC2506
MSEHLPDHLVTGYKTFLEKRLPGERDRFRQLAEAGQKPPTMVIACCDSRTAPETIFSSSPGEIFVVRNVANLVPPYEPGGDNHSVSAALEFAVQALKVKHIVILGHSHCGGIKAALSPEREPLSPGDFIGKWVGLLDPVAKGMHDDDRMTPEERQTATERTAIRHSVGNLRTFPMIEELEAANELTLHGAWVDIATGDLWTMDPQTGEFGRMDSVLE

SEQ ID NO: 7790 - protein, 178 aa, Physcomitrella patens
MGEEFRCFVGGLAWATTDGSLEEAFRPFGEVVQCKVITDRETGRSRGFGFVTFADENSMNEAIKDMNGKELDGRNITVNQAQSRGGGSGGGGGGGYNNRQGGGGGYGGGGYGGGGGGGYGAGGGGAYGSRSSYDREGGGGGGYGGSRGGGGYGSGGGGGGGRGGSGSGNWRGGRENAY

SEQ ID NO: 7791 - protein, 598 aa, Prochlorococcus marinus str. MIT 9211
MTKEALSLPDIDDSPLSPCVANGQDRTKFEQFKADSDYLKEPLRTELQNNSDHFSNDAVQLLKFHGSYQQDNRDTRQKGVEKDWQMMLRLRSPGGHIPPELFVALDHLSDQLGNGTLRATTRQAFQMHGIKKESLKTVIETIIRSMGSTLAACGDINRNVMAPAAPFTYGDYPVARRLANQIADVLSPSYAEKTYLELWVDGDISYKISPSNEVKKVRKNQYKEGVYSGDIKEPLYGSTYLPRKFKCAVTVPGDNSVDLLTQDIGLVVFTNAKNKLIGCNVYVGGGMGRTHNNEETFARSAEPIGFVSAEYVLELVQSILALQRDYGDRKVRRHARMKYLINDKGIEWFIDKLKNNYFKYPIKSLRKEPTSKLLDYLGWHKQSHDLYFVGIPLLSGRLSGEYKKAICKLVNKFKLDIQLTPNQDLLLCNIGSYQRSSIKKELSNIGIIKPDSPEPIQRHALACPALPLCGLAVTEAERILPEILDRINTQLSDLRIQKTLLFRMTGCPNGCARPYMAELALVGSGLDQYQLWLGGSPNLQRLAKPFIQRMPLTSLEETLKPLFISWKNSKKEISFGDHMNELGDQNIMELLSLKDKEP

SEQ ID NO: 7792 - protein, 169 aa, Arabidopsis thaliana
  misc_feature (130)..(130): Xaa can be any naturally occurring amino acid
GGPGPEFRGGPHPSGRPRASFMLFSVPMVAFPVKAIMVVLLNGLKSSVAFQATRRVNTAITSITGNGGGVNCLQGGPPMGKKKLGTFFYLPDLTDSEWVKEVDYLIRTRGIPGVEFKWEPGFGSRGPGTXPGSFDGRSWPMGKLPLFGGTDSVQGLKEGERCKRESPNA

SEQ ID NO: 7793 - protein, 493 aa, Klebsiella pneumoniae
MSEIKTLEMPKWGLSMEEGLLARWAIQEGDDFTRGQEICEIETSKIVNVLEAPFAGTLRRILAREGETLQVGAVLALAADASVSDAELDEFVARLATAKPAAPGPEAAAPDVAAQAGAKPASVVSPPSNSPEPPVGQTVIPVSLQGVTDVTQVNATPHALRLSARWGVDLKKVAAAGAGIVSLFLIWKARSLPRGRLASPTPPVRRSKAPRSHADDSQVSATPLARRLAGKLGINLHDCRSSGSRGRVSRDDVLAAALLLDEHPQTSPVQESAPAPFESIPMSGMRRAIASRLQTSKQQSPHFRLSVDLDLERLLALRQDINREVPGVKISVNDLLVKACALALVAVPDVNIQFDEAAQSIRRFTDADISVAVALPAGLITPIVRSAERKSISDISNEIHSLVTRAKAGTLKPEEFQGGTFSLSNLGMLGVRQFDAIINPPQSAILAIGAGEVRAVVRDGQIVARQQMTVSLSCDHRVIDGAAGAAFLRNSSD

SEQ ID NO: 7794 - protein, 401 aa, Thiomicrospira crunogena XCL-2
MAKILGIGNTVLDIILKTPHYPKEDEELRANARHFEVGGNVSNSLYVLSQLGHQSSIMTTIGGDDAAKQLLNGLKSRQINTDHIQRFIQGQTPTSYIIQNTETGSRTITHYRDLSELSFDYFAKVEIENYDWLHFEGRNIENLTGMLNIAKTFLTHQPISLEVEKAREGIEALFPQANVLFFSHHYARQKGFEDGKALLEEMKTLAPESHLICTWGKEGAWFCQAGQEIQHQPIHTIPQTIDTLGAGDTFNAAVIDALSQNKPLFEAVEAGSKLAARKCQQQGLDNLLTEIKEKQPLANIKQLSNAKTMVVPCADLNHSVILIKHDTGIKAYENNCPHQDVPLNEAYKIDVNPFEKTMKCSVHDAFFSIEDGMCVEGPCMNDELVSVPIEIDDRGDIYLAS

SEQ ID NO: 7795 - protein, 365 aa, Daucus carota subsp. sativus
MASVMNLSITHFCSSHLKQKSPSNKLVFHGLNSNPFLKSKPPQNVIPYSSMSISSFHTTKIAMDSSPKPPTFDFKSYMLEKAISVNKALDASVSLQEPVKIHESMRYSLLAGGKRVRPILSIAACELFGGHEAVAMPSACAVEMIHTMSLMHDDLPFMDNDDLRRGKPTNHKVYGESVAVLAGDAMLALAFHLVATETSGVSSSQVVRVIVELAKAIGAEGLVAGQIVDVCSEGDPNLGLKDLEFIHRSKTAALLEGSVVMGAILGGANDEEVEKVRKYARCIGLLFQVVDDILDVTKSSKELGKTAGKDLVADKTTYPKLIGIEKSREFSDELKREAVDQLAGFNSDKAAPLIAMANYIANRDN

SEQ ID NO: 7796 - protein, 210 aa, Fulvimarina pelagi HTCC2506
MKHQNGPLRVGIGGPVGSGKTTLVEKLCKAARENWSIGVVTNDIYTSEDAEALVRAQALTSDRIIGVETGGCPHTAIREDASINMRAIRYLTKRHPDLDLVVVESGGDNLAATFSPDLVDLSIYVISVCQGDDIPRKGGPAITRSDLLVINKTDLAPHVGADLTRMEQDAAKGRGKLPTVCTDLSRAKGIGDILAFLSAAGGLPAIEDAA

SEQ ID NO: 7797 - protein, 368 aa, Arthrospira platensis
MTSTTSKVTFGKSIGFRKELNRRVNAYLEAENISPRDNPPMYLKTAIILAWVVSAWTFVVFGPDVLWMKLLGCIVLGFGVSAVGFNISHDGNHGGYSKYQWVNYLSGLTHDAIGVSSYLWKFRHNVLHHTYTNILGHDVEIHGDELVRMSPSMEYRWYHRYQHWFIWFVYPFIPYYWSIADVQTMLFKRQYHDHEIPSPTWVDIATLLAFKAFGVAVFLIIPIAVGYSPLEAVIGASIVYMTHGLVACVVFMLAHVIEPAEFLDPDNLHIDDEWAIAQVKTTVDFAPNNPIINWYVGGLNYQTVHHLFPHICHIHYPKIAPILAEVCEEFGVNYAVHQTFFGALAANYSWLKKMSINPETKAIEQLTV

SEQ ID NO: 7798 - protein, 651 aa, Vibrio fischeri ES114
MNTHQAFPFPLGATLTNTGCNFAVHHDSAFPLSLIIFKEDGSYTEHSFTEEYGTIKYTHLTGIKEGAVYGFKIIKNEEDLLLLDPYAKALKNIPNYQVPYTAKQSWSLAQAIVVNDNFDWQSTTMPIIPRSETILLETHVKGFTLLNPNIDENVRGTYLGLVDPATIAHIKEQGITSIQLLPIAACMHEPHLLEMGMVNYWGYNSLSFMAPDPRYAISDAVTELKTAIRELHKNNIEVILDVVYNHTAEGGNGGCTFNLKGLDQDYYLHHNGNYTNYTGCGNTLDITHQPSLNLVMDTLRYWVEHYHIDGFRFDLAATLGREYDQFNPNNAFFKAIAQDPILKNTKLIAEPWDIGPNGYQVGEFPDGWNECSDKYRDTTKSFWRGEQNYLKSIATRLMGSRDLVSASRWPHKLPVNYVSYHDGFTLQDLVSYKNRHNHANGENNRDGHGDNRSDNYGVEGPTDNPRIIALREKQKRNMMTTLLFSFGIPHLLAADACSHTQQGNNNAYCQDSEISWVNWNLDPTAQEFKIWLSDMIHARQKHIVPIINAFSGSKRSHQKVEWYTPDGRTMTHNDWHGAKSLCLHLNIYDGEKELLIMINQSNIPTRFVLPKLTKQANWSLVCDTQYSKVKPKPIVFDYSLSPLSIAVFCNK

SEQ ID NO: 7799 - protein, 777 aa, Flavobacterium sp.
MDPHAPQRQRSGQRLRALALAALACALSPAHAAIDAQQLGARYDAAQANLAFRVYSSRATRVEVFLYKNPTGSQEVARLALSKDPATQVWSLSLPTSTIKNTYGITGAVYYGYRAWGPNWPYDAAWTKGSATGFVSDVDNAGNRFNPNKLLLDPYAREISQDPNTATCADGTIYATGAAHRNKDSGLCASKGIALAADATSVGSKPTRALKDEVIYEVHVRGLTRNDDSVPAAERGTYKGAARKAAALAALGVTAVEFLPVQETQNDQNDVDPNSTAGDNYWGYMTLNYFAPDRRYAYDKSAGGPTREWKAMVKAFHDAGIKVYIDVVYNHTGEGGPWSGTDGLSVYNLLSFRGLDNPAYYSLSSDYKYPWDNTGVGGNYNTRHPIAQNLIVDSLAYWRDALGVDGFRFDLASVLGNSCQHGCFNFDKNDSGNALNRIVAELPPRPAAGGAGADLIAEPWAIGGNSYQVGGFPAGWAEWNGLYRDALRKKQNKLGVETVTPGTLATRFAGSNDLYGDDGRKPWHSINFVVAHDGFTLNDLYAYNDKQNNQPWPYGPSDGGEDHNLSWNQGGIVAEQRKAARTGLALLMLSAGVPMITGGDEALRTQFGNNNTYNLDSAANWLYWSRSALEADHETYTKRLIAFRKAHPALRPANFYSASDTNGNVMEQLRWFKPDGAQADSAYFNGADNHALAWRIDGSEFGDSASAIYVAYNGWSGAVDFKLPWPGTGKQWYRVTDTATWNEGPNAVALPGSETLIGGENTVYGMQARSLLLLIAK

SEQ ID NO: 7800 - protein, 608 aa, Fulvimarina pelagi HTCC2506
MKLRNIAIIAHVDHGKTTLVDKLLAQSGTFRENQRTEERAMDSNDLERERGITILAKATSVEWKDTRINIVDTPGHADFGGEVERILNMVDGAVILVDAAEGPMPQTKFVLGKALKVGLKPIVAINKIDRSDERHKEVLDEIFDLFVALDAAEEQLDFPVLYGSGRAGWLASEPDGPQDQGLTPLFDLILDHVPEPDTASRNEPFRMIGTILEANPFLGRLITGRIQSGTIKPNQSVKVLSRDGKQIEAGRISKILAFRGLDRVPLESAQSGDIVAIAGLSKGTVADTFCDPSVTEPLEAQPIDPPTVTMSFIVNDSPLAGTEGDKVTSRVIRDRLLKEAEGNVALEIAEAPDKDSFYVSGRGELQLAVLIETMRREGFELGISRPRVVMKEGENGQMLEPVEEVVIDVDEEHSGVVVQKMSERKAEMIELRPSGGDRQRLVFHAPTRGLIGYQSELLTDTRGTAIMNRLFHSYQPYKGELAGRNNGVLISSEDGESVAYAMFNLEDRGPMVIDAGVKVYAGMIIGIHTRENDLEVNVLKGKKLTNMRASGKDEAVKLTPPIRMTLDRALSWIEDDELVEVTPKNIRLRKLYLDTHERKRFEKAKKAA

SEQ ID NO: 7801 - protein, 76 aa, Triticum aestivum
FCGPAGPTGQAACGQCLLVTNTATGASITVRIVDQCSNGGLDLDYDTAFKPIDTNGQGFQAGHLTVNYQFVNCGDN

SEQ ID NO: 7802 - protein, 405 aa, Vibrio fischeri ES114
MAGVLGMILAGGEGSRLRPLTESRTKPAVPFGGSYRLIDFALNNFVNADLMRIYVLTQFKSQSLFQHMKKGWNVNGITDRFIDPVPAQMRTGKRWYEGTADAIYQNISFIESTDPEHVCIFGSDHIYKMDIRQMLDFHKKKKAALTVSALRMPAKDASGFGVIEVDEHGKMIGFEEKPSNPKCIPGQPGIALVSMGNYIFEAESLCKELIHDAALEDSSHDFGKDIIPKMFPEGNVYVYDFSTNHIKGEKKEVYWRDVGTIESYWEAHMDLLKKDAPFSLYNRKWPLHTYYPPLPPATFSDSDNGRVQIIDSLVCGGSYIRGSRIEKSVLGFRSNIASACDISESILLGNVKVGKGCVLRRVIVDKGADIAPGTEIGVNLQEDKKRYHVSDEGIVVIPKGERVGY

SEQ ID NO: 7803 - protein, 81 aa, Tomato big bud phytoplasma
GEAVGLPAQQMGNSEVGHLNLGAGRVVHQSLTYINRKIKDGSFFKNKCFLKVIQHVKTNKSKLHLLGLVSDGGVHSHLDHF

SEQ ID NO: 7804 - protein, 431 aa, Prochlorococcus marinus str. MIT 9211
MKRVLAIILGGGKGSRLYPLTKMRAKPAVPLAGKYRLIDIPISNCINSNIHKMYVLTQFNSASLNRHISQTYNLSSPFAQGFVEVLAAQQTPESPSWFEGTADAVRKYQWIFQEWDVDEYLILSGDQLYRMDYSQFVNHHRTTGADLTVAALPVDSSQAEAFGLMRTDGEGNIKEFREKPTGDSLKAMAVDTSRFGLTAQSAKERPYLASMGIYVFSRATLFDLLNKHPNYKDFGKEVIPEALNRGDVLKSYVFDDYWEDIGTIGAFFESNLALTQQPKPPFSFYDEKFPIYTRARYLPPSKLVDAQITDSIVGEGSILKACSIHHCVLGVRSRIESDVVLQDTLVMGSDFYESGEERIALRSGGGIPLGVGQGTTVKRAILDKNARIGENVAIVNKDNVEEADRPEEGFYIRNGIVVVVKNATISDGTII

SEQ ID NO: 7805 - protein, 337 aa, Thiomicrospira crunogena XCL-2
MLTPILFSTQERLSMKRLDQVLAADGVNAELELVIKDVMVACKDIAYKLGQGELAGILGATEDENVQGETQKMLDVISNDLLKDILVANPYVRGVGSEEEDYTIAGNADGKYLVTFDPLDGSSNIDVNLSVGTIFSVLEAQDDQSGDNQEVFLQNGRKQVAAGYVLYGPSSLLVMTTGNGVNLFTLDTNIGEFVLTKEALQIPEDTAEFAINMSNQRFWEPEMKQYIDDCLLGEEGPLAKRYNMRWVASMVAEVHRILIRGGIFMYPYDNRDPSKAGKLRLMYEGNPMSMIVEQAGGASSTGRMDIMDVAPQGIHDRVPVVLGSKNEVAKVVAYHTK

SEQ ID NO: 7806 - protein, 361 aa, Tropheryma whipplei TW08/27
MSAKNYKKTLLVNPISQDELQKRLSAPGFGSVFSEHMVSADWHRDLGWHDYRVEPYGPISLAPSAMVFHYGQEIFEGLKIFRHSQDSSVRAFRPLENAKRFQKSSERIALPVLPVEDFLQSLREWVMVDGRWVPNAPSCVYARPFMIATEEALGLRATCSARYTLICCPVGDLFGQIRPIKVRVSSKYSRASRGGTGSVKFGGNYAASILPQVEAGNNGFDQVLFLDSASYKNIEELSASNIFFVLSSKTLITPSLDGTILPGVTRDSIIRIAEDLGFVVEQRQISLDEVTHLFSQDKVTEMFCCGTAASVTPIGSVSFDGGTLGSGQAGPVTMLLREYLRDIQFGNRPDKYNWMVNLEDT

SEQ ID NO: 7807 - protein, 112 aa, Bradyrhizobium sp. BTAi1
MSIEQFIDNEVKSNDVVLFMKGTPQFPQCGFSGQVVQILDHVGVGYKGLNVLESAELRNGIKTFSNWPTIPQLYVKGEFIGGCDIVREMFQSGELQQLFTDKGIPVGTAASA

SEQ ID NO: 7808 - protein, 745 aa, Glycine max
  misc_feature (217)..(217): Xaa can be any naturally occurring amino acid
  misc_feature (484)..(484): Xaa can be any naturally occurring amino acid
MLQTRPGGSGGRTVLVGVKMDSPSKELLTWALVKVAHPGDTVVALHVLGNNETVNGDGKSSLLSLVKAFDSVLAAYKGFCNLKQVDLKLKICRGSSVKKTLVREANGYSATHVVVGTTHGLHKIRSSTVVAKHCAKKLSKDCCVLAVNNGKVVFKRDSSPPSVAELQGVDRHNRNGLLGSIHWTLGKNRKVLSDDSSGMDADEKKTGPISDHSLAKXFLESKETVRNPSCSICGTTLALPDPSFYQSAEGVSGDEGRENSLAMVPVQPTVAAKTELKPGWPLLDGRILSDRQSAGRSLFHLQISVVQWAMRLPSRNLSYAVDRDEKSKICDQGQDQPAALDSESGALVLVDAELGTASSPENNSGNIPKELEGLHEKYSSTCRLFEYQELVSATSNFLHENLIGKGGSSQVYRGCLPDGKELAVKILNPSDDVLSEFLLEIEIITTLHHKNIISLLGFCFENGKLLLVYDFLSRGSLEENLHEXGNKKNSLVFGWSERYKVAVGVAEALDYLHSKDDQPVIHRDVKSSNVLLSENFEPQLSDFGLAKWASTLSSHITCTDVAGTFGYLAPEYFMYGKVNDKIDVYAFGVVLLELLSGRKPISRDYPKGQESLVMWASPILNSGKVLQLLDPSLGDNYDHEEMEKIVLAATLCIKRAPRARPQMNLISKLLQGDAEAIKWARLQVNALDPPEMLDDEACPPSNLQSHINLALLDVEDDLLSMCSVEQGLTLEDYLRGRWSRASSFD

SEQ ID NO: 7809 - protein, 255 aa, Brassica napus
  misc_feature (142)..(142): Xaa can be any naturally occurring amino acid
  misc_feature (249)..(249): Xaa can be any naturally occurring amino acid
GIRPYGRALNGQRPMDPPGMPKGYSKDDESYEDSQLWSLTGESCPEGTVPIRRTTEQDMLRASSVRRFGRKIRRVRRDSTSNGHEHAVGYVSGRQYYGAKASINVWSPIVTSQYEFSLSQIWVIAGSFTHDLNTIEAGWQPXELYGDTYPRFFTYWTSDAYRTTGCYNLLCSGFVQTNRRIAIGAAISPRSSYKGGQFDIRLLIWKDPKHGHWWLQFGSGVLVGYWPAFLFTHLKAHGSMVQFGGEIVXTRPGGS

SEQ ID NO: 7810 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEAAAAVALSVSGELQRVHFDNSSFSPLFSLLQKERVKKIGEMIESDGSDLCSQTPNGVLEVSACCFSFKTHDSSSSYTHLS

SEQ ID NO: 7811 - protein, 627 aa, Lotus japonicus
MPAWWNRKPWKNKQEHDDDEDGEYEAEEVEEAPRSGLQFNFMKSPISSARSSDKKKKKKIKDKKKPKSFDEVLYRNSPRTSKDCDGGAAAMEKKGLPLPRPTTPCDQASISGSSLSSSASASFDDHSISPHFNANRGQEEVKFNVRPKSPCSRGPTSPTSPLHQRLHALSLDSPTGGKQDEGTSQCHPLPLPPGSPTSPSAPCNTRANGVLENNTCNLSKWKKGKLLGRGTFGHVYLGFNSENGQMCAIKEVKVFSDDKTSKECLKQLNQEINLLNQFSHPNIVQYYGSELGEESLSVYLEYVSGGSIHKLLQEYGAFKEPVIQNYTRQIVSGLAYLHSRNTVHRDIKGANILVDPNGEIKLADFGMSKHINSAASMLSFKGSPYWMAPEVVMNTNGYGLPVDISSLGCTILEMATSKPPWSQFEGVAAIFKIGNSKDMPEIPEHLSDDAKNFIKQCLQRDPLARPTAQSLLNHPFIRDQSATKVANASITRDAFPYMSDGSRTPPVLEPHSNRSSITTLDVDYATKPALAAVRTLRNPRDSTRTITSLPVSPSSSPLRQHRPTHNSPFFSPPHPSYAMMGQSSYTSNNMHKNPARSNATLTLDPWLETSRYKAHTPPGGSPRMRFI

SEQ ID NO: 7812 - protein, 526 aa, Vitis vinifera
MEVGDGSFAPVGVSKQRADQYKGRLTTYVVVACLVAAVGGAIFGYDIGVSGGVTSMDTFLEKFFHTVYLKKRRAEEDHYCKYNDQGLAAFTSSLYLAGLVASIVASPITRKYGRRASIVCGGISFLIGAALNAAAVNLAMLLSGRIMLGIGIGFGDQAVPLYLSEMAPAHLRGALNMMFQLATTTGIFTANMINYGTAKLPSWGWRLSLGLAALPTILMTVGGLFLPETPNSLIERGSREKGRRVLERIRGTNEVDAEFEDIVDASEPANSIKHPFRNILERRNRPQLVMAICMPAFQILNGINSILFYAPVLFQTMGFGNATLYSSALTGAVLVLSTVVSIGLVDRLGRRVLLISGGIQMVLCQVTVAIILGVKFGSNDELSKGYSVLVVIVICLFVIAFGWSWGPLGWTVPSEIFPLETRSAGQSITVAVNLLFTFIIAQCFLSMLCSFKHGIFLFFAGWIVIMTLFVYFFLPETKGVPIEEMIFVWKKHWFWKRMVPGTPDVDDIDGLGSHSMESGEKTKLGS

SEQ ID NO: 7813 - protein, 508 aa, Vitis vinifera
MAVGIAVTSHGGHYNGRITLFVVLSCMMAGMGGVIFGYDIGISGGVTSMDSFLKKFFPEVYKRMKEDTKISNYCKFDSQLLTSFTSSLYIAGLVASFVASWITKKFGRKPTILAGGAAFLIGSALGGAAFNVYMVILGRILLGVGVGFANQAVPLYLSEMAPPRYRGAINNGFQFSIGVGALSANLINFGTEKIKGGWGWRVSLALAAVPASILTLGALFLPETPNSLIQRSKDYGKAELMLQRVRGTNDVQAELDDLVKASSLAKTINDPFKKILQRKYRPQLVMAIAIPFFQQVTGINVIAFYAPVLFRAIGLGVSASLLSAVVTGVVGMASTFISMLIVDKLGRRVLFLVGGIQMLVSQIMVGGILAAELGDHGGVSKVYAFLVLLLICVYVAGFGWSWGPLGWLVPSEIFPLEIRSAGQSITVAVSFIFTFIVAQTFLSMLCHFKSGIFFFFGGWVVLMTAFVYYLLPETKSIPIEQMDRVWKEHWFWKRIVVEKLSNPKMETA

SEQ ID NO: 7814 - protein, 479 aa, marine gamma proteobacterium HTCC2143
MSKFDVVVIGSGPAGYVAAIRATQLGLTVACLEKETNKMGKPNYGGTCLNVGCIPSKALLDSSHKYVEAIENFGLHGITAKELSIDIPQMIARKDSIVDQLTGGVGQLFKANGVTAIEGSGRVLAGKQVEVTKRDGSVEILDAGNIIIAAGSVPIAIPPTPIDDDVIVDSTGALEFLEVPKRVGVIGAGVIGLELGSVWGRLGAKVVVLEALEDFLPAIDQQIAKEAKKLFVKKQGLDIRLGARVTASEVKDGQVTVTYIDKDGEKQEVFDKLIVAVGRRPQSQNLLAGDCNVTMDERGFISVNDYCETEAPGIYAVGDIVRGPMLAHKGSEEGVMVAERIAGQKAAMNYDCIPNVIYTHPEIAAVGQTEEQLKADGIEYKVGVFPFAASGRALAANDTAGMVKMIAHAETDRILGCHIIGPSAADLVQQMVIAMEFGSSAEDIALTVFSHPALSEAVHEAALAVDGHAIHIANKRKRK

SEQ ID NO: 7815 - protein, 514 aa, Salmonella typhi
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 7816 - protein, 273 aa, Glycine max
  misc_feature (32)..(32): Xaa can be any naturally occurring amino acid
NAVPPAGPGPGVEDRPCVFHASAELHRRSIAXQVRINIRAIQDMHIFGDPSSIPIVIAERVMNAPRRTISDNSYLRQGHHLDLRLIRNQWLLIDPKVEFLMSETNEDKTSGDFREMGHRLAQEVISFVRKKMDKASRYGNLGDIRLSFVGHSIGYLIIRTALAESMMEPFLRYLYTYVSVSGPHLGYLYSSNSLFNSGLWLLKKLKGTQCIHQLTFTDDQDIQNPFIYNLCKQKTLDHFRHIILLSSPQVFPCLVTLKIIFRHAFYCHFLTCI

SEQ ID NO: 7817 - protein, 480 aa, Thermoplasma volcanium GSS1
MNRMQKIFSLTISFKLSCLGMGYYDDMRHDDLNYEYLYGSTYPLMKNAGSSVAKVIEKNFASGQKVCVVCGTGNNAGDAIVAAELLRTKFEVTVLLVNGLKSELAKKALQEYGGNVVDASHIDECLAADIIIDGIFGVGISGEPKEPYKSTIEKINASGKKIVSVDVPSGLGTNCAVRPDITVTFTSLKYGMNKENSGEIIVADIGIPDDVRKYAGPGDLIYYPRPDPDSHKGMNGTLGIVAGWEYHGSSVIAALAAENLGLDLVRIYVTNKNYEIVSSYDPGIIVRLFDYKRQASYEEVWRNSALLIGPGLGTSHEAEIALKRLVNGSAVPIVIDADGITLLSKHLSIIKGKKIVVTPHKNEFRKLTGTEPNEENAVEFAKEKGIIIVLKGKVDIITDGKEVHYAKGGNARMTMGGTGDLLAGLISSFISKGIDPMRSCLMGTYLNKRIGELAYDKKGLFYKITDMIDEIPSVMASYVR

SEQ ID NO: 7818 - protein, 294 aa, Escherichia coli B
MSHLKDPTTQYYTGEYPKQKQPTPGIQAKMTPVPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSKQFQKTFAINVFALFWLTQEAIPLLPKGASIITTSSIQAYQPSPHLLDYAATKAAILNYSRGLAKQVAEKGIRVNIVAPGPIWTALQISGGQTQDKIPQFGQQTPMKRAGQPAELAPVYVYLASQESSYVTAEVHGVCGGEHLG

SEQ ID NO: 7819 - protein, 337 aa, Streptococcus pyogenes MGAS8232
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKEGKGGLAVGIHNEELVESPILGTAEEGALFSLTEEGKIIVNNPHKARLDFAALNRSLSQ

SEQ ID NO: 7820 - protein, 119 aa, Zea mays
  misc_feature (55)..(55): Xaa can be any naturally occurring amino acid
RAARVLGKGGAKRHRKVLRDDIQGITIPVIHRLAKRGGGKRISGLIYHETRGVLXIFLYNVVLEACPYTEHTRRKTGTAMDVLYTLKRQGRTLYCFRGYVTSSSGGQLPVLSTAVVLCA

SEQ ID NO: 7821 - protein, 1103 aa, Tropheryma whipplei str. Twist
MPNPRDIGSVLVIGSGPITIGQACEFDYSGTQACRVLKEEGIRVILLNSNPATIMTDPEFSDATYIEPMTIEVLEAILDKERPDAVLPTLGGQTALNLAMQLHNKGLLEKYGTQLIGATPEVIARGENREMFRHIVLSSGAEVATSEVITSVEGAVLFAQKNGYPLVIRPSYTMGGLGSSLVHTESELVDSVKQGIEASPNGQVLLEESIVGWKEYELELMRDVAGNTVIVCSIENIDPVGVHTGDSVTVAPAMTLTDREYQNLRNIAIAIIRMIGINTGGCNIQFAVNPTDGRVVVIEVNPRVSRSSALASKATGFPIAKLAAKLALGYRLHEIKNDITKKTFASFEPSLDYVAVKIPLFAFEKFPKANPELTTSMKSVGEVMAIGRNFTTALQKAMRSLDQPHMCFHWQPFESPGHSIASDVPDPREYYLDFIRTPLPSRLVAIQQALRFGASIDEVHEASRIDKWFVSQIDLINKTADSLKDLSMDCLSRAKMHGFSDRQIADLLRIDEEDVRKRRSALGIVPVYKTVDTCAGEFPAVTPYYYSSYDSENEAIPSPSRKVIIIGSGPNRIGQGIEFDYSCVHAAMALSGMGIETVMINCNPETVSTDYDTSDRLYFEPLTLEDVLEVISVEQRNGDLLGVIAQLGGQIPLSLAKSIQHEGIPILGTSPESIDLAENRDLFSNLLRSLNLPTYEHRTVSNKDEAIIAANKMGFPVLLRPSFVLGGRGMKVIHDSQALEDYFNTFHAVDSEHPLLIDKFLSDAIEVDVDALYDKHELFIGGIMEHIEEAGIHSGDSSCTIPPVTLGKNIVNQIVSTTHAIARTLSVLGPVNIQFAIASGILYVLEANPRSSRTLPFVSKATGIPLAKAATRIMLGHTIEDLQREGLLPQRDMRFFNPTDPIAVKEVILPFKRFRTKSGEFLDTLLGPEMQSTGEVMGIGPTFPIAFAKSQQAAFSELPRTGAIFVSVADHDKRKVVLPAMRFYKLGFKIFATSGTADTLRRFGIDVVTIQKFSEAKKTSSRSVVDLIREGRISLVINTPSGGVSIADGYEIRVTALACEIPVFTTISEMNAAVISLESGSHEIASLQELYSSRARSAENLCG

SEQ ID NO: 7822 - protein, 346 aa, Oryza sativa
MASPPSLLPSAGEDDESQREVYEQLRQLVSTYPTVPSGLDTPYYRHPDGWYTFLPAMVSVMVAQRHFTARDTDIIIATFPKCGTTWLKALLFATVHRDGGGAGGVEDDAALAQLRARNPHQLVPFLEIQVYVRDRAPDLSSLPAPRLLATHIPRPSLPASVAISGCKVVYMCRDPKDCPVSLWHFLDAQRPEPRGDVGEDFRLFCDGVSLVGPYWDHVLAYWRWHVERPGQVLFMTYEELSGDTLGQLRRLAEFVGRPFTGEERAARVDEAIVKACSFESLAGAEVNRSGTIELMEEPMRNAEFFRRGVVGGWPNYLSPEMATRIDEITESKFRGSGLVLPTMMTM

SEQ ID NO: 7823 - protein, 121 aa, Brassica napus
MAGVGTSMLVSVLLFTVVLSLQQVYRGKLASSELFTILGGFTSSLLFLFSLTFIGNLQESSGGKSSWGAVIIAEIIALVAASTVHRVCITTCFLFSAGLLYEMNKISGYMLSKAESKSKRH

SEQ ID NO: 7824 - protein, 109 aa, Glycine max
MAGLQRSEVSFRRQGSSGLVWDDKLLSGELNKNEDPKGAHGGDLNLNLNVRTTPPIQRSRSNGGYRTGKVSPAIEPPSPKLSACGFCSAFGKTGEKGRRAKPRAKHRSR

SEQ ID NO: 7825 - protein, 174 aa, Triticum aestivum
MAPAVMASTATTVAPFQGLKSTVSLAVSRRSSGSLGRVSNGGRIRCVQVWPIEGIKNFETLSYLPPLSTEALLEQVDYLIRSRWVPCLKFSKVGFVFREHNSSPGYYNGRYWTMWKLPMSGCTDTTQVLNKVEEVKKDYPDAYVRVIGFNKLPQVQCVSFIAFRPTGCEESGKA

SEQ ID NO: 7826 - protein, 178 aa, Oryza sativa
  misc_feature (40)..(40): Xaa can be any naturally occurring amino acid
MGEEDISNDSKSSCGCEDGTVEAPAAAAPKENGRAADPRXLQAISDAIRVVPHFPKPGIMFNDITALLLRPAVYKDAVDMYVERYRGMRIAAVAGIEARGIIYGPAHALAIGATILPLRTTQKLPGDVLSADYILGYWDAICSEIHVGATEPGERVVVVDDLVATGGTLCAAIKLLGE

SEQ ID NO: 7827 - protein, 511 aa, Schizosaccharomyces pombe 972h-
MLNSVIKRSALCRFKFTCLQVSECRPAQIEISKRLYSAKASGNGEYDLCVIGGGPGGYVAAIRGAQLGLKTICVEKRGTLGGTCLNVGCIPSKALLNNSHIYHTVKHDTKRRGIDVSGVSVNLSQMMKAKDDSVKSLTSGIEYLFKKNKVEYAKGTGSFIDPQTLSVKGIDGAADQTIKAKNFIIATGSEVKPFPGVTIDEKKIVSSTGALSLSEVPKKMTVLGGGIIGLEMGSVWSRLGAEVTVVEFLPAVGGPMDADISKALSRIISKQGIKFKTSTKLLSAKVNGDSVEVEIENMKNNKRETYQTDVLLVAIGRVPYTEGLGLDKLGISMDKSNRVIMDSEYRTNIPHIRVIGDATLGPMLAHKAEDEGIAAVEYIAKGQGHVNYNCIPAVMYTHPEVAWVGITEQKAKESGIKYRIGTFPFSANSRAKTNMDADGLVKVIVDAETDRLLGVHMIGPMAGELIGEATLALEYGASAEDVARVCHAHPTLSEATKEAMMAAWCGKSIHF

SEQ ID NO: 7828 - protein, 289 aa, Triticum aestivum
MASQDHHHHHGGHSHDDDHHHGDAAAATAGKGAGAGAGAGLWVGEDGRVWHSHDGLAPHSHEPIYSAGDFSKRAPPLDSRSFADRAFTVGIGGPVGTGKTALMLALCTSLRDKYSLAAVTNDIFTKEDGEFLVKHGALPEERIRAVETGGCPHAAIREDISINLGPLEELSNLYKADLLLCESGGDNLAANFSRELADYIIYIIDVSGGDKIPRKGGPGITQADLLVINKTDLASAVGADLAVMERDALRMREGGPFVFAQVKHGVGVEEHLWNHVLRAWEIATGNRRR

SEQ ID NO: 7829 - protein, 332 aa, Leuconostoc mesenteroides subsp. mesenteroides ATCC 8293
MAMPSLPKIWDTFPELNPPLQNVLIEMSESWRIGFSEIDNAIRSQASAGKLVRPALTLLFSELTDAPYNQKAIVLGASIELLHLATLIHDDIIDESKLRRGQDSIQAHFGKDTAVYAGDYLLTGMLSLLNDADNIQANKLALESLRNILFGELTQKHNRYLTDTSFDNYLTQITGKTAALFKLSVLFGATSSDGVSSQLLDVVGKLGENLGIAFQLLDDYLDFESITEQLSLGKPAGQDIRNGIYTAPILFALENPDINAELKELLALRDGITDDQLVHIHNVVLESDAMSRLNSLLAEYSQELDDLLNKLPNNALRQKLSHLATLLLNRKN

SEQ ID NO: 7830 - protein, 556 aa, Leuconostoc mesenteroides subsp. mesenteroides ATCC 8293
MNEKNIVIVGAGFGGVFAAKTLSKKLRSHKEYNIILVDKHSYFTYMTELHEVASQRVKPKHVQEDLEHLFYQDKNVKLLTTEVTNINKDKKTISTTQGDIPYEKLVLAVGGQSNDFGTPGVKEHGFELWSMEESLKIRNHVENIIGQGAAELDPDKREQMLTIAVVGSGFTGAELMGEFIEQRKVLAQTYKLDESEIKLVLLEASPSILNMLKDRKLADKAFKYMEDNGVDIRLNSRVTGVDENGVFFQDGSTLPTKSLIWTAGVKAKSFISNWGFKYGRGGRIEADDYMRATKEDGTPEKDIYVAGDTLSYVDEKTGPIPQTVEGAESAARAASANILADFGLGKAKTFSEAVKYHGFAVSIGSHYTVASLMGLNFSGFIASIAKHGINLFFYSQIRSAYSIFHYMLDEFFRTEDGRNPFKGSISRLGNVLWSTPLRLFLGIFWILVALGNAGDLNNFFWQSGLASFIEIVTGAGILLGLFTWPLGLLSILLTIVSGATHSFELTHWFVMLSSLAIMNGSGRGFGLDFYVVPLLQKIFGGLWYGKAKSTYNELEK

SEQ ID NO: 7831 - protein, 445 aa, Pseudomonas aeruginosa
MTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNARAGHPRDGVEQFSLQFLEGVPPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 7832 - protein, 157 aa, Zea mays
VAFRFEPPPNPQQSTGGEATAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 7833 - protein, 242 aa, Arabidopsis thaliana
MSTGLDMSLDDMIAKNRKSRGGAGPARGTGSGSGPGPTRRNNPNRKSTRSAPYQSAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 7834 - protein, 360 aa, Prochlorococcus marinus str. MIT 9211
MKTYNVVLLPGDGIGPEIMDVATKTIDYVAQKYNFGIEYEQKLIGGSAIDKYNDPLPEETLKACKSSDAVLLSAIGSPKYDALPREKRPESGLLNLRSGLGLFANIRPVKVWPALISESSLKQEIVQNVDLVVVRELTGGIYFGQPKGRLQSENGERAFNTMTYSTMEIDRIARVAFELATDRKKKLCSIDKANVLDVSQLWRERVIELSYNFPKVELNHLYVDNAAMQLIRQPDQFDVILTGNLFGDIISDEAAMLTGSIGMLPSASLRLEGPGLFEPVHGSAPDIANKDIANPMAMVLSAAMMLRVGLKENNAADDLENAIDKVLKDGYRTSDLMTNGKKVLGCREMGEQILMSLAAA

SEQ ID NO: 7835 - protein, 193 aa, Methanothermobacter marburgensis str. Marburg
MLDKLKESLRNSPVIKKGEYDYFVNPVTDGIPLTEPELLEEIADEIVRRFNPDPASVDKIVCIEAMGIHHATVLSLKTRIPFVVVRKRRYGLPGEVAVHQMTGYSEGELYINGVDGDDRVMVIDDVVSTGGTLLAVLEALREMEVEVVDVVTVIDKGEGSRVVKERTGFTVRSLVKADVVDGRVTVEDIPDGG

SEQ ID NO: 7836 - protein, 550 aa, Streptomyces coelicolor A3(2)
MSDTPKLNQRPEWTALADHAKGTLPHPDLRELFAQDPGRAERYVVRVGDLRIDYSKHLVTDETLALLQELAAATGVSGLRDAMFRGERINITEDRAVLHTALRAPRDAVIEVDGENVVPQVHAVLDKMAGFADRVRSGEWTGHTGRRIRNVVNIGIGGSDLGPAMAYEALRAFTDRSLTLRFVSNVDGADLHEAVRDLDPAETLFIIASKTFTTIETITNATSARSWLLDGLGGDEKAVAKHFVALSTNAEKVADFGIDTANMFEFWDWVGGRYSFDSAIGLSLMIAIGPDRFREMLDGFRIVDEHFRNAEAPANAPLLLGLLGVWYGDFLGAQSHAVLPYSHYLSKFTAYLQQLDMESNGKSVDREGNPVQWQTGPVVWGTPGTNGQHAYYQLIHQGTKLIPADFIGFARPVDELSEELKAQHDLLMANFFAQTQALAFGKTPDEVRAEGVPEELVPHKTFRGNHPTTTVLAAELTPSVLGQLIALYEHKVFVQGAIWNIDSFDQWGVELGKVLAKRVEPALTEGADVPGLDPSTAALVAAYRELKEVH

SEQ ID NO: 7837 - protein, 1392 aa, Aspergillus oryzae
MVFELTGILGKWLKPIQGHTSEDDARREGVGGHPGVLRCNKLSKLGDTELTDKVTAQSRRRQGDRAHEVHHGGLKIRGLIRNQAQVCRRHQLANPATWFSRKPPPCRAILQRLTGTIRQGEMLMVVGRPGSGCTTVLKALANIREEYLAMEGDVWYGSMDAGTAKQARANQVAFVGEDDIHFPTLSVSTTLKFALNTRRSTSDPDRAQHLQQDLQTVLELMGLAQAAHVRIGSDHIRGVSGGQRRRVSLAEALCTRASLFCFDNPTRGLDSSTAIRFLTTMRKYTTRSQCMTAMSLYQASDLAVAMFDKVLVLNDGHVAYYGPATSAKAYFESLGFYRSPKISVSDFLASMSGTPECRTPREALDRPVPIHPADFETRFRESSLYQQTVSDAATPPQSKTVGKPKASGYALPLYRQVYECTVRHYQIFLTDRAAWIAEAAGTIVQALLLGTLFRNQRDVTQGLYTRGSALFFCVLIMGLQASAEFGNTFVQRPILLKQKALRFYRPGAYALGQILADIPWKFIFIMYSLPIYWMINFQRTAGHFFTWLVCLYMGLMALSVMFRAIAVFTNSITRAILPVGLLLNVFIIYTGFYITPPGMKVWLFWIRYLDPMYYIFESVALNEIGTSSYQCSSGDIVPRGSAYNETSYQACAVSGSVAGELSLSGRLYLMAEYGFKNTHLWRNVGINAGFFVFFSVVVMIGMERFRNAAEHMSTIFYRRLPSWVSASASRSADIEEPPIVAETKDSKPSSNHDVKAIGRLETTQSVFAWQELSLQLGDDKRLLHEVSGWLQPGKMTALMGMSGAGKTTLLDTLAQRIQIGRLSGGLYLNGQTLPASMGRRTGFVHQNDIHLASSTVREALQLSACLRRPATVSWDEKMDHVEMLIQLLEMEDIAEAIIGVPGAGLNLEQRKRVSIGVELAAKPDIVLFLDEPTSGLDGNSALSIVQLMRRLSDAGQTILCTIHQPSAQMIEQFDNLLLLVPGGKTVYFGPLGSRCQKILDYFARYTRRCEETENPADYLLAVSAEPDKDWFQTWRQSPEYGSTQEQLQKMLQVQEVKDSSSSESDRTYAASYLNQLRVVTQRAFTNYWRDSDYVLGKIQLNIWMGLMNGLTFLQLSNDLTGARGRMFSIFVGVITGPVLSLQIEPRFILLRDQFLARENESRVYHWSIFTISALLVEIPFTLLGGLIYWLLWYYMVGYLTISTRAGYAFLMYELYSLFVASLAQLTASLFPTVLAAQVATGFIWLVVNTFNGPLSPPPLTPRGWRWFYNISPLFYFIEGIGTNAMHALQITCRDSELTTFQTPAGETCASYTAEFFGLANSTGYLVDPNATGLCEYCAYADGDEYVKQYDMSYSQRGNNVGIFIGFILFNYTMAVLATYLIFIFKWRKRRSN

SEQ ID NO: 7838 - protein, 116 aa, Magnetococcus sp. MC-1
MNQVQAFEQSMIPETAVPKFGAGDTLKVHVKVVEGTRERIQVFEGVCIGRMNAGLRSTFTVRKISFGEGVERTFPVYSPRVDKIEVIRHGDVRRAKLYYLRGRTGKASRIKEKRDW

SEQ ID NO: 7839 - protein, 423 aa, Silicibacter pomeroyi DSS-3
MADSATQARQSAIDLLDQILGEGRLLSECLGAGALDRLPPEERARAQRLTLDTLRGLERADRLLKPHLQKAPPLSVRNALRLGTVELAHGEAAHGVVHSMVEIVGRSRRHGRLKGLVNAVLRKVAADAPSAWGRLRVPRLPRWLRDPLVQAWGAPAVAAMEAAHFVGAPLDLTLKSGASAPGGEVLPTGSVRLHDAGQVSALPGFAAGDWWVQDAAAALPVQLLDPQPGESVLDLCAAPGGKTMQLAAAGARVTALDISEGRMARVRENLARTGLSAETVVGDALEQGGQYDAVLLDAPCSATGTIRRHPDLPLAKDGSEFGALIELQAQMIAHAWTLVRPGGRMVFCTCSLLPDEGEVQVEEALTLYPDMSTDRAALGLPGIDPAWITEEGGLRLRPDYWSERGGMDGFYMAVLRKAADGPE

SEQ ID NO: 7840 - protein, 197 aa, Synechococcus sp. RS9916
MTSTVQNFLSLLCGEYSNQQQALDNPPFFAHIFLRYRPLEHLQPGSILLEQSYAVNPSHPYRLRMIRAEEQSPGIIKLWNHSFREPSRFATASFDKKCRQTIRDSDLICLDQCHYQVQNKTDGYYGSIEPGCQCLVNRNGQETLLVSTFHLQEDTLKTLDRGHDPKTNERLWGSIAGEFRFRRTQSWEAKWDQDSPT

SEQ ID NO: 7841 - protein, 698 aa, Streptomyces coelicolor A3(2)
MSTQSSKQTVDGADRFEWTELDRRAVDTARILAADAVQKVGNGHPGTAMALAPAAYTIFQKVMRHDPADPEWTGRDRFVLSPGHTSLTLYTQLFLAGYEVELDDLKAFRTHGSRTPGHPEYGHTAGVETTTGPLGQGVANAVGMAMAARYERGLFDPEAPEGESPFDHTIWAIVSDGDLQEGVSAEASSLAGHQKLGNLVFLYDDNHISIEGDTVTAFSEDVLKRYEAYGWHTQRVEPAESGDVDVRALHAAMTAAKAETGRPSIIAMRTIIAWPAPNAQNTEASHGSALGADEIAATKRVLGFDPERSFEVADEVLAHTRRALDRGAEAHAAWDKRIAAWRDAAPERAALFDRVVAGRLPEGWENALPVFETGKAVATRAASGKVLQALGPVLPELWGGSADLAGSNNTTIDKTSSFLPGGNPLPGADPYGRTVHFGIREFSMAAEMNGIALHGNTRIYGGTFLVFSDYMRNAVRMSALMQLPVTYVWTHDSIGLGEDGPTHQPVEHLASLRAIPGLNVVRPADANETATVWAEILRRHSTHPAPHGLALTRQGVPTYAPNPDAARGGYVLADASTGAPDVVLIATGSEVQLAMAARETLEAEGTATRVVSMPSVEWFEEQPRAYRESVLPPSVRARVAVEAGIGLTWHRFVGDAGRIVSLEHFGASADAKTLFSEFGFTAGHVAAAARDSLAAARG

SEQ ID NO: 7842 - protein, 908 aa, Arabidopsis thaliana
MDTGGDEKRARRSEEDRLSNLPESLICQIMLNIPTKDVVKSSVLSKRWRNLWRYVPGLNVEYNQFLDYNAFVSFVDRFLALDRESCFQSFRLRYDCDEEERTISNVKRWINIVVDQKLKVLDVLDYTWGNEEVQIPPSVYTCESLVSLKLCNVILPNPKVISLPLVKVIELDIVKFSNALVLEKIISSCSALESLIISRSSVDDINVLRVSSRSLLSFKHIGNCSDGWDELEVAIDAPKLEYLNISDHSTAKFKMKNSGSLVEAKINIIFNMEELPHPNDRPKRKMIQDFLAEISSVKKLFISSHTLEVIHDLGCELPLFRNLSSLHIDFEDHTLKMLSTFLQSCPNVKSLVVEFKDSSKEDGDRVLSIPRCFFTTLEYVKIERPITGEARGMKVVSYILENSPILKKLNLCLNSSREKSESVILKELLTIPRLSTSCKVVVFEPRSCWFMDGAGEKRVRAKGSREVDWISNLPETLLCQVLFYLPTKDVVKSSVLSSRWRNLWKYVPGFNLSYCDFHVRNTFSYDHNTFLRFVDSFMGFNSQSCLQSFSVRYDSSGYGEPKLALIRRWINGVVSRKVKYLGVLDDSCDNYEFEMPPTLYTCETLVYLTLDGLSLASPKFVSLPSLKELHLSIVKFADHMALETLISQCPVLENLNINRSFCDDFEFTCVRSQSLLSFTHVADTDEMLNEDLVVAIDAPKLKYLRLSDHRIASFILNDLASLVEADIDTVFNLICKKMFNPNDLNKRNMIRDFLVGISSIKTLIIASSTLEVIYDYSRCEPLPLFRNLSSLRVDFYGYKWEMLPIFLESCPNLKSLVVGSANYREKEGINILSVPRGFLSSLEYVKIERPLKGEAMEMKLVSYLLENSTILKKLTLCLDDSIKKEESVILKELNTIPRLSSACQVVIL

SEQ ID NO: 7843 - protein, 143 aa, Triticum aestivum
  misc_feature (110)..(110): Xaa can be any naturally occurring amino acid
  misc_feature (121)..(121): Xaa can be any naturally occurring amino acid
  misc_feature (130)..(130): Xaa can be any naturally occurring amino acid
PLQAQIQPIPTLPSTRPQATPNPRSSTDELAGERATEMEAAAAAAGVELGSSKPQIATQAEMAEARVPLAYRDQCAHLLIPLNKCRVAEFYLPWKCEPERHAYEKCQYEXVMERMLQMQKXREAQETKSXAALNWLIPARQVA

SEQ ID NO: 7844 - protein, 378 aa, Magnetococcus sp. MC-1
MSKDLYEILGVSKGANDAEIKAAYRKLAMKLHPDRNPGNDAAEAQFKEVNAAYEVLKDPQKRTIYDQYGHAGLGQGGPGGPGGFGGQGGAGFGDIFEEFFGDIFGGGRQTRGGGRSGARQGEDYRYDLRVTLEEVARGVEKRVRIPSMSTCDTCHGSGARSGSKPTTCTTCGGAGQIRTQQGFFQVQRACHVCHGKGQIISDPCPDCGGAGRQKKEKTLTVKIPPGVDTGTRIRLSGEGGAGIQGGPAGDLYIITEVEPHSMFERYGVDLLCVVPITFPQAALGAKLEVPTLNGKARITLPAGSQTGKRLVLRSKGLPHLNRPGMLGDLVVEVRVETPVKLTTKQKELLEEFDRCGDPDSQPDSVGFFDKVKEFLGGN

SEQ ID NO: 7845 - protein, 242 aa, Candidatus Protochlamydia amoebophila UWE25
MGIQMNIYRLITLFIFTFALPGLSAEATNPQYTLAEDNQHKNQDDEDDEDWYDDDEDDDNQYQAHSPTPKEESQINTPKTSQVYPKITETTHPTLTQQKPTFASEQTLSIIKPDAVQNNYIGEIISRFEQAGLKIAAIKMTTLTKDQASKFYAIHKDRPFYNDLVNFMSSGPVVVMVLEGNQAIAKNRELMGATDPKKAEKGTLRADFAESMSRNAVHGSDSSETAEEEVLFFFKPDEITHR

SEQ ID NO: 7846 - protein, 479 aa, Silicibacter pomeroyi DSS-3
MIEKRDFYINGAWVAPAVSNDFQVINPSTEEPCAVISLGSEADTNAAVAAAKAALPGWMATPVAERIALVEKLIEIYHTRGEDLAQAMSLEMGAPIDMSRSQQVGAGTWHLKNFIRAAKAFQFERPLGDHAPNDRIIYEAVGVAALITPWNWPMNQVTLKVGAAAIAGCTMVLKPSEQSPLNAMIFAEMMDEAGFPPGVFNLVNGDGAGVGSQLSTHPDIDMVSFTGSTRAGTAISKAAADTLKKVHLELGGKGANVIFADADDKAVKRGVLHMMNNTGQSCNAPSRMLVQRPIYDQAVETAAEVASKVTVGNALDEGRHIGPVVNELQWSKIQDLIQKGIDEGARLVAGGTGRPEGLNKGYYVRPTVFADANNQMTIAREEIFGPVLTMIPFDTEEEAIEIANDTPYGLTNYVQTQDATRANRMARALRSGMVEMNGQSRSAGSPFGGMKQSGNGREGGVWGLEDFLEVKAVGGWAAE

SEQ ID NO: 7847 - protein, 659 aa, Neisseria meningitidis Z2491
MSQLANAIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQAAIEAARAETGKPSIICCKTLIGKGSANKEGSHKTHGAPLGADEIEATRKHLGWTYPAFEIPQEIYDAWNAKEQGAKLEAEWNELFAQYQTKYPAEAAEFVRRMDKKLPDNFDEYVQAALKEVCAKAETIATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAVKAADHPSCLIFSRQNLKFQARSEQQLNDIKRGGYVISEAQGNAQAVIIATGSEVELALEAQKALAAQNIAVHVVSMPSTNVFDRQDTAYQAAVLPESLPRIAVEAGHADGWYKYVGLNGAVVGINRFGESAPADLLFKAFGFTVDNVVDTVKSVL

SEQ ID NO: 7848 - protein, 143 aa, Candidatus Protochlamydia amoebophila UWE25
MTLERTLSIIKPDAVGNNHIGEIIARFEKAGLRIVAAKMKQLDRKDAEGFYAVHKGRPFFEDLVGFMTTGPVMIMVLEGENAINKNREIMGATDPKKAAPGTIRADFAQTIDENAVHGSDAAETAKTEIEYFFKSQDVCARKR

SEQ ID NO: 7849 - protein, 498 aa, Schizosaccharomyces pombe 972h-
MSTSSKLSTNIKDLSLFDLEEFPARSYIGGKWVTAASGKTFDVENPGLNETLAPVTDMSVEETRKAIKVAHEAFLSYRNSDIKERYAILRRWYDLIMENADDLATMMTLENGKALGDAKGEVVYAAKFIDWFAGEALRISGDSSMSSNPQNRIITIKQPVGVVGIITPWNFPAAMITRKVGAALAAGCTVVIRPAAETPFTALALAKLAERAGVPAGVLNMVTANSPSEHGIELTTNPLIRKVSFTGSTNVGKILAKQSSSTLKKLSLELGGNAPFIVFEDADLEKAADALMACKFRGSGQTCVCANRIYVHSSVYDAFVDLVTERVSKFKLGYGLDAGVTHGPLISEKAISKVKQHVEDAVQKGGVVVTGGKVASNLGPMYFEPTVIINAKQGMLISEEETFGPVGALFKFDTEDEVVAWANDSPVGLAGYLFSKDISRVFRVGEALQVGMVGCNTGLVSDVLSPFGGVKESGFGREGSKYGISEYLDIKSLTISTL

SEQ ID NO: 7850 - protein, 378 aa, Oryza sativa (indica cultivar-group)
MESGSEFYAGEGLQIDPKWLIDPKLLFVGPRIGEGAHAKVYEGKYKNQNVAIKIVHKGDTPEEMVKREGRFLREVTMLSRVQHKNLVKFIGACLEPVMVVVTELLVGGSLRKYLVGLRPRSLEPRVAVGFALDIARAMECLHAHAIIHRDLKPENLLLTADQRTVKLVDLGLAREETLTEMMTAETGTYRWMAPEVSVTAVHICQYNSFLSIFANPEIYPQLYSTVTLRHGEKKHYNHKVDVYSFAIVLWELLHNRLPFEGMSNLQAAYAAAFKNIRPSADNLPEELSEILTTCWKEEPNERPNFTQIVQMLLHYLSTLSPPEPLAPPRTFSSENAILPPESPGTSSLMASRGDLGDTPKGKMEDKPRGFFFCFSQCY

SEQ ID NO: 7851 - protein, 356 aa, Allium cepa
MPIESVIIAPPAPRVETLSKSNLHSIPLEYIRPEHERACLGDALEQLHNSNSGPQIPITDLDSRDCIEKVTKAAKEWGVMHIVNHGISSELMEKVRAAGKAFFNLPLEAKEEYANDQSKGKIQGYGSKLANNASGQLEWEDYFFHLIFPDDKVDLSVWPKQPSDYIEIMQEFGSQLRILASKMLSILSLGLQLPTKDRLEQELKGPEDLLLQLKINYYPKCPQPHLALGVEAHTDVSALSFILHNNVPGLQVLYEGEWVTAKLVPDSLIVHVGDSLEILSNGIYKSVLHRGLVNKEKVRISWAVFCEPPKDAVVLKPLDEVVTDDAPARYTPRTFAQHLERKLFKKKVGDLDDSDV

SEQ ID NO: 7852 - protein, 318 aa, Solanum lycopersicum
MAPEFESGTKMATTIQKSSCAYVTFLAGNGDYVKGVVGLAKGLIKAKSMYPLVVAILPDVPEEHRMILTRHGCIVKEIEPLAPSLQSLDKYARSYYVLNYSKLRIWEFVEYSKMVYLDGDMQVFENIDHLFELPDKYLYAVADCICDMYGEPCDEVLPWPKELGPRPSVYFNAGMFVFQPNPSVYVRLLNTLKVTPPTQFAEQDFLNMYFKDVYKPIPYTYNMLLAMLWRHPEKIEVNKAKAVHYCSPGAKPWKYTGKEEHMDREDIKMLVKKWWDIYNDTTLDHKAQGSTVEANRLRGAAFSDTNISALYITSPSAA

SEQ ID NO: 7853 - protein, 153 aa, Medicago truncatula
MGFTEKQEFLVNSSWESFKQNLPGYSVLFYTIILEKAPAAKGMFSFLKNTPEVKDSPQLQAHAEKVFQMVRDAAVQLRATGEVVLGYTKVGAIHIQRGVVDPHFVVVKEALLKTIKEASGDNWSEELNTAWEIAYDELAISIKKAVKLGMIYC

SEQ ID NO: 7854 - protein, 118 aa, Agrobacterium tumefaciens str. C58
MTGLTTHVLDAAHGVPAEGLTIELYRLSGDRREKLKTVKTNSDGRVDGGPLLVGDSFKAGEYELVFHAGDYLRGRGVQLAEPAFLDIIPIRFGIADESGHYHVPLLLSPYSYSTYRGS

SEQ ID NO: 7855 - protein, 334 aa, Xylella fastidiosa Temecula1
MSIEQLAETAQAMVASGKGIIAIDESAGTIAKRFSSVGIENIEENRRAYRELLLTTPKLSDYISGAILFDETIRQSTKAGVPFPKYMAEHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQFDPLPWPLSFSYGRAMQQAALKLWSQDMKGNFAKAQQVVYERAKENGLAALGKWKG

SEQ ID NO: 7856 - protein, 271 aa, Haemophilus influenzae 86-028NP
MINKDTQLCMSLSGRPSNFGTTFHNYLYDKLGLNFIYKAFTTQDIEHAIKGVRALGIRGCAVSMPFKETCMPFLDEIHPSAQAIESVNTIVNDNGFLRAYNTDYIAIVKLIEKYHLNKNAKVIVHGSGGMAKAVVAAFKNSGFEKLKIYARNVKTGQYLAALYGYAYINSLENQQADILVNVTPIGMKGGKEEMDLAFPKAFIDNASVAFDVVAMPVETPFIRYAQARGKQTISGAEVIVLQAVEQFELYTHQRPSDELIAEAAAFARTKF

SEQ ID NO: 7857 - protein, 147 aa, Medicago truncatula
MGFTEKQESLVNSSWESFKQNLSGYSVLFYTIILEKAPAAKGMFSFLKDTTGVQDSPQLQAHAAKVFEMVRDSAVQLRATGEVILGDATLGAIHIQKGVVDPHFVVVKEALLKTIKEAAGGNWSEELSTAWEVAYDGLAASIKKSMS

SEQ ID NO: 7858 - protein, 391 aa, Xylella fastidiosa Temecula1
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYPIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 7859 - protein, 269 aa, Leuconostoc mesenteroides subsp. mesenteroides ATCC 8293
MSQHNASRIPFVVANWKINKLHADVAEFLDKVNGKVPAENVVETGIAAQDLFLSDMVRATAQSPIHIVAENVHWEDSGAYTGETSPKALKDIGAKYVLIGHFERRKFFNETDSTVNLKVTAALRNGLRPIIDVDEDMSTYAQFMDAEPSVAQVAAALAGVSVDQIRNVTLAYEPTWAIGSGEAASAVQAQKAAHLIRQTLAKLYSPVIAEQVRVLYGGSVTPDNAREIMLQKDIDGVLVGTSALDPEKFLQLVAIAQDPEVPEFNIENT

SEQ ID NO: 7860 - protein, 579 aa, Oryza sativa (japonica cultivar-group)
MGEVATTTLLLTSHEAKPAKAPSIHDAIEVYIGATGARQLLKAMLLAFAWAFDAQQVFMSVFTDAEPPWHCTGVVDAVEAAAGDSGSSCSSPATSASPCALPLGTWEWDRLAKTSVVSDWALNCSGGGPALVSLPASSFFTGNLVVVLPYSLISATTTPLLTSHEAEPSIDDVIEAYIGATGARQLLKAMLLAFAWAFDAQQVFMSVFTDAEPPWHCTGVVDAAAAAAADSGSSCSPPAASASPKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDALSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELV

SEQ ID NO: 7861 - protein, 298 aa, Brassica napus
  misc_feature (12)..(12): Xaa can be any naturally occurring amino acid
  misc_feature (14)..(14): Xaa can be any naturally occurring amino acid
  misc_feature (19)..(20): Xaa can be any naturally occurring amino acid
  misc_feature (25)..(27): Xaa can be any naturally occurring amino acid
  misc_feature (29)..(29): Xaa can be any naturally occurring amino acid
  misc_feature (36)..(37): Xaa can be any naturally occurring amino acid
  misc_feature (47)..(47): Xaa can be any naturally occurring amino acid
  misc_feature (52)..(52): Xaa can be any naturally occurring amino acid
  misc_feature (221)..(221): Xaa can be any naturally occurring amino acid
  misc_feature (255)..(255): Xaa can be any naturally occurring amino acid
  misc_feature (284)..(284): Xaa can be any naturally occurring amino acid
  misc_feature (286)..(286): Xaa can be any naturally occurring amino acid
YPGNVCLTHDEXTXFKYKXXQYMFXXXRXVSPFEWXXFSITSAPGDXYVSVXIRTLGDWTRKLKTVFSEVCKPPTAGKSGLLRADGGDSIAFPKILIDGPYGAPAQDYKKYDVVLLVGLGIGATPMISILKDIINNMKSRDRDSDIENNSSNGNSKGFRTRKAYFYWVTREQGSFEWFKGIMDEVSELDDEGIIELHNYCTSVYEEGDARVALIAMLQSLXHAKNGVDVVSGTRVKSHFAKPNWRQVYKRIAVQXIPHKRIGVFYCGAPGLTKDLKNLALDFSXKXTSTKFDFHKENF

SEQ ID NO: 7862 - protein, 184 aa, Borrelia garinii PBi
MVVGIILANGFEDIEAIIPIDILRRGNVNIQVISLNDNNVVTSSKGVSFLTDDVILNCKENYFDLIILPGGMPGATNLFNSKELDLILKDMNSRGKFIAAICASPAVVLAAKGLLGSNKFTCYPGLEKSVLDGEFVDKNVVISNNFITSKGVGTSFEFAFTLLEMVKGRQIMENVKKATLLCDS

SEQ ID NO: 7863 - protein, 601 aa, Prochlorococcus marinus str. NATL2A
MNFDEKESTNIEEIEQTVPSPCIANNSPRAKFEQFKADSNYLSEPLHSELLNDSDHFTNDAVQLLKFHGSYQQDDREHRKRGGTGKDWQMMLRLRNPAGYVPGPLFVALDELSDRLGNQTLRATTRQCFQMHGIKKGNIKEVIGTIVKSMGSTLAACGDVNRNVMAPAAPYEQGSYPAARKLANDIADVLSPQKAEKTYIDLWVDGEMKYAIKPSSEVKKNKKLQLKPGVFSGDKKEPLYGATYLPRKFKCATTVPGDNSVDILTHDIGLVTFTNKKGVLEGCNVYVGGGMGRTHNLDTTFARIADPIGYVEGEHILELVQSILALQRDYGDRKTRRHSRLKYVLHDMGVDWFKKQLTTKYFTRQIENLKHEGDTILEDYLGWHQQSEKLWFVGLPLLSGRLTGRVKKELRNIVEKFALDVRLTPNQDLLLCNIGNYQKASVKRALINIGFINPGAPDSLARNAMACPALPLCGLAMTEAERFLPELLERINNQLKILEINKPILIRVTGCPNGCARPYMAELALVGSGLNQYQLWLGGSTNLKRLATPYLQKMPIDDLEKTLEPLFLSWKDTGASSSLGDHVTKLGSESVMSLLTSSAAP

SEQ ID NO: 7864 - protein, 140 aa, Emericella nidulans
MARTKQTARKSSKSTGGKAPRKQLASKAARKAAPSTGGVKKPHRYKPGGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 7865 - protein, 810 aa, Frankia sp. EAN1pec
MSERRWIAWFKEIGADDVDQAGGKGANLGELTRAGLPVPPGFVITVSAYLDVVDAAWMRSEIAARASDIDPDDHAQLEQVAGELRAHIVAAPVPESLGRAISEAYRELGGGSVAVRSSATAEDAAGTSFAGMNSTFTNVSGETELLARVRECWASLYGPRAVAYRASRHMVAEPETAVVVQRMVDAERSGVMFSVDPITGDRSRIVIEAAFGLGEVVVGGEVIPDTYVVDKDGPRLVDVRTGAQTHQIIRGADGHDLLVDLLPTEGRHRILTEDEVLDLARLALRVEAHYGEPQDVEWAIEGHRTHLVQSRPVTTGGAAPVTTAPRPTRIESSERTGPSERTGRSEPSDTVLLTGLGGAPGRAAGRVRVLTSPGEGAAFATGEVLVAAMTSPDWVPVIRRAAAVVTDSGGVTCHAAIVARELGVPCVVGTSSATSTLRTGDTVVVDGSRGVVEKDADMWETPRALASPGRAMVKAIPSPAVAIEVAPVVPAGQAPNPVVPVAVEPTATRLYVNLAVADHVEQVAALPVAGVGLLRAELLLVDALGGTHPRHLLEQGGRAEFVERMAASVERITRAFAPRPVIYRATDFRTNEFRGLTGGDRFEPVEANPMIGYRGCFRYVRDPAVFDAELEVLAVVRERTPNLHLMIPFVRTGWELEACLKAVDASPLGDHRDMLRWVMAEVPSAAYWIPAYARLGIDGVSIGSNDLTQLVLGVDRDSETCAELFDEADPAVLDTIARIITACRENGLTSSLCGQAPSTRPDYAERLVELGITSVSVDPDAVGAAAWSIAAAERRILLDAARTGMASGRG

SEQ ID NO: 7866 - protein, 441 aa, Leuconostoc mesenteroides subsp. mesenteroides ATCC 8293 [sequence omitted]

SEQ ID NO: 7867 - protein, 408 aa, Pseudomonas sp. Cam-1
  misc_feature (36)..(36): Xaa can be any naturally occurring amino acid
  misc_feature (51)..(51): Xaa can be any naturally occurring amino acid
  misc_feature (104)..(104): Xaa can be any naturally occurring amino acid
  misc_feature (119)..(119): Xaa can be any naturally occurring amino acid
MIDTIAIIGAGLAGSTAARALRAQGYEGRIHLLGDXSHQAYDRTTLSKTVXAGEQPEPPAILDSAWYASAHVDVQLGRRVSCLDLANRQIQFESGAPLAYDRLXLATGARARRMAIRGXDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRVPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 7868 - protein, 614 aa, Xylella fastidiosa Temecula1
MSFSKHFGKLMLATCLSLSAAPAFSYSISHGKVVDDKGNQIQLRGVNWFGFETGDHVVNGLWARNWKEFITQLQGMGFNAIRLPFCPANLNSNTSPSSIDYSRNPDLQGLSSLQILDKVVKELSDRRMYVLLDHHRPDCSAISELWYTDSYSEKQWIDDLRFVAHRYANVHGVIGLEVKNEPHGRTTWGTGDPKTDWNTAVEHAAAAILEAAPKWLIGVEGIGENPICSSTIGHFWGENLEPMDCTPLKVPADHLLLMPHVYGPDVYVQPYFNSPDFPNNMAAIWDKHFGHFAKAGYAMAIGEFGGKYGEGDPRDIAWQNAFVDYLISIGVTDAFYWAANQNSVDTGGMVGNDWTTPRDDKVKLLNKLWNAGGGASGGSGGGAGASSGSGAGGGSSGGAGTGSGSGAGGGSSGGAGTGSGSGAGGGSSGGAGASSGSGAGGGSSGGAGTGSGSGAGGGSSGGAGASSGSGAGGGSSGGAGASSGSGAGGGSSGGAGAGSGSGARGGSSGGAGAGSGSGAGGGSGSGSDPTKSKIAVNTIVDSDWHTGYCERIQVTNTSDSPNTWTVTIPIKGKIQTLWSARWSVKDNALTAFGMDWNKTLDPKGRTEFGFCSNY

SEQ ID NO: 7869 - protein, 375 aa, Mycobacterium sp. MCS
MPPSLPASAPPVRGKDPAPRGKNRTRDAVVNAATRMTLRTLPVLPDRVKRALLGFRSVTVDGNTLDTTLQLLLAAQRAAGINGLVASDDVVVARRQLRLTAAMFPADIVADMTELSIPGPAGAIPARLYRPTSPDPDGPLLVFYHGGGFVIGDLDTHDDLCRVICRDGGITVLSPDYRLAPEHKAPAAADDAYAAFRWASEHAAELGVAADRIAVGGDSAGGNLAAVVCQRARNAAAPLPALQLLIYPVVDVGSETRSKTLFADGYFLTARDIAWFMDLYLEGASVDRTDPDVSPLLADDLSGLPPALVLTGGFDPLRDEGNRYAEALRAAGVPVDLREERSLIHAFANFFPLGGDSATATAAMISALRAHLSRG

SEQ ID NO: 7870 - protein, 502 aa, Agrobacterium tumefaciens str. C58
MSLFWRPERQYILTSFNELGLSEKIVASVTQLGYTTPTPIQAKAIPLLLEGRDLIGLAQTGTGKTAAFGLPIIEMLMKQADRPANRTTRTLILAPTRELVNQIGDNLRSFVKKTPLRINQVVGGASINKQQLQLEKGTDILVATPGRLLDLIARNAISLSKVTYLVLDEADQMLDLGFIHDLRKISRMVPPKRQTLLFSATMPKAISELASNFLTDPIKVEVTPPGKAADKVEQYVHFVAGKNDKTDLLKKSLNENPDGRSIVFLRTKHGAEKLYKHLEHIGFKVASIHGNKSQGQRERALKGFKDGEIKVLVATDVAARGIDIPAVTHVFNYDLPEVPDAYVHRIGRTARAGRDGIAIAFCAPDETRLLHDIEKLMKIDIPVASGERPAGLASPTRPNNNRGGRNNNGGQPRGPREGGRHNGESRPSRNHAPRDADNDLEVTSDFKRVKQAEGDAGRPAGPRKQRRPARKPGGSGANRHAPAGGNGQEKRASGNGNRGRNR

SEQ ID NO: 7871 - protein, 182 aa, Streptomyces galbus
MTELANIPELLASRIRDVADYPEPGVMFKDITPLLADPVAFTALTDTLAAGRRRHPRTKVVGLEARGFILGAPVAVRAGLGFIPVRKAGKLPGATLSQAYDLEYGSAEIEVHAEDLAAGDRVLIVDDVLATGGTAEAAIQLIRRAGAEVCGLAVLMELGFLGGRARLEPILDGAPLEALLQV

SEQ ID NO: 7872 - protein, 868 aa, marine gamma proteobacterium HTCC2143
MAKRVYLFNEGGKDDRELLGGKGANLCEMTTLGLPVPFGFIITTPTCREFFEAGNQLPSLLEQEYRVALDLVEKKMGARFGDPENPLLFSVRSGASVSMPGMMNTILNLGLNDEIAEGLAKKTDNARFAYDSYRRFIQMFADVVLGVDGKLFEHEIEKYKAAHNKVLDVDMTAEDWQSIIVIYKTLANFPQDPFVQLKLAVEAVFLSWYTPRANVYREMNNIPDTLGTAVSVQAMVFGNFGDDSGSGVAFTRNPSTGEHAFFGEYLFNAAGEDVVAGTRTPLPVEALNERMPEVYKELYATQALLEKHYRDMQDMEFTVQQGKFYMLQTRSGKRTGRASIKIAVDMVNEGLITESEALMRVSPEHVEAFLHPMVDPAAKTSIVANGLPASPGGATGSVVFSAEEAVEVARDGTAVVLVRRETTPEDIHGMKVAEGILTELGGMTSHAAVVARGMGVCAITGCGSLTINYQQGTAVTAEGVVIKRGDIITLDGTAGEVMLGDIPKTEASSSDDFQILLSWADKHRKLKVRANAETPEDAAKARELGAEGIGLCRTEHMFFAADRIDKMRGMILSETKEERLKYLDMLFEFQRDDILELFKVMDGLPVTVRLLDPPLHEFLPHTPEEMSALAKRIGKPVETIKAMTENLHEVNPMLGFRGCRLSVVYPEITEMQVRAIISAAVDATEQGYRPFPEIMIPLVVNVREIRMLNEIIDKGIQEVLKEKAISIPYKVGTMMETPRACLGADRLAGEVEFMSFGTNDLTQMTYGFSRDDVGKFLPQYLDKKLVESDPFVSLDQRAVGKLMEMAVTESRGRKKGIKYGICGEHGGDPRSIQFCHDLGLDYVSCSPFRVPVARIAAAQANVGGALSD

SEQ ID NO: 7873 - protein, 375 aa, Glycine max
MAVLTPVSSCFGAKYQALAPLRILRGLVCLLVLLSTAFMMLVFFGFISAVVVRVFSVSYSRRATSFIFGAWLALWPFLFEKINKTKVVFSGDIVPSRERILLIANHRTEVDWMYLWDLALRKGCLGYIKYILKSSLMRLPVFGWAFHILEFIPVKRKWEADESIMRHMLSTFKDPQDPLWLALFPEGTDFTEQKCLRSQKYAAEHKLPVLKNVLLPRTKGFCACLQELRSSLTAVYDVTIGYKYRCPSFLDNVFGVDPSEVHIHIHRFPLDSIPVSEDEICMWLINRFQTKDQLLSNFQTQGQFPDQASERDLSAVTSILNCMTIVTVTGTMMYYSFASFWFKLYVSLVCAYLVPATYFNTRPQPILSFLKMRAR

SEQ ID NO: 7874 - protein, 410 aa, marine gamma proteobacterium HTCC2143
MKMPDKGSSWDNLAAEMINRGSGDAKWREGKTAVYVFNAGEDVARVQKEAYALYMSENGLGPTAFPSLRKMEAEVIDMGLGLLHGSELSDGSITSGGTDSITMAVKAARDYARNALGKTGLFNIVAPYSAHPAFDKAAIMMDLELRRIPVGDDLLADCAAMSTAIDDQTIMLVGSAPNFPYGLIDPITELGEIAEAKNVWLHVDACVGGYIAPFVRMNGVDIPDFDFSVPGVSSMSADLHKYGFCAKGASTVLFKTAELKKHMIFDCRDWPGGRMLTPTLAGTRPGGAISAAWAVMNYLGIEGYKNKHQQVTDARKAIELGVRELGFTILGTPLLGIIAFQHPDVDVFAIYKQMYDRGWVTSLTTQPKALHLMLSPFHKTVTNLYLSDLTESIEQVKSGDKRAVKEAKYN

SEQ ID NO: 7875 - protein, 559 aa, Chlorobium tepidum TLS
MYLSRSAEWSALESHYQDISHQAMIDLFSTDPNRHERFSLSFNAIHLDYSKNRISARTMELLMDLVRRSGIEKKRRQMFEGEQINFTEHRSVLHTALRRPPGYTMTIDGNDVASEVSDVLDQMKAFCKKVISGEWKGYTGKRITDVVNIGIGGSDLGPFMVTEALKPFAHGKLKVHFVSNVDGSHLVETLRGLNPETTLFIIASKTFTTQETLANAVSARAWFLVKAGNRDHVAKHFVAVSTNREKVEEFGIDPDNMFRFWDWVGGRYSLWSAIGLSIALYLGFDRFRELLAGAHAMDEHFLNAPLEENMPMILAMLGIWYNNFFGAHSQAIIPYDQYLHRFPAYLQQLDMESNGKRVDRAGHEVDYATGPVIWGEPGTNAQHAFFQLLHQGTEIVPVDFIVSLKSQNPVGEHHDMLVANCFAQSEALMKGKSEAEARAELEAAGLSGGDLEKLLPHKLFPGNRPTNTIVLDELNPFNLGSLIALYEHKVFVQGVVWNINSFDQWGVELGKQLAKAILPEFDAVDPVETHDASTNALINRYRQFRNGLKFPKSNQLKMF

SEQ ID NO: 7876 - protein, 358 aa, Wolinella succinogenes
MKKYEIAIIKGDGIGPEIVDEAKKVLDAISYSHGFELSYHDYLMGGIAVDRAGVPLPDETIEGCLRADAVLFGAIGGEKWDSLPRELRPESGLLKLRKSLEIFANLRPTVVYDELIEASTLKESVIKGVDILVVRELIGGIYFGEPKGREGDKAFNTMVYSVPEIERIAHVAFKAAMRRQKRVCSVDKANVLDVSQLWRETVTRIAKEYPEVELSHMYIDNAAMQLIRNPKQFDVILTGNLFGDILSDEASMLSGSIGLLPSASIGGKAALYEPIHGSAPDIAGQGIANPIATIASASMMLRHSLGEVEAADAIDKAIVKTLKEGYRTKDIAAFGAKEICTTDEMGSIIANYAAKKGE

SEQ ID NO: 7877 - protein, 384 aa, Oryza sativa (indica cultivar-group)
MEEVVVLIIGAGPAGLATAAYLTLQHVAYAIIERESCTASLWRHRTYDRLKLHLAKEFCELPHMAYPSGTPTYVPRESFVEYLDSYTDRFGIQPRYDTSVESATYDQGKKHWAVLAQDTDTGVVARLTARFLIMATGEKSAASIPLVPGLAGFEGEAIHSSAYKSGNGYTGKSVLVVGAGNSGMEIAYDLATHGAHTSIVVRSPVHIMTKELIRFGMTMVQNLGLSVTIVDPLLVMAAKLIFWDLSKHGIMRPKMGPLLLKSQTGKSAVIDVGTAKLITRGVIDVLEGILKINANNVEFHCGRQIPFDAIVFATGYKSTVNTWLKNGESMFRNDGFPKKKFPNHWRGENGLYCAGFARRGLVSIAMDAKNIVDDIRATMYQVSC

SEQ ID NO: 7878 - protein, 197 aa, Bradyrhizobium japonicum USDA 110
MRTATIKRKTKETDIEVTVNLDGTGVSNIATGIGFFDHMLDLLARHSRIDLTVKAVGDLHIDHHHTTEDTGIALGQAVKQALGTMAGITRYAGVHMPMDETLSRVVIDISGRPVLVFKVDFPRDKIGEFDTELVREWFQAFAMNASVTLHVETLYGDNSHHIAESCFKGLARALRAAVAIDPKAAGEIPSTKGSLGG

SEQ ID NO: 7879 - protein, 431 aa, Prochlorococcus marinus str. NATL2A
MKRVLAIILGGGKGSRLYPLTKMRAKPAVPLAGKYRLIDIPISNCINSDISKMYVLTQFNSASLNRHIAQTYNLSGPFGQGFVEVLAAQQTPETPSWFEGTADAVRKYQWLFQEWDVDEYLILSGDQLYRMDYSLFVEQHRNTGADLTVAALPVDPAQAEAFGLMRTDEIGNIKEFREKPTGDSLKAMAVDTSRFGLEANEAKEKPYLASMGIYVFSRSTLFDLLNKFPSYTDFGKEIIPEALGRGDKLKSYVFNDYWEDIGTIGAFFESNLALTQQPTPPFSFYDEKFPIYTRPRYLPPSKIVDTQITDSIVSEGSILKSCSIHHCVLGVRSRIESDVVLNETLVMGSDFYESYEERIALRNGGGIPLGVGQGTTVKRAILDKNARIGDNVTIVNKDNVEEADRADQGFYIRNGIVVIVKNATIPDGTII

SEQ ID NO: 7880 - protein, 103 aa, Zea mays
VTCLKMMRNKDAKLKDLEISTVDGFQGREKEAIIISMVRSNSKKEVGFLSDHRRMNVAVTRARRQCCLVCDVETVSSDRFLKRLVEYFEENGEYLSASEYQSS

SEQ ID NO: 7881 - protein, 421 aa, Neisseria meningitidis Z2491
MSEALAKETLNPFEIARKQVKTACDRLKTDPAVYEILESPTRVLEVNFPVKLDDDTVKTFTGYRSQHNNAVGPYKGGVRFHPGVNLDEVKALSIWMTIKCCVAGIPYGGGKGGITLDPRDYSEAELERIARAYSEAISPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 7882 - protein, 235 aa, Neisseria meningitidis Z2491
MNAAIEHVQAVAFDLDGTLCDSVPDLAAAAEAMLEQLGMKPLPAKVVESYVGDGIGKLVHRVLTNDRDREADSELWEKGFVSYMKYYRDHLSVFTRPYPETEAGLALLKSLGIPLAVITNKNEILAAELLKQLGLADYFSLILGGDSLPEKKPSPLPLRHAAEVLGIDVANMVMVGDSRNDIIAAKAAGCLSVGVTFGYGDMTLLSQDDATRPDWIIGSLPEIYENLQPQKNKEE

SEQ ID NO: 7883 - protein, 460 aa, Candidatus Protochlamydia amoebophila UWE25
MNKLLNLLQPAPHIPELKDQELVKDQYKYWRIRILYSMFIGYAFYYFTRKSFTFAMPGLIQDLGFDKSQLGILGSILSITYGVSKFASGIIGDRTNSRYMMAIGLMLTGICNICFGLSSSIFFFALFWGLNGWFQGFGWPPCARFLTQWYSHSERGSWWSTWNVSHNVGGFLIPWIAGITLQYFGWRYAMYIPGILCILISFFLINRLRDTPQSLGLPPIEKYRNDYVDKAEADKEAEQLTTKQLLVNFVLKNSYIWILALAYFFVYAVRTGINDWTALFLVESKGYSSIGANGCVSLFEVGGFFGSLAAGWSSDKLFGAKRGPINVLFTLGMFAFIAIFWMIPSGYLLFDSVLMFCIGFSIFGPQMMIGLAAAELSHKKAVATSTGFVGFFAYIGAAFAGYPLGYITQQWGWQGFYWALMGCCIIALFLLIPLWSVSATTLKPKNKSSSPVSSPALASK

SEQ ID NO: 7884 - protein, 198 aa, Synechococcus sp. RS9916
MIRFAKTMAGIFDNFAQSQANPKEFARINIVFRPLPRDIFNGPGFYSEQYYDHSPWDPYRQGIHRLTIKEKTYVMENFGFPNKERLAGAGRVPELLESIKKENLEPRCGCAMHFVESRPGHYTGNVEPGKKCIVPRDGKLTYLVSEVEVNEETWISRDRGFDPETDEPKWGSEHGPLRFARIKSFSELITEEWASRDP

SEQ ID NO: 7885 - protein, 546 aa, Oryza sativa (indica cultivar-group)
MAIASMAAAAAAAIVGAVREHVRASDLAVAGAVLFAFSAAVSAVRARRRGAPVLWPLVGIVPTLFVHRDDIYEWGSAALLRAGGVFPYRGTWGGGSSGVITSAPANVEHVLRANFGNYPKGPYYRERFVELLGGGIFNADGEAWRAQRRAATAEMHSSRFVEFSVRSIEQLVYGRLVPLAERLSGGGAAVDLQEVLLRFTFDNICAVAFGVDAGCLADGLPDVPFARAFELATELSLLRFVTPPFIWKAKRLLRAGSERRLVEATRAVREFAERAVADRRNEMRKVGSLRGRCDLLSRLMSSAPGADYSNEFLRDFCISFILAGRDTSSVGLAWFFWLLAGHPDVESRVVGDVLAAGGDIKRMDYLHAALTEAMRLYPPVPVDFKEALADDVLPDGTPVRARQRVIYYTYAIGRDPASWGDDAAAFRPERWMRGGAFAGGESPFKYAVFNAGPRLCIGKRFAYTQMKTAAAAVLSRFAVEVVPGQEVKPKLTTTLYMKNGLMVRFRRRSPPPPSPPPRHVVADDDDDDDVAAGRHVAVGSCNSNHL

SEQ ID NO: 7886 - protein, 176 aa, Triticum aestivum
  misc_feature (21)..(21): Xaa can be any naturally occurring amino acid
MSPTVMASSPTSVAPFQGLKXSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGSEESGKA

SEQ ID NO: 7887 - protein, 655 aa, Clostridium perfringens ATCC 13124
MRRKFNSKEFNDKYYYDGELGAIYNKEETIFRVWSPEAKSLELLLYRDGNKESLIERDLLHKKSNGLWELVKKGDLNGVYYKCHIVGEDFEHDFVDPYCKALGVNGYRAMVIDLKKTNPKGWENEKKPSLENPLDSILYEMHIRDFSIDKSSGVSLENRGKFLGIVEENTKVPGTEVKTTLDHLKELGITHVHLLPSFDFGTVDEERLDEEQYNWGYDPVNYNVPEGSYSKNPYKGEVRIKEFKEMVLKLHRAGIRVIMDVVYNHTYSGENSNLNLSYPGYYHRQDDFGNFSNGSGCGNELASERLMVRKYMVDSLKYWAKEYHIDGFRFDLMALHDIETLKEIREELNKIDPSILIYGEGWNGGDSPLPKEEACFKCNIGKFDKLQIAAFSDDMRDGIKGYVAHLKEGGFVNGGEDFEESIKFGIVASTYHEGVDYNKVNYSDSPWANEPYQTVNYCSAHDNNTLHDKLKIVCENASEEEIIEMNKLSAAIFLTSQGIPFIHSGEEFLRTKTNEKGEFIENSYNSNDFVNKIDWTRKVKYMDLFKYYKGLIELRKEYPLFRLESNKEIREKISFIESELGIKKKGIVAYRLKDHNNEFIVVFNSNNNEVKINLPKGLWGVMVNNKFSGKEIRDEARDFYDIIRKSACVLKKLSD

SEQ ID NO: 7888 - protein, 319 aa, Kluyveromyces lactis NRRL Y-1140
MSQPQEEKHNQKTAAHKVSKFGSFVAGGLAACIAVTVTNPFDCVKTRMQLQGELHANAAKVYTNPIQAFGVIFKNEGIAGLQKGLASAYLYQIALNGSRLGFYEPIRGILNNVFYPNVESHKVQHIGINVAAGATSGVVGAFIGSPLFLVKTRMQSYSNAIHIGQQTHYTSAFNGLATIFRSEGIKGLFRGVDAAMLRTGIGSAVQLPIYNICKNFLLKHDLMNDGTGLHLLSSTIAGFGVGVAMNPWDVVLTRVYNQKGNLYSGPIDCFIKTVRNEGLSALYKGFGAQILRIGPHTVLCLTFMEQTLKLVYSVESRFL

SEQ ID NO: 7889 - protein, 477 aa, Neisseria meningitidis Z2491
MNEYSQLIKHPDISLSPISDGIGVGNPATGEILAYVRNTGSDKLKNLIQKAAAAQKLWAAKTALERADILWRWYFLVKENKEALARLMTMEQGKSLTESRGEIDYAASFVRWFAEEARRIDGDVLTSVKASQKLIVLKQPVGVTAAITPWNFPSAMIARKAAPALAVGCAMIVKPASLTPLSAYALVVLAYEAGVPQDLLPVVSGRASEIGREFATNPIIRKISFTGSTEVGAKIFADSAADIKKLSLELGGNAPFIVFDDADLDKAVEGALASKFRNSGQTCVCTNRVYAQSGIYDAFCRKLSEKAAALKLGNGLEDGVNQGPLIEEKAVEKVEQHIADALSKGAVCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 7890 - protein, 144 aa, Gibberella zeae PH-1
MVSPTKDPITCHVLDTQAGKPARGIRVRLEGPIPPSANPHSAAQPRANTFESITDEDGRVTSWLPFLSEDSAGEPPLQTLVEILEDRKGRGSSRWTLRFDTGAYFGEENTFFPEVTVTFRMEERQTYHVPLLLSPYSYTSYRGS

SEQ ID NO: 7891 - protein, 415 aa, Haemophilus influenzae 86-028NP
MNFFQYKHNKLYAEDMPVQQLAEQFGTPLYVYSRATLERHWHAFDSAFGKRPHLICFAVKSCSNIGVLNIMAKLGSGFDIVSQGELERVLAAGGDASKVVFSGVAKSREEIMRALEVGIRCFNVESVSELKHINQIAGEMGKIAPISLRVNPDVDAHTHPYISTGLKENKFGVSVNEAREVYKLASTLPNIKITGMDCHIGSQLTELQPFLDATDRLIVLMEQLKEDGITLKHLDLGGGLGVTYTDETPPHPSDYANALLEKLKNYPELEIILEPGRAISANAGILVAKVQYLKSNESRNFAITDTGMNDMIRPALYEAYMNIVEIDRTLEREKAIYDVVGPVCETSDFLGKQRELSIAEGDYIAQCSAGAYGASMSSNYNSRARTAEVLVDGDQSYLIRRRETLQELWALESTI

SEQ ID NO: 7892 - protein, 506 aa, Rhodobacter sphaeroides 2.4.1
MTAPKPVVLCILDGWGLRAEREANAVALAETPTFDRLMATCPNATLVTHGPDVGLPRGQMGNSEVGHTNIGAGRVVAMDLGAIDLAIEEGSFPQNPALRDFIGKVKAKSGTAHLMGVVSDGGVHGHIQHLISAVEVLAGEGIPVVIHAITDGRDVAPTSAGEFVGQLVRVLPEGARIGTVIGRYWAMDRDKRWDRVKRASDAMLHATGEHAPDAEAAVAAALARGETDEFIAPTVVGDYAGARDGDGFFCLNFRADRAREILAGLAQPGFDAYDTGARPDWSAFLGMVDYSKEHDRFMTTAYPKPVIRNTLGEWVASHGLRQFRIAETEKYPHVTFFLNGGREAPETGEDRYMANSPKVATYDLQPEMSAPDVSDHLVEAIGAGYDLIVVNYANPDMVGHTGDLKAAMAAVEEVDRGLGRAVEAVTKAGGAMIVTADHGNCETMVDPETGGPHTAHTTNPVPVILVNGPAGARLHAGRLADLAPTLLQLMQLPQPEEMTGRSLIDA

SEQ ID NO: 7893 - protein, 219 aa, Triticum aestivum
MDQYSYGGGDGDQAGQGGYATVTSAPPKRPAGRTKFRETRHPVYRGVRRRGAAGRWVCEVREPNKKSRIWLGTFASPEAAARAHDVAALALRGRAACLNFADSATLLAVDPATLRTPDDIRAAAIALAETACPAAPVAAEASAPAPAMMAMMQEPSAVEYDDYPMQYGGIGDFDQHLYYYDGLSAGGGDWQSSSHMDGADDDSNCGGGYGAGEVPLWSY

SEQ ID NO: 7894 - protein, 409 aa, Arabidopsis thaliana
MTMEVSKKKGGDFQQCHDLIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGTGLRFCVLSGYGTESQGRFRSDGEIYDPATNSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 7895 - protein, 178 aa, Streptomyces clavuligerus
MTGGAQELLLSRIRDVPDYPQPGVVFKDITPLLADPEAFSVLTEALAEVCVRHGATKVVGLEARGFILGAPVAVRAGLGFIPIRKAGKLPGATLSQAYALEYGTAEIEVHAEDLTPDDRVMVIDDVLATGGTAAAAMELIRRGGADVAGLAVLMELGFLGGRARLEPTLAALEALLAL

SEQ ID NO: 7896 - protein, 1102 aa, Prochlorococcus marinus str. MIT 9211
MPRRKDIRRILILGSGPIVIGQACEFDYSGTQACKALKEEGYEVVLVNSNPASIMTDPEIAYRTYIEPITSDVIEKVIEVERPQALLPTMGGQTALNISVELAEKGILKKFGVELIGADLASIKRAEDRQLFKDSMKNIGVNVCPSGIASNIEESLSVGNTISTFPRIIRPAFTLGGSGGGIAYNKEEFISICKQGLEASPVSQILIEKSLLGWKEFELEVMRDISDNVVIVCSIENLDPMGIHTGDSITVAPAQTLTDREYQRLRDYSIKIIREIGVETGGSNIQFAVNPIDGEVIVIEMNPRVSRSSALASKATGFPIAKIAALLAVGYRLDEIVNDITGKTPACFEPTIDYVVTKIPRFAFEKFGGSPAVLNTSMKSVGEAMAIGRSFEESFQKALRSLEVGLSGWGCDGTDQLIKSVDLDKLLRTPSPERIMAVRTAMLEGRSDENIYRISNIDPWFLSKLRNIIIAEQSILTDKNIEDVNEEELFLLKQLGFSDRQIAWALRVNELQIRSLRKRFNILPKFKTVDTCAAEFSSSTPYHYSTYERQVKKIDLDGTINKIELDREIEASYTNKVLILGGGPNRIGQGIEFDYCCCHSSYQFQVDGYTTIMVNSNPETVSTDYDTSDILYFEPLTLEDILNIIEYEQPNGVIVQFGGQTPLKLSIPIMNWLNSSDGIKTQTKILGTSPISIDKAEDREQFDKILNDLKIKQPRNGIARSISEAIAIAQDIKYPIVVRPSYVLGGRAMEIVYEDEELVRYMNEAVKVEPDHPVLIDQYLQNAIEVDVDALCDRTGNVVIGGLMEHIEPAGIHSGDSACCLPSISLSKDSQLTIRKWTESLSKALNVEGLINLQFAVQIDTEGIEQVFIIEANPRASRTVPFVSKATGLPLARIATSLIGGKTLNQLGVTKEPIPPLQTIKEAVMPFKRFPGSDSVLGPEMRSTGEVMGSATDFGMAYAKSELAAGEALPTSGVVFLSTHDRDKPSLVPIARSLIDLGFTLTATLGTSKYLMDAGVLVEPILKVHEGRPNIEDLIRSAQIQLIINTPIGRQAAHDDKYLRRAALDYSVPTLTTVAGAKAAVEAITALQNHKITINALQDIHH

SEQ ID NO: 7897 - protein, 230 aa, Prochlorococcus marinus str. MIT 9211
MTCAQARDFISAYLPLIKNVPKGRELVLAPPFTAISTLSEILKGSNVSLSSQNVHWEDNGAFTAEISPKMLLEHSVSYAIVGHSEPRKYFSESDKQINLRAKSAQANGLIPIVCVGETIEQRERGEAERVIRRQVEQGLEETDKKKLIVAYEPIWAIGTGKTCEANEANRICGLIRQWANCPEILIQYGGSVKPGNIDEIMAMSDIDGVLVGGASLDPESFARISNYKVE

SEQ ID NO: 7898 - protein, 323 aa, Synechococcus sp. CC9605
MSTVTELLQPVETDLETLLGDLRSLIGAGHPILQAAAEHLFSAGGKRLRPGIVLLLSRALSEQGELSPRHRRLAEITEMIHTASLVHDDVVDEASTRRGVDTVHSRFDARVAVLAGDFLFAQASWHLANLDDLDVVKLLSRVIMDLADGEVKQGLYRFDTAQTFETYLEKSYCKTASLIANSCRAAGVLSGCAPTQLDSLYQFGRQLGLAFQVVDDILDFTGNDQQLGKPAASDLASGYLTAPTFYALKEHPSLQPLIDRQFSEPGDLDKALEMVRASKAIERTRKLAETFARESRESIAWLPESAAQRALMELPKFVLSRLY

SEQ ID NO: 7899 - protein, 313 aa, Yarrowia lipolytica CLIB122
MPSLADIKQVNAAYKPTVKDAVAVFFGGTSGIGKETAYMFAKKFDSPTVIIVGRSEEAGNKIVNDLKELNAKATFIKSDLSQMKEVVRVSDIVKRDVTKINLLFLSQGILSTAGRTETSEGIELRMSLNYYGRWLAVKELLPLVQTAYDEGDKDNARVMTVLAPGNEGPYVEDDMQLRTKFSMMNQNRHIVQFSSAAVMKFAREHPDLSFIHAHPGLVATGIMRELPWYVRYPSAILMKTPWAVSPADSGEKFFYMSASCPKFAHGAFLLNPACESIKEKPVSKGYLTEQHQDKIWKHTEEEFELALNGLNKA

SEQ ID NO: 7900 - protein, 394 aa, Thermoplasma volcanium GSS1
MNKVRMAEKRLFNGFNTRAVQSGELRDPRFGNVTTPIFETSTFVFPNSEKDAYIDNTRNLPYIYTRWGNPTVQAFEEKYASLEKAEHALSFSSGMGAITSVILALAERGDKILSVSDLYGQTFYFLNKVLPEYGISVEYISTDRLNSGEFKPSDYDIIYLESITNPTLKVPDIKAVSERSTGKKIIVDATFASPYNQNPLDLGADVVIHSATKYISGHSDVVMGVFSTNDKSIFDKVVVRRKTFGSNPDPIQSYLALRGIKTLGLRMEKHNKNGMELAKYLRTEPRISHVYYPDTEIGKKVLRGFGGMISFELRPELDVHVFMRNLKIPMVAASLGGVESLITLPVETSHSSMTKEERERIGITDNLVRFSIGIEDHVDLIDDIKQALDKASES

SEQ ID NO: 7901 - protein, 355 aa, Prochlorococcus marinus str. NATL2A
MALSYYAEELKKTASAIAQPGKGILAVDESTKTVGKRLASIGVENSEENRKAYRGMLFTTEGLGNFISGAILFEETLFQNHPDGEPMVKKLEKLGIIPGIKVDKGLRPLAGGHDVETFCSGLDGLVERAADYYEQGARFAKWRAVLQITDDGCPSKLSIRENAWGLARYARSVQESGLVPIIEPEILMDGSHSIEKTAAVQEEVIKEVYLACQVNGVLLEGTLLKPSMTVQGADSSTKADPQQVAEMTIRTMERCVPASVPGITFLSGGLSEEAASVYLNLMNKIDRKAKWNVSFSYGRALQHSCLKAWKGSNTADGQKALIARAQANSEASKGLYVAGSQPSSDEQLFVAGYKY

SEQ ID NO: 7902 - protein, 377 aa, Candidatus Protochlamydia amoebophila UWE25
MTQKIPFRDYHLFSLLEAYDRQTLPLDLFISHYFREHSSLGSKDRGFLAETIYALIRWKGLLEYLAPSSSWQEKYIVYQTTDLSKMQAREDIPLHARVSFPSHLFELFEECYGVEKAVNLCLINNTTAPTTIRVNRIKTTRDSLFKRWEGQYKISHTRYSSEGIIFHKKINFFSLPEFKEGLFEVQDEGSQLLAQLVRPKPGDQVLDYCAGSGGKTLAFAPHMEHRGQIYLHDIRPFALQEAKKRLKRAGIQNSQILLPNSPQLSKLKKKMNWILVDAPCTGTGTLRRNPDMKWKFDETVLPRLIGQQRTIFEKALSFLHPEGHIVYGTCSMLNAENQNQLEHFIKTYSLEVEGEIFQTIPAQGEMDGFFGVVLKRA

SEQ ID NO: 7903 - protein, 198 aa, Synechococcus sp. RS9916
MNASLARLTKQLSASFNNQKQAFENPPLYGHILVRFRPLPQLKAGSLLLEQAYAVAPKEPYRIRVLRPNICNQRGLVINNYGIQDNQRFWGAIEDNSKRAQISEADLKLLEGCTYLVSENGKGFQGEVEPGCKCIVKRQGIESYLVSSFELSDSGMTTIDRGHDPKTHEHLWGSIAGPFQFDKTVDYSSEIPPEWHSP

SEQ ID NO: 7904 - protein, 192 aa, Schizosaccharomyces pombe 972h-
MPTIKCVVVGDGAVGKTCLLISYTTNKFPSDYVPTVFDNYAVTVMIGDEPYTLGLFDTAGQEDYDRLRPLSYPQTDVFLVCFSVTSPASFENVKEKWFPEVHHHCPGVPCLIVGTQIDLRDDPSVQQKLARQHQHPLTHEQGERLARELGAVKYVECSALTQKGLKNVFDEAIVAALDPPVPHKKKSKCLVL

SEQ ID NO: 7905 - protein, 392 aa, Klebsiella pneumoniae
MRYGGRHSCLSPAMISLRHRGTVMKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDGTSRFSYNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 7906 - protein, 169 aa, Crocosphaera watsonii WH 8501
MIYLIMGVSGSGKTTIGQALSQEFGCAFYDADDFHPPENITKMSQGIPLNDSDRLPWLNAIKLVINQHQEENKNAVITCSALKQSYRDLLEENTTDIIWIYLKGNHETILNRLQQRSKHFMKENMLISQFKTLEEPENAVIIDVNLSVKEILQEIIEQTYAKIESNKDF

SEQ ID NO: 7907 - protein, 383 aa, Glycine max
MGEGENTEIEIEIETETESEATSTTWSLGKHTQIIGLSEKLINGNNLSAKIEAAREIRKMVRKSSSSSKTRAKLAAAGVIEPLVLMLSSSNLDARQSSLLALLNLAVRNERNKVKIVTDGAMPPLVELLKMQNSGIRELATAAILTLSAATSNKPIIAASGAGPLLVQILKSGSVQGKVDAVTALHNLSTGIENSIELLDASAVFPLLNLLKECKKYSKFAEKATALLEILSNSEEGRTAISIADGGILTLVETVEDGSLVSTEHAVGTLLSLCRSCRDKYRELILKEGAIPGLLRLTVEGTAEAQDRARVLLDLLRDSPPEKRLTSSVLEKIVYDIAERVDGADKAAETAKRLLQDMVQRSMEHSMKCIQHRAASCTPIPST

SEQ ID NO: 7908 - protein, 593 aa, Crocosphaera watsonii WH 8501
MTGFDRVMLYKFDEDDHGEVIAEDKLAELEPYLGLHYPASDIPLPARRLFSSNYIRLIPDAKATGIDLFSKLHPLNDTALDLTHSILRSASPCHLEYLHNMGVGASLTISLIDDRKLWGLIACHHLTPKYVPYELRKACEFLGQVVFSEISAKEETKDYDYRMKLTRIQGALIESMSQADNFIEGLINSNQNLLDLTSSQGVAVCVGEEYNLIGNTPKEEEVKYLLQWLKKNIDEEVFSTPSLPHLYADARNFKNVASGLLAIKISHRNYILWFRPEVIQTVNWGGDPSKAYEMQKIDGNLRLCPRKSFELWKETVRLTSLSWKPIEIKAALGLKEAIVNIILRQADELAELAHDLELSNAELKKFAYVASHDLQEPLNQVSNYVQLLEMRYDEALDEDGKEFINFAVEGVSLMQTLIDDVLAYSKVDIRDIKFDLTESENALEKAIANLRGRIAETNAIITHDPLPTVMANSTQLIQLFLNLISNAIKFRSEATPEIHIQAQRLEDEWLFSVEDNGIGIDPRFSDRIFIIFQRLHTRDEYPGTGMGLAICKKIMECHRGKIWVESEIGQGATFYFTIPVGGTERDRKRGSTR

SEQ ID NO: 7909 - protein, 460 aa, Rhodobacter sphaeroides 2.4.1
MMEGLAQANDLSEVIEADRAHMWHHLSQHKQYETVDPRIIVEGKGMRVWDAAGKEHLDAVSGGVWTVNVGYGRESIANAVRDQLIKMNYFAHSAGSIPASRFSKRLIEKMPGLSRVYYSNSGSEANEKVFKMVRQISHRHHGGKKGKILFRERDYHGTTITALATSGQPQRAEQYGPLTPGFVMVPHCLEYRKQWDVENYGERAADAIEEVILREGPDTIGALCLEPVTAGGGVIVPPAGYWERVQEICRKYDILLHIDEVVCGLGRTGTWFGYQNFGVKPDFVTMAKGVASGYAAISCTVTTEAVFDMFKDDPSDPMSYFRDISTFGGCTAGPVAALENMRIIEDEGLLENTLKMGARVVENLSALQEKHAVIGDVRGKGLFCGAELVADRATKEPMDEKRVAAVVADVMAQGVIIGMTNRSLPGFNNTLCLSPALIATPDDIDQITDAIDRALTRVFG

SEQ ID NO: 7910 - protein, 441 aa, Zea mays
MLACIACSSKEGGEDGSRAAATTPHGKEAVKSLTSQLKDMVLKFSGSSKQCRGTPGAQSFRSSGGGRYLRPYPSFIDVTGFAPANKVLGNALAGAGAAGGAARTASSDTLDLTRSNRKTPQSSGWIPSTEAAAAGDDVREWTAQVEPGVQITFGTIPSGGNDLKRIRFSREMFNKWEAQRWWGENYDRIVELYNVVTFSGRQQGCSTPASSVDDSALRDSSYSRVGSASRGSPITVPPPPVASKERLARSASFRATAAGSSSAPYAAAHSARAAYFPSAAVPDPSDHVWAHHFNMLNSAAAGTSAMGGGGPSPYDPSSVATASSRDEASVSLSNASDLEATEWVEEDEPGVCLTIRELGDGTRELRRIRFSRERFGEERAKVYVSSIEQMLCMKNIIMLANWGGVCSAGMVRHLDSNQPHKTGNQRRQQDPRSITIDLLVQ

SEQ ID NO: 7911 - protein, 171 aa, Mycoplasma fermentans
MDLKKYIRDIENFPKTGIMFKDISPLLANGKALNYTITEMAKLAQDVDVIVGPDARGFLFGTPTAAFLKKPFIMVRKPGKLPGDVISKSYDLEYGNNVLQIQKGFIKKGQTVAIIDDVLATGGTTKAIIKLLEEQGAIVKKVILLLELVDLNGRQLITKDNDIEIVSLVKF

SEQ ID NO: 7912 - protein, 242 aa, Synechococcus sp. CC9605
MANWRQLGAIWQLRPAEPTGLIEFIGGSYLAATPQISYRRLLEDLEADGLAVHAWAYVPGFDHQRQARDAWSAFRSARRQLEERCGALAAPLRLGHSLGCKLHLLAPDGGRGSRALVALSFNNFNADRSIPLLGELAPRLGVETEFSPSPAETLRLISRHYQQERNLVVRFGRDELDQSGDLIQALRERPSDASSTLELPGDHLTPASAGLRRSFLGDWADDPKRVSVIRQLSRTIGEAIRP

SEQ ID NO: 7913 - protein, 181 aa, Rhizobium galegae
MTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 7914 - protein, 260 aa, Rhodobacter sphaeroides 2.4.1
MHQPALHPDQDDGAAVLRSALRDAPDEWALFLDIDGTLVDIAEQPHDVRVAASLPQDLARLADRLGGALALVTGRRVDWIDAHFGPHLFPAAGLHGVERRRASGELDRAGLAPSLNALRKDLGRRTARMPGVLLEDKVAAVALHYRQAPEREPDVRAMMEMALKVMGDGWVLQHGKMVVELRPASANKGTALEAFLTEPPFAGRRPVAIGDDVTDEEMFRVVNACGGLSVRICETEAPTLARARLASPQALRDLVAELGA

SEQ ID NO: 7915 - protein, 377 aa, Glycine max
MAIAAAAVVVPLGLLFFASGLLVNLIQAICYVVVRPVSKSLYRRINRVVAELLWLELVWLIDWWAGVKVQIFTDHETFRLMGKEHALVISNHRSDIDWLVGWVSAQRSGCLGSTLAVMKKSSKFLPVIGWSMWFSEYLFLERSWAKDESTLKSGIQRLSDFPLPFWLALFVEGTRFTQAKLLAAQEYATSTGLPVPRNVLIPRTKGFVSAVSHMRSFVPAIYDVTVAIPKSSPAPTMLRLFKGQPSVVHVHIKRHLMKELPDTDEAVAQWCRDIFVAKDALLDKHMAEGTFSDQELQDTGRPIKSLLVVISWACLVVAGSVKFLQWSSLLSSWKGVAFSAFGLAVVTALMQILIQFSQSERSNPAKIVPAKSKNKGS

SEQ ID NO: 7916 - protein, 427 aa, Salmonella typhimurium LT2
MADTKAKITLTGDTTIELDVLKGTLGQDVIDIRSLGSKGVFTFDPGFTSTASCESKITFIDGDEGILLHRGFPIDQLATDSNYLEVCYILLYGEKPTQEEYDEFRTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCETYEVNPVLERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELEHIALNDPYFIEKKLYPNVDFYSGIILKAMGIPSSMFTVIFAMARTVGWIAHWNEMHTDGMKIARPRQLYTGYDKRDFKSALKR

SEQ ID NO: 7917 - protein, 419 aa, Chlorobium tepidum TLS
MAVSFSKLIQSRWLPLKKLLGFLGPGFLVTVGFIDPGNWATNIEGGARFGYELLWVITLSTLILIVIQHMAARLGIATGKSLAVNIRDHFPAPVSSLLGFTIVAACVATDVAELVGGGIGFSLLFGMPLWAGALLTVVLEVFLVVSQRYHRIETIIVGFLGIIALCYLAELWIVRPAWHEVLPATVTPVLGRESIYVAIAILGAVVMPHNVYLHSNVIHSRKWGMTDDEKKELLRYEKADTLFAMTLGWVVNSAMIVVAAAVFHQHGVRVESIEQASATLRPLAGPLAGLLFAVALVFAGVGSSITSSMAEANVITGFLGKPEDPESLLWRVSVFLTAIPSFIIILFKVDTYKILIFSQVVLSLQLPFTLLPLLVLCRSEKVMGVFRSRGVEFVAAVLITMVVVALNLYLLSTTVTGDS

SEQ ID NO: 7918 - protein, 359 aa, Prochlorococcus marinus str. NATL2A
MKSYKITLLPGDGIGPEITNVTHKILDLVSRKFGFEIKFKEMPFGGSAIDSDGIPFPDRTLQECKNSDAVLLAAIGDPKYDELPREKRPETGLLNLRSSLDLFANIRPVKIIPSLTKASSLKEDFVKEVDLVVVRELTSGIYFGEPKGRIKTDKGERAFNTMTYTSEEVNRIAEIAFKLAKQRNQKVCSVDKANVLDVSQLWREETILVSNKYKDIELTHQYVDNAAMQLVRNPSQFDVILTGNLFGDILSDIAAMLTGSIGMLPSASLTTDGPGVFEPVHGSAPDIAGKDIANPIAMLLSAAMMLKIALNETEAATFLENAINEILNDGYRTSDLMSIQTTKQVGCSQMGELLAEKLK

SEQ ID NO: 7919 - protein, 286 aa, Thiomicrospira crunogena XCL-2
MVALVTPMMGDESVDFDALERLIEFHIKSKTRAIVAMGTTGESATLDFQEHRDVVRFVVEKAAGRIPVIAGTGANSTTEAIELTQYAKEVGADACLLVTPYYNKPTQEGLYLHYKKIAQTVDIPQILYNVPGRTACDLLPETIGRLSTINNIIGVKEATGDVSRVSQIKELVDDDFDLYTGDDATAVDFILEGGHGGISVTANVMPALVSEVYDEALAGHAEKARMMDAPLTELHKNLFVEANPIPVKWAMAEMGLMGGAIRLPLTPLSEKYHALVRQALQTAGAL

SEQ ID NO: 7920 - protein, 508 aa, Oryza sativa (indica cultivar-group)
MTTSTRGSEGATSANLTDDQLLGGLLTAAFSPQSCRSRYEFAGYHKRKPPHKPSPYLVAKLRSHEALQKRCGPGTAPYDKALRQLKSGDGAAAADGDDDCRYLVSISYNRGLGNRIIAIVSAFLYAVLTERALLVAPYNGDVAALFCEPFPGTTWLLPDGGRRFPLRHLRDLDGKSKESLGALLKSNGIVSVAAGVNGSTSSSWSGRPPPPYVYLHLDGGADYHDKLFYCDEQQRLLRGVPWLLMKTDSYLVPGLFLVPSLRGELERMFPEKDAVFHHLSRYLLHPANAVWHAITAYHRDHLAGAGHLVGIQIRVYHEETPPVSQVVLDQVLSCARRENLLPAAGNTSSSDQAVLVTSLSSWYYEKIRDELGGGGGGVHQPSHEGLQRMGDTAHDMRALSEMYLLSTCDALLTTGFSTFGYVAQGLAGLRPWIMPRRPWWEKEAATAVPDPPCARVATPEPCFHSPSYYECAARRNYDDIGKVVPYVRRCEDVSWGIQLVNGSSQSQW

SEQ ID NO: 7921 - protein, 371 aa, Aspergillus oryzae
MVPDVAPQTANPNTGSSETERDNRPMMKALVYTGPNKLEVLDRPMPVIQSPTDAILKMLHSTICGTDLHILKGDVPAIPYDRVLGHEGVGTVVSVGPAIDGLSVGDNVVIAAITACKVCASCRKGLEAHCITGGWQLGNKVDGTQAEYVRIPHATSSLYKIPEGLDLRACAAISDALPTGLECGTISAHVQPGSTVAIIGAGPVGLAVMLTARLYTPSQIVMIDLDDTRLEHAKRLGADHAVNPGKLDAMETLNTFTEGQGFDCVIEAVGIPKTFEMCQKLVAPGGSIANVGVHGHPVNLDLHKLWDRNISIKMQLLNAVSIPTLLRLYQSGHIKPSNLFTHHYPFSEVHKAYHSFQMAAQEGALKVAIDF

SEQ ID NO: 7922 - protein, 90 aa, Synechococcus sp. RS9916
MAADPLTTAVSDRICRHMNDDHSEAVLRYAQHYGGMHSAQTAAMTAVRPEAMELMVDGNSVEIPFDHTLSDSEDAHRTLVAMLRAMPASD

SEQ ID NO: 7923 - protein, 225 aa, Zea mays
MATYSDGGGDQRRLLTIPKEGERIIAPTRRPDGTLRKAIRIRAGYVPQEEVAIYQSKGALMRKSGPDVPPGYDPAQVADAKPKTKAAKRNERRKEKRQQASSTNNKGKSMDIEGTDAGETDKALSSKTVKQKDSVESVIKQISGIAISESHATPSTNTTNNSQPESSAPDIDKKIRALKKKIRLAEAQVQGDPEKLRLEALEKMKKIDGWLKELKLLEDKRAPAA

SEQ ID NO: 7924 - protein, 344 aa, Vibrio parahaemolyticus RIMD 2210633
MTNATNRRIVLASRPHGAPTTENFRLEEVAKPVPQAGEMLLRTVYLSLDPYMRGRMSDAESYAEPVALDDVMIGGTVCQVEASNHPDYEAGEWVLAYTVGWQDYAISTGEMVIKLGKEPQNPSYALGVAGMPGFTAYMGLLDIGQPKPGETIVVAAATGPVGATVGQIGKIKDCRVVGIAGGEEKCRYAKEVLGFDECIDHKADDFEQQLKDACYNGIDVYFENVGGKVFEAVMPLLNTSARIPLCGLISQYNATELPEGTDHLPLLMGKLLTKRIKVQGFIIFDDYGHRYGEFAQDINQWLAEGKIQYREHLVEGLDNAPEAFIGLLEGKNFGKLVVKINDPL

SEQ ID NO: 7925 - protein, 546 aa, Aspergillus oryzae
MARILEPEKRLPLSNQDLLSYVFDRPAYDRTQSIYIDAHNPSRSISWNQARTIIRQLIKGLRNAGLQNGDCVAVHSLNNIFYSVVVLAIVGSGGIFTGTNPSYTAGELQHHLKTSQSKFVFCESEFVSPLLESAKQASIHNGNIWVFDTTGDSILPPGLQSWTHLLKQGESDWVHFDDLVIAKKTTAARFFSSGTTGLPKAVEITHHNLLAQHSLVFEAHPRPYSMSHLIVLPAFHAAIAPLMHIGALRSGYVMYIMRRFELNSYLEFVDKYNITDLIVVPPILTAVLKSEHPEKERRLKKVKNIVCGAAPLDKAIQSQARDLLPKDTPLTQAWGMTETCCASMIFPYPEKDETGSVGRLVPNVEAKLIDDQGRNITAYNVPGELCIRGPTVTPGYFDNVSANSSAFDDDGWLKTGDIASCDEASRKWYIVDRKKELIKVSGFQVAPSEVEAVLLSHPGVADAAVVGARNPGDGTERPCAFVVPKSGMKVTSVELKLYAARRLAKYKELSGGVKFVDAIPRNVSGKILRRVLRDLCEDDGGLKSKL

SEQ ID NO: 7926 - protein, 479 aa, delta proteobacterium MLMS-1
MMAKSPAAARAGGMVPPAWTTAGGFFVWSTHPRHRLIRPTKGEKTMATQIELARDGKISPEMEEVARDEGLAAELIRQEVAAGTIVIPCNHGRQQRAVGIGRGLKTKVNASIGTSSDIIDYGAEVAKAQAAAEEGADTLMELSVGGNLDEVRRQVLAATDLPVGNVPLYQAFCEASRRYGDPNKLDEELLFELIEQQCADGISFMAIHCGINLYTLERLRKQGYRYGGLVSKGGTQMIAWMLANNRDNPLYSQFDRVVDILRRHDVVLSLGNGIRAGAIHDSSDRAQVAELVINCELTEIGRQMGCQMMVEGPGHVPLDEIEGNIQLQKRMSGEAPYYVLGPLPCDVGAGYDHVTAAVGAASSSRYGADLVCYITPAEHLALPNEADVREGVRVARLAVHMGDIVKLGKRGRERDLAMGKARRDMQWQRQYELGLFGPQAKKIRDERSPADQATCTMCGEFCAAKNAEVLFADCLGDKR

SEQ ID NO: 7927 - protein, 501 aa, Catharanthus roseus
MALASIEKVATGLICFILLIFSLKRIGHPRDWALVGILSVWFPSLGHIYEKLAKSLAKNDKTFVLKGSFLSKQDVIFTCDPANMHHVMSTNFSNYPKGPENRNVFDVYGEMLFTADHEKWKSHRKVTNAYFHDQRFNGFSQKVNKEVIEKELFPFLDHAAEEALVFDLQDVFQRLMLDSSSILTTGQNHRSLRVGLPYDETLEAINIANYQIFVRHILPAKIWKFQKWLGIMGEKKIKKAWRILDDISVEYMNRRKKEISSTISSQEDMDVVKFSEEDHVVLKSVDASDNLLRDTVKGILLAGTDTTATVLSWFFWLILKNPRVEQKIREEIELYLKQKNGEHGLYTNPEELNELMYLHAAIYETMRLYPAAPFTSRKSIQADVFPTGHQVNPNTTIVMAYYAVGRMKSIWGEDCLEFKPERWLSDKGKLIPVQTNKFLAFGTGPRICPGKELGLNRVKAVAAAIIPKYSFKIMRNKPVMPAACATLYLKDGLIVRVNKII

SEQ ID NO: 7928 - protein, 711 aa, Gibberella zeae PH-1
MAPRGFEDEELTISLSSSHVRRPQQTQPQSQSQQQDDSHDAPQAASRPADAPLKERIKTEQRIGAYKVLRTLGEGSFGKVKLAIHNGTGQQVALKIIARKKLISRDMAGRVEREIEYLQLLRHPHIIKLFTVIKTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPTGAANLIKKMLVVNPVHRATIEDIRADPWFTTELPVYLQLPVEEFFNTGVDPNKAIKKNDIAPNASEKVQERLHNEVTEKISKTMGYGKSDVEEALQAAEPSAIKDAYMIVRENKMMQVNHNSEALLAEPEGSSPMLSMSSARSTISQATTTPRPYVSKVGILPSSLPAYHKDYMEREKAGSVENSPPKVLINDEPQLNRTDAEKEETARRLRPHSRSQLRIDEANTRPQGMTPINPPKKTKPVRWQFGIRSRNSPWEALLCIHKALYKLGATYIPDEDYESRTAEERAEASGDSSFVDSHDGYRGSTSSIDPKKRYNLPADPWHINVRWDTSAIKKKAGNTPSAPSTPSSPSTPDGHHAKEPFVALHLDIQIYEMEHGVYLVDFKCSGYETAHGRLLEEKDVTSPFPFLDMAAKLIMQLAEAD

SEQ ID NO: 7929 - protein, 468 aa, Neisseria meningitidis
MSIKNVVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7930 - protein, 540 aa, Prochlorococcus marinus str. MIT 9515
MSKISKKNINKIKVTESPVVLAILDGWGHREETSDNAIKQANTPVMDALWHAYPHTLISASGADVGLPNGQMGNSEVGHLTIGSGRIIQQELVRITNVVKNNQLTQVLELNNMANSIKKNNGTLHITGLCSDGGVHSHIEHLLGLIKWASESGLDKVAIHVITDGRDTPAKSAYKYIKQIEDCIKEFKVGEIASICGRYWIMDRNLLWERTEKAFINLTDPNLQVTDLSPEDYLNKSYGENITDEFLEPVRISKKFLKDGDSLICFNFRPDRARQIIKALSEREFDNFKRNIIPDIDILTFTQYEANLPVKVVFPPESLNNFIGQIVSENGLKQYRTAETEKYPHVTYFFNGGVEVPSPGEHRHLIPSPRVATYDMAPEMSAEELTISCSNAIKTGQYSFVVINFANPDMVGHTGDMEAAIKAIETVDKCIGKIVNATGEMGGSILITADHGNAELMKGPDGEPWTAHTINKVPLIFIEGEKRKIPNMGNEIYLRDNAGLADIAPTLLQLLSLPVPKEMTGKSLIKEIELKGFNKVVQHV

SEQ ID NO: 7931 - protein, 468 aa, Neisseria meningitidis
MSIKDAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTKFSTLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7932 - protein, 113 aa, Mycobacterium sp. MCS
MNTLDFVDQSSLRDDIPAFGPGDTVNVHVKVIEGSKERIQVFKGVVIRRQGGGIRETFTVRKESYGVGVERTFPVHSPNIDHIDVVTRGDVRRAKLYYLRELRGKKAKIKEKR

SEQ ID NO: 7933 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7934 - protein, 370 aa, Medicago truncatula
MRCGCFGASRTRKKERKPSDYISGEIEGYPLDNIRHFSDKELSLATDNYHLGNKIGRGGFGTVYQGTLKDGRKIAVKPLSVGSKQGVREFLTEIKTLSNVKHSNLVELVGFCIQGPNRTVVYEYVENGNLHTALLGKKSLSVKMKWRERSTICIGTAKGLAYLHEELTQHIVHRDIKASNVLLDKDFNPKIGDFGMAKLFPDDITHISTRIAGTTGYLAPEYALGGQLTKKADVYSFGVLILEIISGKSSSRTNWDGSHKSLLEWAWQLHEEEKWLALVDPEMEEFPEKEVIKYIKVALFCTQAAARRRPLMTQVVDMLSKEIQLNDKQLTAPGLFNYDAGETSQKKSNPESLVYHTSSTQPSITEVTAR

SEQ ID NO: 7935 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7936 - protein, 422 aa, Oryza sativa
  misc_feature (7)..(7): Xaa can be any naturally occurring amino acid
  misc_feature (187)..(187): Xaa can be any naturally occurring amino acid
MAVEYHXCCGAAFFEHVVIIVVLVLFAGLMSGLTLGLMSLSLVDLEVLAKSGTDQDRKHAAKILPVVKNQHLLLCTLLICNAAAMEALPIFLDSLVTAWGAILISVTLILLFGEILPQSICSRYGLAIGASVAPLVRVLVWVCFPVAYPISKLLDHLLGKGHTALFRRAELKTLVTLHGNEAGKGGXELTHDETTIIAGALELTEKKAKDAMTPLCQTFAIDINAKLDRDLMQKVLDKGHSRVPVYYEKKTNIIGLILVKNLLSINPDDEIPIKSVTIRKIPRVSEDMPLYDILNEFQKGHSHMAVVIRQTNANYAAEPPANDGGTLEVAISIDDKHGEKVVKNLPPLRRWKSCPNSQNSNRGNRNRKWSKDQSDVLQIHEEPLPTLNEDEEAVGIITMEDVIEELLQEEIYDETDVHVEEQ

SEQ ID NO: 7937 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7938 - protein, 455 aa, Bacillus halodurans C-125
MKMTTVSVPTRESLIEEIKETIKTKNVELLHLQFVDIEGILKHVTVTAEQIDSVVDGKIMFDGSSITGFTPINQSDLYLQPDLTTFAVLPWTEEEGYSEGRFLCSVKKPDGSDFEGDPRNILKKTVERAKEKGYSISVGPELEFFLFETDEYGLPTKQTQDIGGYFEPSPKDNGEKVRLEIYRTLKAMGFTIEASHHEVAEGQHEINFKYADALGSADAATTYKWVVKTVAKQFGLHATFMPKPLGGANGSGMHTNISLFDDEKQENAFYDESDKLGLSKTAYQFIAGLIENVKDFVAVTNPLVNSYKRLVPGYEAPCYIAWSASNRSALIRIPATRGAGTRVEIRCPDPAANPYLAFAVVASAGLDGVEQELTAPASVDADIFHMSAEEIAERGIENLPTSLEEAINRFEEGEIGKKTFGEHAFGEYVALKRGEWDEFRTTVHDWEVAAYQGKF

SEQ ID NO: 7939 - protein, 796 aa, Cryptococcus neoformans var. neoformans B-3501A
MSTTIQQGDTDTGAGNHLPAWLLAMSGIFTAVATAISMMSIVLQLKNYRKPTLQRAVVRIMVMVPLYAISSLIALFSLEAAFFIDAIRDLYEAFVIYTFLQLLITYLGGERSLLIILHGRPPIPHPFPVNIFLQPMDVSDPWVLLNLKRGVLQYVQVKPLLVLATVALKATGTYQEGRFAADSGYTYVSIAYNTSICLSLYCLAMFWVAVNKDLKPFRPVPKFLCVKGILFFSFWQSIGISLLVAMGAIRKVGPYTDPEHMSLALVDSLICFEMPIFAIAHQYAFQASDYIDHNLVYAARLPFIYAFRDAFGFKDVWQDTIDTFKGRGVSYQAYEPAEGGLHYGVGRQKRIRAGLRYAKGGKMKYWMPKPGDEARMKGQSGLITSMKRRVDERLAEREGYAPLLPQQAARVVHLDPGRYTTYTGGERMFDSDSSDDSDAPSLTFHSADEMEDAMYDRARRIGYAGFPNVDVSKEEARRKRREEEEGILKGRWTRSGLRVRDGTGLGGGEGQGEGRMRAGSAAKGKSNGKNKDKGKGKGQSRKVYGTWADHPPSVQRFNSSSSSTRNGNGNGHPADFDEADDEGVVRQEEEGRAIKKKRQRQSPPVWVTRTGATTGVGSSSSPFSIGDDDDDDDEDGEGVKNRETQGDRSMSFNHPDNSSHNSDSDSEHSVKPSTTKKLPADAVDLVKEDYEAVEAARERERRRGEPQTNAPAHVYRKTIIDEIPETDTNAGAMKRRRGIGGRIEEIQEVYAHDPHVMTKDEIQTGVKEVVDHVETSVTVEPPKHAMSLDLEDNPWS

SEQ ID NO: 7940 - protein, 346 aa, Crocosphaera watsonii WH 8501
MANIIFVVLIVLTGSAVCACAETALFSVSPVRVKQLAQSKKRTAIVLQSIRSKMNRPIATIVILNNIFNIVGSIVIGSLAATVLGDAWLGLFSSVLTFLIIVCGEIVPKTIGERYSEPIALAVAIPVQFLTVIFTPLVWLMEQITSPFNRRGNLPTTNETEIRFLTMIGHKEGVIEDDEAEMIQRVFQLNDLTANELMTPRVIVTFLPGDSTLLESQEEIIISEHSRILVIEESIDKVIGYCLKDELLAAIIKGKGEQKINQLLRQVYYVPESIKADKLLKTFQDTREHLMVVLDEYGGVAGVVTLEDVLEVLIGEIVDETDRIIDLQEIARKKRKVLLNSRGIKP

SEQ ID NO: 7941 - protein, 452 aa, Cryptococcus neoformans var. neoformans B-3501A
MLRNLRPLLRTVPAPSRSVLRPLSTTSKAFATAQSSPVRAHSVEELHALTAEEILKEGGVRKEAEMRHFTVNFGPQHPAAHGVLRLILELNGEEILRADPHIGLLHRGTEKLIEYKNYTQALPYFDRLDYVSMMTNELSYSIAVERLLNIEVPERAKWIRTLFGEITRVLNHLMAVLTHAMDVGALTPFLWGFEEREKLMEFYERVSGARMHAAYVRPGGVAFDLPHGLLDDIFKWATQFSSRVDEVEEVVTGNRIWKQRTIGIGPVTAQQALDYSFSGVMLRGSGIPWDIRKVAPYDAYDKVEFDVPVGKNGDCYDRYLCRVQEFRESLRIIGQCLNKIPDGAYKVDDHKIVPPPRASMKESMESLIHHFKIFSEGYSVPPGETYAAIEAPKGEMGVYLVSDGTNRPYKCKIRAPGFAHLAGADFMMRHHFLPDAVAIIGTMDLVFGEVDR

SEQ ID NO: 7942 - protein, 390 aa, Oryza sativa
MDSIMEPYVADLLTDDITASMVELLSGDGGAAQMDVGVLEAYLRAIGALPAHPAAPGADLAAAAEVESMASNDDTNGNWDTKVDAKVPSAFLPPPPGFPPLPVPALADEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDTREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQDISSCVLTVLNTQ

SEQ ID NO: 7943 - protein, 505 aa, Triticum aestivum
MMTVPLVVALFNSPFVLTTLAFLLFTLLVSKTRSNVAARGTLPPSPPSLPVFGHLRLLGSLPHRSLRSLAASYGPVMYLRLGRVPTVVAYSAAAAEEAMKTRDLAFASRPKLFMVDRFYYGTGGIGFAPYGEHWRQARRVCVTHMLNPHRLLSFRRVRGQEVAALVDRVRRAGTVVNLSDNLIVYSFTAISRATFGDTDYGIDGEEGGARLRKVFAEIEELLGTAPMGEKVPWLRWVDVLTGLERKTRRAFEEMDGLLERVITDHRQKSGAGDNDQRDFVDVLLGANELDTNGIKAIILDMLAAATDSTFTLLEWAMAELINHPQEMRKLQDEVRTAVGDAGHVTEDHLPDLRYLKAVVKETLRLHPPTPLLLPRETVEDTQLLGYHVPAGTRVLIHAWAIGRDPATWGDRAEEFVPERFLEYTHEMGQDFAFLPFGTGRRGCPGVKFAMPSNELALASLVYHFDWELAGGRKPPVDMTELHGLSVRLKTPLLLAAKPWSSRGVE

SEQ ID NO: 7944 - protein, 489 aa, Oryza sativa (indica cultivar-group)
MEASLDQLPDQLSCGLEDAPPSNSNLTGDQLLGDLLSAAFSWQSCRSRHEALQVRCGPGTAPYEKALRQLKSGDGAIAADGDDDDCRYVVSMVYDRGLGNRVIPIISAFLYAVLTERALLVAPYNGDVDALFCEPFPGTTWIHPGGRRFPLRRLRDLDGKSRESLGTLLKSNAVSVDAGGNGTSSWSGRPPPYVYLHLDGGADYHDKLFYCDEQQRLLRGTPWLLMKTDSYLVPGLFIVPSLRGELERMFPEKDAVFHHLSRYLLHPANALWHAITPCSTTSPAPATSSAYRFACTTRRRRRCRRWCSTRDDDEHVVVGPGRARDVAELVGLAGERPWLMPRRPVWDKEPATEVPEPPCVRAASPEPCFHSPSYYDCAARRNYEDIGKAVPYIRRCEDVSWGIQLVKGSSHWVRTVAGEAHGGRQPKCGGEGTVGGNQQPSAGLKIAAKLDKAVAMRKDDEVKQMVIALVAIGRNSSGTEEHASTGLVG

SEQ ID NO: 7945 - protein, 377 aa, Bradyrhizobium japonicum USDA 110
MSTSTKRCYYETLEVERDADESKLKSSFRKLAMKFHPDRNPGDDTSEVKFKEINEAYEVLKDKDKRAAYDRFGHAAFEQGGPGGGAGFGAGFASSFSDIFEDLFGMAGQRGRGGRERGADLRYNMEITLEEAFGGKTAQIEIPVSVTCEACSGIGAKAGTKPKTCSTCGGAGRVRQSQGFFTLERTCPGCQGRGQMIEDACPSCSGQGRVTRERTLSVNIPQGVEDGTRIRLAGEGEAGVRGGPPGDLYIFLSLAQHQFFQRDGADLHCRVPISMVTAALGGEFEVPTIEKGKAKVKVPAGTQSNRRFRIASKGMPVLRSRQTGDMYVQVVVETPQNLTKKQQELLAEFEKLSSGNTQPESEGFFTKVKDFFGSRAN

SEQ ID NO: 7946 - protein, 399 aa, Oryza sativa (japonica cultivar-group)
MNGSSGSQGHNVNGGQKKVQHASPLTLNNGSKHRPLTPMRRCRGVACVVIILSTAFTLIVFIAPITTFLVRLVSVHYSRKATSVLFGMWLSLWPFLFEKINKTNVVFSGESVLPKKRVLLFANHRTEVDWMYLWDLALRKGYLGYIKYILKSSLMKLPVFSWAFHIFEFIPVERKWEIDEAIIQNKLSAFKDPRDPLWLAVFPEGTDYTEKKCIKSQEYASEHGLPILKNVLLPKTKGFLCCLQELKSSLDAVYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTGFFLYLSLFSSVWFKVYVLLSCAYLTFVTYFSIQPPQLICSSEGGTHAKKVL

SEQ ID NO: 7947 - protein, 207 aa, Bradyrhizobium japonicum USDA 110
MSERLLVLVRHGQSEWNLKNLFTGWKDPDLTEQGVAEAREAGRKLKAQGLVFDVAYTSVLTRAQHTLDLILGELGQKGLPTEKNLALNERDYGDLSGLNKDDARKKWGEDQVLIWRRSYDVPPPGGESLKDTLARALPYYVQEILPSVLNGKRTLVAAHGNSLRALIMVLEKLSPEGILKRELATGVPIIYRLNADSTVASKLDLAG

SEQ ID NO: 7948 - protein, 166 aa, Synechococcus sp. WH 7805
MGDASLLQQTTAGRGRGSQQKHGASENAADPENDSVSSMRVIAQDPSELTQHALRRARQAVRCLPFRRSFYRLLEESAQSSKELANRPDWRVNTSQRLGAGETETLLIWLIQLGVLRREVDGQGLTERVRITPLGRDVLADWPEVIPAADPLSRVMHWCRRRRPRW

SEQ ID NO: 7949 - protein, 730 aa, Kluyveromyces lactis NRRL Y-1140
MSSDVSSPISEVPFVEKFLGEVECEEYLPTFEKFRLFDEDRLYYLDREILEELGVKKIGDKIKILKQSRQLRRDASGFNPKKELVEITAKINALNSNPLSINEELVTDKHSVIFILNDGSAKKVNVNGCFNAHSIKKKLIKRLPSEFISIDPVTKEATHSSQDYDVFVVDYVKNVLHLLYDVELVTICHSSDRLEKNRLIFVSKDQTPSEKAIFTSKKVYLKTLSVMQQMGSQPGAGRPLLSGPGTNALRIENRSDNIREIFTQRPPTELISTNLPEYFPHTDINRLKKTLRNSMRQSIRASMIRGKNGSLVSLAGSNKIGDILVNQSHAVDRALLESIQNDGSASNSADHAVPMHNTSTNGSDASTASLTPLMKRTSISSNSRNSKSSVRGRSGSESGTSESNDKIELYSTDTDTEGEEDDAEDTISLPTKVEAPKSWLKGARIGSGSFGSVYLGMNAETGELMAVKQVELKPTAVTAGVVSIADESKKAHSPGGGNTAVKNTSQIHRKMIDALQHEMNILKELHHENIVTYYGSSQEGGNLNIFLEYVPGGSVSSMLNNYGPFDEPLVKNFTRQILIGLAYLHKRNIIHRDIKGANILIDIKGGVKITDFGISKKLSPLNKQQNKRASLQGSVYWMAPEVVKQVVTTEKADIWSVGCVIVEMFTGKHPFPDFSQMQAIFKIGTNIIPEIPSWVSEEAKAFLFKSFELDYRKRPSSLGLLQEPWLNTVL

SEQ ID NO: 7950 - protein, 220 aa, Pseudomonas syringae pv. syringae B728a
MSLPLNASAPHTDAQPHPGAARVGIGGPVGSGKTRLLEQLILRFIARGTELAIITNDLATREDAERVQRSGLIDPQRVRAVETGACPHTAIREDPTLNLQMADELEARFGNLDLVLIESGGDNLASTFSLDLVDYWIFVIDVAGGDDIPRKRGPGVLSCDLLVVNKYDLAPYVGVDLPRMRRESAQARNGQPVLFTNCNTGEGVDAVVDAISRAVLFDRT

SEQ ID NO: 7951 - protein, 321 aa, Magnaporthe grisea 70-15
MFGRSAPKFDPAKDIPNQAGRIAFVTGGNGGLGLETVIQLAKAGMERIFIGARNEEKALKAIKEISTNLNCSTTFTFVKMDLTSFDSVCRAADQVISQTDKLHLLINNAGVVGTAPGLTPEGYETQWGTNHMGHALFTRLLLPLLKQTAEGGRVDVRIVNVSSLSERMCALHGCGDLEVFKRAEAKGPLWGAGLFWGYGASKLATILHARMLAKKHPSVKAVAVHPGTVKTTITGSFSKTSPFIGGYVMPFITALFFVDVSEGARNQLWAATSDQANTGEYYAPVGRPNMGSGKSRNMKEAERVWEWTERELDAYLRKTGR

SEQ ID NO: 7952 - protein, 216 aa, Vibrio parahaemolyticus RIMD 2210633
MKYQAAIFDMDGLLLDTERVCMRIFQEACEVQNLPFYEDVYLSIIGRNAAGIETIFRKAYGENLDRLHLEWRTRYNAVVKHQAIPVKDGVVELLEWLKAQGLPIAVATSTAKEVAKIKLELAGLSKYFDNLTTGCEVSHGKPDPEIYFLAANRLDVEPSQCLAFEDSNNGVRAAVAANMVTYQIPDLVEPCDEVKQFGHAIVPSLHEVLAELKQTR

SEQ ID NO: 7953 - protein, 414 aa, Schizosaccharomyces pombe 972h-
MNIVKRAVPELLRGMTNATPNIGLIKNKVVSFEAVGQLKKSFYKRQLPKQCLAFDSSLGKDVFLRALQEGRMENYFSLAQQMVTQNEPAFCGLGTLCMILNSLKVDPGRLWKGSWRWYDQYMLDCCRSLSDIEKDGVTLEEFSCLANCNGLRTITKCVKDVSFDEFRKDVISCSTIENKIMAISFCRKVLGQTGDGHFSPVGGFSESDNKILILDVARFKYPCYWVDLKLMYESMFPIDKASGQPRGYVLLEPMHIPLGVLTVGLNKYSWRNVSKHILQQAATVKNADNLAEILLSINQSSIPLIQERSNSSKSGDFEHFKECIRSTKTYHLFLKHTNTNVEYITMAFWAIFSLPMIQKALPKGVLEEIQSLLKEVEISEINTQLTALKKQLDSLTHCCKTDTGCCSSSCCKNT

SEQ ID NO: 7954 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALSALKADHEFLLRGGVFSKDWIDSYIAFKEEDVRRIRMAPHPLEFEM

SEQ ID NO: 7955 - protein, 279 aa, Arabidopsis thaliana
MATSLQTKYTLNPITNNIPRSHRPSFLRVTSTTNSQPNHEMKLVVEQRLVNPPLSNDPTLQSTWTHRLWVAAGCTTVFVSFSKSIIGAFGSHLWLEPSLAGFAGYILADLGSGVYHWATDNYGDESTPLVGIHIEDSQDHHKCPWTITKRQFANNLHFMARGTTLIVLPLDLAFDDHVVHGFVSMFAFCVLFCQLFHAWAHGTKSKLPPLVVGLQDIGLLVSRIHHMNHHRAPYNNNYCVVSGVWNKVLDESNVFKAMEMVLYIQLGVRPRSWTEPNYE

SEQ ID NO: 7956 - protein, 144 aa, Cyanophora paradoxa
MAAFVAALPVIPSKAFIAGKADVAKAPVATNKGGVRMSKKATFTAAATAAALLAASPVFAADGAAIFTNNCAACHAGGNNVIAAEKTLKKAALEQYLDGGYNVDAIKKQVTGGKNAMPAFGGRLAEDEIAAVAEYVYSQAGNGW

SEQ ID NO: 7957 - protein, 335 aa, Allium cepa
MEVERVQAIATLTANLGTIPPEFIRSDHERPDLTTYHGPVPELPVIDLANSSQENVVKQISEAAREYGIFQLVNHGIPNEVINELQRVGKEFFQPPQEEKEVYATVPDSGSFEGYGTKLQKDLEGKKAWVDYLFHNVWPEHKINYKFWPRNPPAYRKANEEYTKHLQVVVDKMHSYLSLGLGLESHVLKEAVGGDDLEYLLKINYYPPCPRPNLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDENPPKFKTKKYKDYAYCKINKLPQ

SEQ ID NO: 7958 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGIEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7959 - protein, 1401 aa, Schizosaccharomyces pombe 972h-
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 7960 - protein, 352 aa, Allium cepa
MPIESVIIAPPAPRVETLSKSNLHSIPLEYIRPEHERACLGDALEQLHNSNSGPQIPITDLDSRDCIEKVTKAAKEWGVMHIVNHGISSELMEKVRAAGKAFFNLPLEAKEEYANDQSKGKIQGYGSKLANNASGQLEWEDYFFHLIFPDDKVDLSVWPKQPSDYIEIMQEFGSQLRILASKMLSILSLGLQLPTKDRLEQELKGPEDLLLQLKINYYPKCPQPHLALGVEAHTDVSALSFILHNNVPGLQVLYEGEWVTAKLVPDSLIVHVGDSLEILSNGIYKSVLHRGLVNKEKVRISWAVFCEPPKDAVVLKPLDEVVTDDAPARYTPRTFAQHLERKLFKKKGWRFG

SEQ ID NO: 7961 - protein, 468 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEM

SEQ ID NO: 7962 - protein, 419 aa, Neisseria lactamica
FTVPARIVLEDPEEWFENGQAFDGSSIGGWKGIQASDMQLRPDPATAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7963 - protein, 496 aa, Xylella fastidiosa Temecula1
MSAPFALYDTAAAAALDARLAAHLGDDGDLLMQCAGRAAWDLLRQRWPDARQVLVACGTGNNGGDGYVLACLAHRAGLQVQVVHLPGCGPASLLAQRAYDAYLAAGGQVMLFSGVLETADVLVDALFGIGLNRPLDVPTQGLINALNAAGRPVLALDVPSGVDAERGAVFGTPVCAHVTLQFMVPHVGLYTGPALDAVGERVLAALDVPPALRDALPPCAERWGPQRLASLFRSRRRNSHKGEFGRVLCVGGNWGSGGAIMLSAEAALRSGAGVVHVATREAHVAPLLARCPETMPRGVAGSAELMPLLTAADVVALGPGLGQDSWGQALLAATLDSGCALVIDADALNVLAAAPGPLPPGAILTPHPGEAGRLLGCTTAQVQADRRAAAQALAARFAAVVVLKGAGSLIAAPGCLPCVIDAGNPGMAVAGMGDVLTGVIAALRAQGESAFDAALFGALLHAAAGDQVARDGGERGLLPSDVLPVLRRLINPDSAP

SEQ ID NO: 7964 - protein, 462 aa, Rhodobacter sphaeroides 2.4.1
MATFDVIIIGAGPGGYVSAIRCAQLGLKTAVVEGREALGGTCLNVGCIPSKALLHATHNLHEVHENFEKMGLMGAHPTVDWSKMQGYKQEVVDGNTKGIEFLFKKNKITWLKGWGSIPEPGKVKVGEEIHEAKSIVIATGSEPASLPGVEADESVIVTSTGALSLGRIPETMVVIGAGVIGLELGSVYARLGTKVTVVEYMEAILPGMDAEVVKTTQRILAKQGLSFVLGAAVKGATVSDGKATVTWAAKKDGKETSLTVDTVLVATGRKPFTEGLGLEALGVEMLPRGVVKIDDHFRTSVPGIYAIGDCVPGMMLAHKAEDEGVALAEILAGKHGHVNYGVIPGVIYTTPEVASVGRTEESLKEEGRAYKVGKFPFMGNARAKAVFQAEGFVKMIADKETDRILGCHIIGPAAGDLIHEVCVAMEFGASAQDLAMTCHAHPTWSEAVREAALACGDGAIHA

SEQ ID NO: 7965 - protein, 414 aa, Thermus caldophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKGVIPRAIRVGYRVYAYDFHRNPIPGQEGPNLYWRDVGTLDAYYEASMDLVKVDPVFGLCSPVWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 7966 - protein, 510 aa, Rhodobacter sphaeroides 2.4.1
MMGTEVRVPTLGESVSEATVATWFKKPGDRVAADEMLCELETDKVTVEVHAPVAGRLVEIVAPEGTTVAVSALLAQIGAAEAGEDPAPEKTHAGAEAKAGAGESKMIDVMVPALGESVSEATVSTWFKKPGDTVAQDEMLCELETDKVSVEVPAPAAGVLAEILVTEGTTVAAGSKLALISSDGQGVAAAPKAETPKKTEAAPAQEPAPKKDVEDAPSARKAMAEAGLSPDAVQGTGRDGRIMKDDVARAVSGASQAAAPTPAPQPALPRQPVPADDAAREERVKMTRLRQTIARRLKEAQNTAAMLTTYNEVDMSGVMGLRNEYKDAFEKKHGTKMGFMSFFVKACCHALKEVPEVNAEIDGTDIVYKNYVHMGVAVGTPSGLVVPVVRDADQMGFAQIEKKIAELGLRARDGKLSMAEMQGGSFTISNGGVYGSLMSSPILNPPQSGILGMHKIQERPVVEKGQIVIRPMMYLALSYDHRIVDGKGAVTFLVRVKEALEDPRRLLLDL

SEQ ID NO: 7967 - protein, 638 aa, Cryptococcus neoformans var. neoformans B-3501A
MNRNCSSSTPTSSHSPQQSEHKRRWWDDLTFTKCKKMFLRHLHFVGPGLVSSVAYIDPGNWATDLEAGADYGYKLLFVVLLASLAAVVLQLLSVRLGTTTGLSLPAQTRLLFLRLKTRYPRYRIPLTIALWTLYALAEIAIIATDLAELLGSAIALHLLFPKLPLFAGVLITAVDVLVVLVFFRSSSGRQGMMFFEIIIVSLVLAVFISFMILLKLTSPVWRDVFLGLVPSETLVKPGALYLGVGIIGATVMPHALFLGSFLSGVDRLNMIPQPPSMRKPRNVTMPSFNPFRRTRSIRSDSEQGEGVSTGISPVLLQAPRPSSGSEAAVLENDGAKDEVHLQDSVVELTKEEKLFAIEQKEYERNVRMFDRIKWVDVHLFHSTIDTAISLLSFALTINASILTLAGAVYYYNESPPSEGADLFGAFDLIKSYISHAAAIVFALALLCAGQSASITATLAGQVVSEGFINWKTSPFLRRLITRLLGVIPSAVVASAVGTKGLNTMLVASQVLLSIVLPTVVFPLVYLCSKHEIMTVQGPEVESIEMERIANSGTSVSDPFALAATTPSLSPTTLGDDLAALGIESTTVRVEPDHSVDRPSRRSKSYVSPKWVTVLGYVLFVVIVLANVYVIVELCLGNG

SEQ ID NO: 7968 - protein, 609 aa, Magnetococcus sp. MC-1
MCGILAEVGQQSPAAARQRALDRLRHRGPDHGGQWSAQQPVPVWLGHRRLAIVDTSSAGNQPLHLHAADLHLVGNGEIYNAPALQKTLEALGHVFHSHSDNEAILHAYREWGSDCLAHLEGMFAFVLWDARQQTLLAARDRMGIKPLFYAATPAGGLVLASEASALVGLDGVAQQGYEPQALSHVLAYGHIPDPYAIWRGVNKLSPGQFLRWTPQQGLRLHTYWSPPSQSDAPSDDQAWGQRFEQVLQEHLLSDVPLSLFLSGGLDSTSVAVGVKRLGHQLKAFSLGFPGHPRDESALAQATAERLGHPFEAVVMDGRDLLQQVDAALLQQDEPHLFGSYLTMLNICSAVAKEYKVVLSGDGGDELFAGYNWYRDIPTALPTLAPWKAALAKPLLRHSPLPAALLERARLAFACCSPLHRHAWRTSQRFLPAEVEALLRPAAIRYDDEAFLAPLQRWFTPELPLVRALQRIDLMSFCSNHVCAKVDRASMAHALEVRVPYLDRRLVEWAISRPADPREAQGSKPLIRDYIAPHVPAQVLEQRKQGFSLRTTPPANLESTFVAWIEQSPLISQSILRRDWPRFLRADDRLRAQKLWHLALLARWMHHHPA

SEQ ID NO: 7969 - protein, 200 aa, Yarrowia lipolytica CLIB122
MTETGQIQKFKLVIVGEQSVGKTSLITRIMYDKFDQNYEATIGIQFLSKPMYLPDRTIRLQLWDTAGQERFRSLVPAYIRDSHIAIVVYAIDSRKSFVDVDKWIEDVKAERGNQVVLMLVGNKSDLEESREVTTEEGQEKAKQYDALFLETSAKAGHNVKSILNKVASELPGLETALKTDQSELIDVNITNEPEQDSCSC

SEQ ID NO: 7970 - protein, 374 aa, Schizosaccharomyces pombe 972h-
MLHFLIRPSTRCAGSPHFNSTSSFLRKRLQSKTILSKRLGFQFRPSSTNVLAEVSTATSGFNPSWWPYALIQNTAYTINVYAGAPWWVSIILTTLGVRLALTPVMIASFRNSTKLSVIQPEMKKELEAIKTAKLDNDQLALNQHSIALRGIYLKHNVNPFAIFILPLTQSAVFFSFFYAIRKMSRLSVDGFTTGGLAWFKDLSIPDPYCILPIINAGLMFSGMQMNRANTASTIGNSTNWRTFFFLCCLLSPLLTAKLPAAIFMYWIPSSLFNIVQGYILKNPVVRSKLGFAPLPSIIEKQPSGFTLITNPIKSLKEFYKGVRDGFKTQYEQLQKDVSRRAVATTSASTIRPNSHYKKLKELNRSKKNSKKQSN

SEQ ID NO: 7971 - protein, 451 aa, Pseudomonas aeruginosa PAO1
MSFDFDLFVIGAGSGGVRAARFAAGFGARVAVAESRYLGGTCVNVGCVPKKLLVYGAHFSEDFEQARAYGWSAGEAQFDWATLIGNKNREIQRLNGIYRNLLVNSGVTLLEGHARLLDAHSVEVDGQRFSAKHILVATGGWPQVPDIPGKEHAITSNEAFFLERLPRRVLVVGGGYIAVEFASIFNGLGAETTLLYRRDLFLRGFDRSVREHLRDELGKKGLDLQFNSDIARIDKQADGSLAATLKDGRVLEADCVFYATGRRPMLDDLGLENTAVKLTDKGFIAVDEHYQTSEPSILALGDVIGRVQLTPVALAEGMAVARRLFKPEEYRPVDYKLIPTAVFSLPNIGTVGLTEEEALSAGHKVKIFESRFRPMKLTLTDDQEKTLMKLVVDAHDDRVLGCHMVGAEAGEILQGIAVAMKAGATKQAFDETIGIHPTAAEEFVTLRTPTR

SEQ ID NO: 7972 - protein, 432 aa, Tropheryma whipplei TW08/27
MSKIKLVTAIPGPESERLHRIRQATVARGVSSTFPIYIKESHGSILIDEDGNHLIDMGCGIGVTTLGHSHPAVVDAARAQINSVWHTLFSITPYESYVEVCKLLAKNTPGDFPKKSLLLNSGAEAVENAVKISRAYTGRPTVAVLDRSFHGRTNLTSSMTYRGSLYSSDFGPTASNIVSAPNSYPLHDRLSGKEAAARTISYLETRVAARNIACLFYEPIQGEGGVIVPADGFLPALQDWCRENDIVFVADEIQSGFGRTGCFFASETDGLEPDIVCSAKGIANGLPLSAVTGRSDIVDAARPGTLGGTFTGNHVSCAAALEVFEQYKDNAPLDSASRLGDILKELLLNLQSKHPQIAEVRGRGAMFGAEFSGNHAGEMVSRVITRAAELGVIFLSSGVEGNVVRFLPNVFMDKETIEEAIGVLDSAISSVV

SEQ ID NO: 7973 - protein, 419 aa, Neisseria polysaccharea
FTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKVAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7974 - protein, 419 aa, Neisseria mucosa
FTIPARIVLDDPEEWFENGQAFDGSSIGGWKGIQASDMQLRPDPATAFIDPFYDDTTVVLTCDVIDPADGQGYDRDPRSIARRAEAYLKSTGIGDTAYFGPEPEFFVFDGVEFETDMHKTRYEITSESGAWASGLHMDGQNTGHRPTVKGGYAPVAPIDAGQDLRSAMVNILEELGIEVEVHHAEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7975 - protein, 471 aa, Schizosaccharomyces pombe 972h-
MYPLNANSYTLLRKLGSGSFGVVWKARENVSGDIIAIKQIDLETGIDDITDIEQEVFMLSNCNSSNVIQYYGCFVDGYTLWILMEHMDGGSVSGLLKMGRLNEQVISIILREVLYGLNYLHGQNKIHRDIKAANILLSSSTGNVKLADFGVAAQLSNAASRRHTFVGTPFWMAPEVIQQTSYGLAADIWSLGITAIEMANGIPPRATMHPMRVIFEIPQSEPPKLDDHFSPTFRDFVSCCLDLNPNMRWSAKELLQHPFIKSAGTVKDIIPLLVQKENKLFDDSDQSVLEETINNTLKPFEEPIAEGNADIEDWTFETVKKSDSTVLGNTSIPKNSIISSQNKEELPSSIKYLEKTIMSDQATPHPFSKSLSEKGSSYHKSLTSDFAMKHYIKSTIRSMLLNDKLSATQRSSLESFYTSFISLDKNLSSKFVNQITPDNRLHHKKQKRSPISQLLFSRWLEETEKRRSLNG

SEQ ID NO: 7976 - protein, 339 aa, Candidatus Protochlamydia amoebophila UWE25
MAVNIAINGFGRIGRLVCRLAIEREDIRIIAINDLVPADNLAYLLKFDSTHGRFKGEIKVEENAIHVNGKKILIFSEKDPQNLPWNDLKIDYVVESTGLFTTSELAGKHLIAGAQRVVISAPAKGDVPTFVMGVNEKNYNPATDRIVSNASCTTNCLAPITKVLLDNFGIDEGLMTTIHAVTASQPTVDGPSKKDWRGGRGASQNIIPASTGAAKAVALCLPQVKGKLTGMAFRVPNADVSAIDLTVRLSKETSYEDICQAMKNASEGAMKGILAFCDEQVVSSDFISSPYSAIFDKDAGITLNSKFYKLIAWYDNEMGYACRVIDLVSYMNCCNNNSL

SEQ ID NO: 7977 - protein, 401 aa, Solanum tuberosum
MAVKKSVGSLKEADLKGKRVFVRVDLNVPLDDIFNITDDTRIRAAVPTIKYLMQNGARVILASHLGRPKGVTPKYSLKPLVPRLSELLAIEVKMANDSIGPEVENLVAELPEGGVVLLENVRFYKEEEKNDPEFAKKLASLADLYVNDAFGTAHRAHASTEGVAKVLKPAVAGFLMQKELDYLVGAVSNPQKPFAAIVGGSKVSSKIGVIESLLEKVDVLLLGGGMIFTFYKAQGYAVGSSLVEEDKLDLATSLMEKAKTKGVSLLLPTDVVIADKFAADANSKIVPASEIPDGWMGLDIGPDAIKSFGSALDTTKNIIWNGPMGVFEFDKFAAGTEAIAKKLAELSGKGVTTIIGGGDSVAAVEKVGLAEKMSHISTGGGASLELLEGKPLPGVLALDDA

SEQ ID NO: 7978 - protein, 344 aa, Arabidopsis thaliana
MRSRQLHNVSEDRETLSRRNKRSKTSLNGHIPIDLLIEIFLKLPVKSIATCRSVSKFWTYVLGRQDFTELFLTKSSSRPQLLFACANDNGYFFFSSNQPQNLDENSSPIAAYPLTHVPKSRDLGPPINGLVSLRGERILKGRIRPVDVSIIYNPSTGESLTLPKTNMTRKKIYTVTSFLGYDPIEKQYKVLSMNMSYEKHPKCEGYQVLTLGTGKLSWRMIKCCLNYQHPLKNSMLMGQEAHKTISGICRSFELWVLEDTVKHEWSKHVYLLPPLWKDAVANTRLYFAGMIGTSEIVLFRPDEPLCVFYYNIDRNTIKRVGIRGLEAFKYFRIFLNHVENVKLF

SEQ ID NO: 7979 - protein, 419 aa, Neisseria cinerea
FTVPARIVLKDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7980 - protein, 762 aa, Myroides odoratus
MQRTILAALLTGALLGAPAWAAINPNKLGAAYDATKANVTFKVYSSKATRIELYLYSTATGSAEKAKYVMTNSGGIWSVTIPTSTLSGQGLGGTLYYGYRAWGPNWPYNASWTKGSSLGFISDVDAAGNRFNPNKLLSDPYALELSHDPTTATMTNGSIYASGATYRNIDSGSSAPKGIVLAGDTQATGTKPTRALKDDVVYEAHVRGLTMNDTSITAAYRGTYKGAGLKAAALAALGVTAIEFLPVQETQNDTNDNDPSSTSGDNYWGYMTLNYFAPDRRYAYDKTPGGPTREFKEMVKAFHDNGIKVLVDVVYNHTGEGGAWSPTDKTTYNITSFRGLDNPTYYSLTADFQNSWDNTGVGGNYNTRNTIAQNLIVDSLAYWRDKLGVDGYRFDLASVLGNSCQHGCFNFDKMDAGNALNRIVAELPPRPATGGSGVDLIAEPWAIGGNSYQVGGFPSGWAEWNGAYRDVVRQAQNKLGSVAITTGQMATRFAGSSDLYGDDGRKPWHSVNFITAHDGFTLKDLYSCNSKNNNQVWPYGPSDGGEDNNNSWDQGGIAADQRKAARNGMALMMLSAGVPMIVGGDEALRSMNCNNNPYNLDSSANWLNWSRTTDQNNFQSFSKAMIAFRKAHPALRPANFYSSVDNNGNVMEQLRWFKPDGGVADATYFNDANNHAIAWRIDGSEFGDTASAIYVAHNAWSAQVNFTLPWPGAGKSWYRVTDTCGWAEGASQVQAPGSEALVGGENTAYGLCGRGTLLLIAK

SEQ ID NO: 7981 - protein, 419 aa, Neisseria pharyngis subsp. flava
FTIPTRIVLDDPEEWFENGQAFDGSSIGGWKGIQASDMQLRPDPATAFIDPFFDDTTVVLTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7982 - protein, 419 aa, Neisseria flavescens
FTIPTRIVLDDPEEWFENGQAFDGSSIGGWKGIQASDMQLRPDASTAFVDPFYDDTTVVFTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7983 - protein, 143 aa, Triticum aestivum
KERLGDRITALHQIVSPFVKTDTASVLQETIGYIRFLLSQIEALSFPYLGHGNGGNSMQQHNLLLNHSTGNDMVEVEGSTKQEEEEVINGVDGSRKDLRSRGLCLVPVSCTSHLADDNGASDFWAVAAAPPPPPPPLAGIIWR

SEQ ID NO: 7984 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTIGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 7985 - protein, 194 aa, Triticum aestivum
MAPTVMASSATSVAPFQGLKSTVGLPVSRRSNGASLGSVSNGGRIRCMQVWPIEGIKKFETLSYLPPLSTEALLKQVDYLIRSKWVPCLEFSKVGFIFREHNASPGYYNGRYWTMCKLPMFGCTDATQVINEVEEVKKEYPDAYVRIIGFDNMRQVQCVSFIAFKPPGCQESGKAYTAHSRQAIYKVPLQYGQL

SEQ ID NO: 7986 - protein, 204 aa, Agrobacterium tumefaciens str. C58
MMKSGNGPLRVGIGGPVGSGKTALTEKLCKAMSGDYSVAVVTNDIYTKEDAEALVRMQALPSERIVGVETGGCPHTAIREDATINLQAIAGLNAQFPDLDVVFIESGGDNLAATFSPDLADITIYVISVCQGEEIPRKGGPGITRSDLLVINKKDLAPYVGADLTVMDSDATRMRNAMPFVFTDMKRGDGVDRIVGFLKEQGGL

SEQ ID NO: 7987 - protein, 372 aa, Ipomoea nil
MPTKVSDTCRPHHPIVSQILDLYSIKELPESHAWSSDDHTGSNSINFESIPVIDLDNYNHDNNFNILDTIGHACKKWGAFQLINHNISEKLLEDIEIAGRRLFSLPMQQKLKAARSPDGVSGYGLARISSFFDKLMWSEGFTIVGSPLEHSRLLWPQDFNSFCEVVEEYEKEMKKLAGRMMKLILESLGVAEEDAKWGVESKGRCSALQLNSYPACPDPGRAMGLAEHTDSTVLTILHQNNTSGLQVFREGAAGGWVTVPPIPGALVINAGDLLHILSNGLYHSVLHRAVVNRSSHRLSVAYLYGPPPGIKISPLPKLVAEGQPPLFRAITWSEYLRTKAKHFDKALSSVRLICAPRNPFSDTNDHNRVRVG

SEQ ID NO: 7988 - protein, 893 aa, Eubacterium acidaminophilum
  misc_feature (350)..(350): Xaa can be any naturally occurring amino acid
MVLVKIDGRELEVPKDYTILKACEAAGAKIPTFCYDERLSRHGAGACRICLVEIEGQRNLMPSCTEKVWEGISVFTKSERVIKERKGILELMVQNHPLDCLTCEKSGDCKLQDYCYEYGVTGIKGLEERVLPVDESNPFYTFDPDKCILCGKCVRVCEELQGTRAILISERGPVAKVSTQFEEGLENSPCVSCGNCVSYCPVGALLPKSKTEHRVWETKKVRTTCSYCGVGCQLELIVKGDEVVGVQPAMGAGNDGLLCVKGKFAYNFVNHPDRLKKPLIRKDGVLVEATWEEALSLVAKKISDIKSQHGADSIAGLTSARCTNEENYLFQKLLRAVVGTNNVDHCARLXHASTVAGLATTLGSGAMTNSIAETRYNDVIFVTGSNTTENHPVIAAQMKQAVKNGAKLIVADPRRIELADYADVFLQITPGTNIALLNAMMNVIISEGLQDKKYIEDKTENYEELVGLAKRYTPEEAARICGVDAEDIRKAARIYASADKAGIYYAMGITQHISGTDNVMSISNLALLCGNIGKEAAGVNPLRGQNNVQGACDMGGLPGDLPGYQKVISPEVIEKFEAVWSAKLSSKVGLTVPEMLTEASNGNIRMIYIMGENPMVSDPDITHVKHALEHLDFLVVQDIFLTETAELADVVLPAASFAEKDGTFSNTERRVQRVRKAVNPVGDSKPDYEILINLMKKLGYNAFYKDASEIFDEIASVTPQYAGIDYKRLEDINGLQWPCPTKEHPGTKYLHSKGCARGKGLFVPCEYAQSAEMPDSTYPLVLTTGRILYQYHTTTMTGKTEGISSNYSESFIEVNPSTANKLGIEDGEMVRVVSRRGSVETNVRVTEIVEEDVVFMPFHFAKGAANMITNSKLDPKAKIPELKVCAVRIERIK

SEQ ID NO: 7989 - protein, 237 aa, Rickettsia mongolotimonae
LNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFA

SEQ ID NO: 7990 - protein, 466 aa, Lactobacillus brevis
MENTRMKQMRRSNQSSGPALNCHDLPKYKLAKHALEPRPREADRLVRDQLLDEGNSRLNLATFCQTYMEPEAVELMKDTLEKNAIDKSEYPRTAEIENRCVNIIANLWHAPEAESFTGTSTIGSSEACMLAGLAMKFAWRKRAKANGLDLTAHQPNIVISAGYQVCWEKFCVYWDIDMHVVPMDDDHMSLNVDHVLDYVDDYTIGIVGIMGITYTGQYDDLARLDAVVERYNRTTKFPVYIHVDAASGGFYTPFIEPELKWDFRLNNVISINASGHKYGLVYPGVGWVIWRDQQYLPKELVFKVSYLGGELPTMAINFSHSASQLIGQYYNFIRFGFDGYREIQEKTHDVARYLAKSLTKLGGFSLINDGHELPLICYELTADSDREWTLYDLSDRLLMKGWQVPTYPLPKNMTDRVIQRIVVRADFGMSMAHDFIDDLTQAIHDLDQAHIVFHSDPQPKKYGFTH

SEQ ID NO: 7991 - protein, 499 aa, Synechococcus sp. RS9916
MAGRFSQQNQRVRPSSKEDQVVEKAKEHFERTLIQIAGSVAGSVAALEHPSHDEALNYGEIFLRDNVPVMVYLLTQRRYDIVRHFLTVCLDLQSTTYQTRGVFPTSFVEEGDALLADYGQRSIGRITSVDASLWWPVLCWLYVKHSGDEEFGSSQKVQRGIQLLLDLVLHPTFEGTPVLFVPDCAFMIDRPMDVWGAPLEVEVLLYGSLRSCIKLMELSRRHHDSRLLDQRLVLTRQWVHDLRQFLLKHYWVTSKTMQVLRRRPTEQYGDNQHQNEFNVQPQVIPDWLQDWLENRGGYLIGNMRTGRPDFRFYSLGNSLGCLFGLLTSPQQRALFRLVLHNRDHLMAQMPMRICHPPMDGLEWQNKTGSDPKNWPWSYHNGGHWPSLLWFFGASILLHERRHPHADVLLMGQMKALLEESYWSQLNQLPRQQWAEYFDGPTGTWVGQQSRTYQTWTIVGFLLLHHFLRTRPEDVEILDLEELFGTGADNDEASASESQP

SEQ ID NO: 7992 - protein, 446 aa, Streptococcus mutans UA159
MKTHPKKQSLSEVNQSVRVPKNASFLTTLRAFLGPGALVAVGYMDPGNWITSVVGGASYKYLLLSVVLLSSLIAMQLQQMAGKLGIVSRQDLAQATASHLPKRLRYLLFIVIELALMATDLAEVIGSGIALHLLFGWPLLFSIFITILDVFLLLSIMKLGFRKIEAIVSTLILTILVIFVYLVVISHPSFSGIIKGYIPQFAIFDSAQAATNSRLTLALGIIGATVMPHNLYLHSSISQTRQVDYKQKSSIAQAVKFMTWDSNLQLSLAFIVNSLLLILGASLFYGHASEISAFSQMYNALANNHIAGAVASSFLSTLFAIALLASGQNSTITGTLTGQIVMEGFLHLKMPQWLIRLVTRLLALLPVLIAAILYGSQEKILDQLIVYSQVFLSVALPFSIFPLVYFTSQKKIMGEFVNAKWNTYLAYGVATVLTILNLQLIINTIF

SEQ ID NO: 7993 - protein, 250 aa, Salmonella typhimurium LT2
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPLKHYYLGNADEIAAKAAAVANQGKAK

SEQ ID NO: 7994 - protein, 429 aa, Photobacterium sp. SKA34
MTRVIVVGGGAGGLELATKLGRTLGRKGRAEVTLVDRRASHLWKPLLHEVATGSLDAGVDAISYRAHAKNHHFDFQMGSLETIDRENKTITLAALFDKQNELLLPERTLEYDILVLAIGSTSNDFNTPGVRDHCIFLDSPEQAHRFRTEMNNQFMRLHGNKEQKTVDIAIVGAGATGVELSAELHNAVQELHNYGFGDLDSSRLNVNLVEAGDRILPALPPRISQAAHNELTKLGVTVRTGTMVTKADETGLTTKDGDHIPAQIMVWAAGIKAPDFMKDISGLETNRINQLVVKPTLQTTRDDDIYVIGDLASCVQEDGSFVPPRAQAAHQMASRCFSNIVAKITDREQKPYVYSDHGSLVSLSRFSTVGSLMGNLSKGSMMVEGRIARMVYISLYRMHQMALHGMFKTGLIMLVSRINRVLRPSLKLH

SEQ ID NO: 7995 - protein, 1102 aa, Prochlorococcus marinus str. NATL2A
MPRRKDIRRILILGSGPIVIGQACEFDYSGTQACKALRSEGFEVILVNSNPASIMTDPETANRTYVEPLTASVVEQIIKIERPDALLPTMGGQTALNISVELAESGTLEKYNIELIGADLNAIKKAEDRNLFKIAMKNIGVDVCPSGIASNLQEAEIVGNEISSFPKIIRPAFTLGGSGGGIAYNQDEFLELCKTGLDASPVSQILIEKSLLGWKEFELEVMRDLSDNVVIICSIENVDPMGVHTGDSITVAPAQTLTDREYQRLRDYSISIIREIGVATGGSNIQFAINPNNGEIIVIEMNPRVSRSSALASKATGFPIAKIAALLAVGYRLDEIINDITGKTPACFEPSIDYVVTKIPRFAFEKFSGSSSILTTSMKSVGEAMAIGRCFEESFQKAIRSLETGLSGWGCDRVDQNVSSIELERLLRTPSPERIMHVRLAMKNGRSDNEIFSFSKIDPWFLSKLRNIVEAEDQLLNYENITQLEPNFLFKLKQLGFSDRQIAFALNTDELIIRARRTHLKILPVYKTVDTCASEFSSNTPYHYSTYERPAYNIDNDGNIIKNINLNELKNNNKNKILILGGGPNRIGQGIEFDYCCCHASYQAQEDDYTTIMINSNPETVSTDYDTSDILYFEPLTLEDVLNVIEFEEPHGIVVQFGGQTPLKLSLPIVNWLEKLENSKLRTKVLGTSPISIDLAEDREQFDKVLRRLDIRQPKNGLARTFEESLSVANKIGYPLVVRPSYVLGGRAMEIVYEQDELERYIKEAVNVELDHPILIDQYLENAIEVDVDALCDVSKNVVIGGLMEHIEPAGIHSGDSACCLPSITLSVESIKTIKHWTKSLAIELDVVGLINLQFAVKRDQEGNEIVYIIEANPRASRTVPFVSKATGVPLAKIATQLLLGKTLKDIGLNQEPIPPLQTIKEAVMPFKRFPGSDSLLGPEMRSTGEVMGSAKTFGMAYAKSELAAGEGLPTSGFVFLSTHDRDKPALIPVAKKLIELGFSVLATSGTSNYLEKFDLNVERVLKVHEGRPNIEDMIRSGKVQLVINTPIGRQAIYDDKYLRKAALDYSVPTLTTLKGASAAVKGIEALQNQILSVSALQDIHS

SEQ ID NO: 7996 - protein, 236 aa, Kluyveromyces lactis NRRL Y-1140
MSLLSWVFGSSMTPQERMRKNQRALERAQRELEREKKKLEAQEKKLIQEIKKSAKNGQVNAAKIQAKDLVRTRKYTEKFGNMKTQLQAISLRVQAVRSSDQMAVSMREATGLLAGMNRSMNLPQLQRISMEFEKQSDLMEQRQEFMDESIDDVMGDELDEDDEADEIVNRVLDEIGVDLNSKLQTAPQDLVKNEQAAAEPARAVAEAIGSSGDGPGPVTGSTTDDELQARLNSLKR

SEQ ID NO: 7997 - protein, 507 aa, Arabidopsis thaliana
MAMASLARRKAYFLTRNISNSPTDAFRFSFSLTRGFASSGSDDNDVVIIGGGPGGYVAAIKAAQLGLKTTCIEKRGALGGTCLNVGCIPSKALLHSSHMYHEAKHVFANHGVKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNERFSTNVSGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 7998 - protein, 129 aa, Treponema maltophilum
MKKQITSAHGPAAIGPYSQAVQAGPFVFTSGQLPIDPKTGAFAGSTIEEQTRQSLKNIEAVLKEAGLAMDAVVKTTVFLSDMNNFTAMNGVYAEFFGAGVFPARSAVQVARLPKDSLVEIEAVALCPAR

SEQ ID NO: 7999 - protein, 1030 aa, Schizosaccharomyces pombe 972h-
MSENSTDSKNFQFSEGSRESSNDELKVLLRDTETKEDEKSSFSNSEEESIIENLSDSSVNKEYAKNSLKLSDAVSESKYLNPLLKDKRHDRSFALHKVVVPDDYDYIPLNKHIPSDPPAKTYPFELDPFQSTAIKCVERMESVLVSAHTSAGKTVIAEYAIAQALKNRQRVIYTSPIKSLSNQKYRELLSEFGDVGLMTGDVSINPSASCLIMTTEILRAMLYKNSEIMHEIAWVIFDEVHYMRDKDRGVVWEETLILLPDAIRFIFLSATLPNALQFARWISEIHKQPCHVVYTDYRPTPLQHFIYPQGADGIYMLVDEKNKFKTENFKKVLEVLDHSTRQENYSKSSKKVKKSSSLERIINMVLSNRYDPIIVFCFSKKECEINAHQFGKLDLNDTENKELVTEIFDSAINQLSEEDRGLRQFEEMRSLLLRGIGIHHSGLLPILKELVEILFQEGLVRILFATETFSIGLNMPARTVLFTKAQKFSGNNFRWLTSGEYMQMSGRAGRRGIDTKGLSIVILDQSIDEQAARCLMNGQADVLNSAFHLSYGMILNLMRIEEISPEDILKKSFYQFQNMESLPLIKEELMQLKNEETSINIPNETAVKEFHDLKLQLEKYGEEIQKVMTHPDNCLPYLQSGRLIQIKLGGIIFPWGVLVNVIKREFDPNTREQVAPHETYVLDVLLPISSNSMSNHKVNPSILVPPRPNETPLYEIVSVLLTAVCNISSIRIYMPRELNSNESKLRAYRRVNEVIEEFKEIPYLDPLEHMHIESSTLSLSLRKLEILEPKLFDSPYYKDSKHRAEYHEFRKKLNLRAQIKDISTKITNTEAIIQLRELKIRQRVLRRLGFCTLENVIDIKGRVACEITSGDELLLVELIFQGFFNQMPPEEIAAALSCFVYEDKSEVSTLNLKEPFKKMYLTIIEAAKRIATVSLESKLQFNESDYLHQFKPDIMEPVSLWINGASFQEICIVSKLYEGSIVRTFRRLDELLKQLEHAAIVLGNNELKEKSVLTEQKLHRDIIFSASLYL

SEQ ID NO: 8000 - protein, 693 aa, Oryza sativa (indica cultivar-group)
MAAGSHGGYRGYEVAREREHDVGVSRRSKEHYHHRHPSRHRDSERRRDGGRSGGRELSNGYSHRRDSPRPPPRRRPSEGRTEDREPGEVSGGSGSERSGERPMKTREPRENGVTRVSKEEAKMSPSKKRKQSPVIWDRNGSQRQARDPVRGIREVDAVVAEIIMHQSHSLPVMSSLSSIGDGHSPMILDVSVDKVQEYEKNRIVDEEEEGYPTMRNILTSRWADAGDEEENVFVPKKKKSVSPVDSIERGSTKKVTSPESGEVLVYNSVRSSSRSSDSGVLQGSANRDLEVEKGDNIDVEKAADDDYPAGHLLDSDFEGEDCRSETPECTRSPRRCINMLQGCRSVDEFERLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPEKRISAEDALNHEWFRELPLPRSKDFMPTFPALNEQDRRFKKHMKSPDPLEEQWMKEQGNNGDRGLFG

SEQ ID NO: 8001 - protein, 787 aa, Neisseria meningitidis MC58
MQFSYSWLKTQADTELSSDKLEHLLTMSGLEVEEAETAAPAFAGVVIAEVKSVEKHPDADRLNVTRVDAGTGGLVQIVCGAPNVKAGIKVPCSLPGAVLPGNFKIKPTKMRGEVSDGMLCSTDELGLPDDGVNGLHILPEDAPVGTNIREYLDLDDTLFTLKITPNRADCLSIKGIAREVSALTGCAFRQPEIHTAPITGSRKQPVQINAPADCGRFISRVIENVNARATTPDWMKQRLERSGIRSISALVDIGNYVMLEIGQPMHVFDADKLSGSLHIRRAREGETLECLNEKTVSLSENTLVVADEKGVLSLAGLMGGAASAVSDGTQNIVLEAAWFAPEIIAGKSRQYGFGSDSSFRFERGVDYRLQADAIERATELVLQICGGAAGEMVEAQGELPEAKQVGLRLDRLKTVLGVDIPAEQVETILQHLGLQPEKTAEGFRVTAPSFRFDIEIEADLIEEIGRVYGYENIPDDYTSGRLKMLELPETRRPRFAVYNEMAARGYREVVSYAFVDEQWEQDFAANADPIRLQNPLAAQYAVMRSTLIGGLVEILQNNLNRKQNRVCVFEIARVFSKGSDGQFVQNERIGGLWYGAVMPEQWGGKTRNADFYDIKADVENLLKNKAVEFVKTGHPALHPGRAANIVSDGKVIGFVGELHPKWLQKYDLPQAPLVFEIDMAAVLECGKTRYRVVSKFQPVRRDLAFVMPEAMSHDDLLLVLKGAANKLVQEISVFDVYRGTGLPEGMKSVAVKVILQDMENTLTDEAVEPLIGKLIGAATAAGARLRS

SEQ ID NO: 8002 - protein, 416 aa, Thermotoga maritima
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVIAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 8003 - protein, 620 aa, Magnaporthe grisea 70-15
MPSEGDIEMHSLAAKEDIMLAQQGSSSNHSMRREPIYDDNTRGPSALRRWADSFRRDPGIRITPKEVPLYLDRDQVHHHHIHHEQYHHPPPPLPPQVPMREHDGERYYDLRSATLATVNTGLSRELKGRHLQMIAIGGSIGTGLFVASGKALATGGPASVLLAYCIIGVMLYCTVHALGELAVVFPVAGSFSAFSTRFLDPSWGFAMGWNSLHDYTILGSQREKSRVCGNILDGHIGLNLFGVKGYGEAEFIFAIVKVTAVIGFILLGIVINVGGTTTEGYIGTKYWHNPGAFNNGFKGLCSVFVQAAFAFAGTELVGLAAAETANPRKSLPTAIKQVFWRITLFYIVALTIVGFLVPYDSKRLLARNIADAAASPFVIAIESAGIEVLPSIMNSVILIAVLSVGNSAVFGSSRTLAALADQGQAPRILAYVDRRGRPLVAILLSMSIGLLAFVADSDIQQELLDWLLAISALSSIFTWGSICLSHIRFRRAWSKKGRSLGDLAFRAQPGLAGSWIGFLLNAIFLVAQFWVGGWPLPPVTGEEMTPLSIAGEFFLQCMAIPIVLIMWLGHKLYYRTSLVRTDDMDIDTGRRDFNLPILMAQEYEEKLNWPRWKRLYRFFC

SEQ ID NO: 8004 - protein, 516 aa, Arabidopsis thaliana
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTVTKRSNLL

SEQ ID NO: 8005 - protein, 897 aa, Eubacterium acidaminophilum
  misc_feature (349)..(349): Xaa can be any naturally occurring amino acid
MINVTINGTTVSVPRKSTLLEACNAAGVSIPTFCHDERLQAHAACRICVVEVAGARGLMTACSTPAVDGMDVQTHSERVIEARRGVLSLMIANHPLDCLTCVKSGDCRLQDYCYEYGVKEPEFEGAKKNYEIDDSNPFYISDQNKCISCGRCVRVCNELQCTGAIDLAERGFDTHVATPFDVDLEKSKCVSCGNCVAVCPVGALMPKSKELFRQWETKKVRTTCSYCGVGCQMDLVVKGDTVVGAEPANGPANEGLLCVKGRFGYKFLSHPDRLTKPLIRKNGELVESSWDEAYSLVAKKMKQTKEEFGADSLVGLTSARCTNEENYLMQKLFRAVIGTNNIDHCARLXHSSTVAGLAATLGSGAMTNSITEVKDSDAIFVIGSNTTENHPVIGAMMKQAVKKGAKLIVAEPRRIELADYADVFLQIKPGTNVALLNGMMKAIVDEDLHDKEYIEERTEDFDKLKELLGRHTVEEYAAICGVDAEDVRKAARIYAEADKAGIYYAMGITQHSDGTNHVKSVSNLALLCGNLGKESAGVNPLRGQNNVQGACDMGGLPNSFPGYLSVTSPEIREKFEKAWDAKLSGNVGLTIPKMLSGIDSGDVRLMYIMGENPMVSDPDLTHVEKSLRKVDFLVVQDIFLTETALLADVVLPAAAFAEKDGTFSNTERRVQMVRKAVNPPGEAKADWKIFMDLMNKLGYSNYYRNTSEIMDEIASVTPQYGGISYDRLEEKGSLQWPCPTKEHEGTKFLHKGQFARGKGLFTAVEYKGPAEITDEEYPLILTTGRVLYHYHTMTMTGKVEGLMQKSPESFIELSPNAAENLGVADGEMVKVSSRRGTINVKAAVKDILADNVVFMPFHFAVGAANMLTNTALDPTCNIPEFKVCAVKVEKIATEKTA

SEQ ID NO: 8006 - protein, 538 aa, Aspergillus oryzae
MSPNLEITIPTTSLSPTSPPYTVYNLTLRLPLRSFTISKRYSDFLNFHKTLLTQTNIPPPAPLPQKTWFKNTVSNASLREDRRQALEAYLQAINDADDPRWRNSPAWRAFLNLPSAANASHTSTRLHAAITDPGSGADNPISDPTLWLDVYRDMKSHLHDARLHLTRRDQETTPQKQHESSARAKSSLVRAGSLVAALEEGLKVMGEAANRAQSPSGKGRGGSLGDGELRRRKDLLINARKEKDGLEDLLNAMAAKSRVDHAVASVQDKEALVGSASRKPARSGRVLGKETERTRELDNQGLLQLQRQTMEDQDQSVEELLKIIRRQKELGIAINEEVEIQNALLSIANEDAERCFCDFSMRSSRGCENFVSLSDGGGMGWSGCIARARMAASIRCKTGEYESSIGKVSTGSLVMSMRRYSESFRHKPTHPHLRRQAPYYSRTCPSHRLQALSAGRKNLRSGVWPGKSDSTFQQECGEQSHTPLGCLLLEKNKAAREISLPCEGLCLLLCNRTQGHRNQFPCLKLAFVSLLSGSKSLT

SEQ ID NO: 8007 - protein, 170 aa, Aspergillus oryzae
MIDPRPYHILSYGTLLGVQVYQTFVSGIVAFRALPRPQFASLQTATFPIYFSLQTALPVLVALTASNNGQPLGISGLLENPKTLLPMAAAAVTGLVNMVVLRPLTVNTMRERKHQETRDGKKSYDPPPHSKEMVALNKKFGRLHGFSSLINLVCLGATIYYGALLGKRLA

SEQ ID NO: 8008 - protein, 116 aa, Photobacterium sp. SKA34
MAEETIFSKIIRKEIPTDILYQDDLVTAFRDINPRAPSHILIIPNKLIPTVNDVEADDELMMGRMFTVARKLAEKEGVAEDGYRLIVNCNPYGGQEVYHIHMHLLGGRPLGPMLVG

SEQ ID NO: 8009 - protein, 289 aa, Streptococcus mutans UA159
MQIDGYTRLAAVVATPIKHSISPFIHNYAFEKTGINGVYVAWDIPESELQVTLKNIMRYDMFGINISMPYKQAVIPYLDEVTKAADLIGAVNTIVNRDGRLIGYNTDGFGFFKSLGTFADFDVADKVITILGGGGAATAIIAQAAINGAKKINIFNQTAFLEETKEKAKQISSKTGAAIEVFPVEDLNMIQKKVLVSDLFVNATNVGMDGKSMIINDSFEFPPNLMVADVIYQPFETPFLRLVRSRGLKAVNGLGMLLFQAAAAFELWTGKEMPSQEIWQALEKKYKSK

SEQ ID NO: 8010 - protein, 130 aa, Triticum aestivum
MVKTSVLNDALNAMNNAEKAGKRQVLIRPSSKVIVKFLTVMQKHGYIGEFEEVDDHRSGKIVIQLNGRLNKCGVINPRYPVQLRDLEKWATQLLPSRQFGYVVLTTSAGIMDHEEARRKHVAGKLLGFFY

SEQ ID NO: 8011 - protein, 231 aa, Oryza sativa (indica cultivar-group)
MDYWKTKVLPKIKVVFAKGGNAKKAAAAELIKSFDESKEGINGEFEEKKADLQPKVVEIYEAAPAPLKVLIKDRAKVSGIKKNSAAVTKFVDDLAKIEFPGAKQLSEGIAKVGPALLSGPVFATFEKVSTLLPADEEEIKPKEAPAAAAEEEKKEEAAAAAATDAAGEEKKEEAEEKKEEEAAAPADEPAAAAGESAPAPAEAEPPVEAAATPAAAEAAPAKAEEEEAPKA

SEQ ID NO: 8012 - protein, 155 aa, Anaplasma phagocytophilum
MYCCVLTYLVEYKGGTRVQERTLSILKPDVVERGIIGNVISYIEAAGLKVVAQRMCRLTVSQAEEFYDVHRDRPFFPELVKFMTSGPVVVQVLEGESAIAVYRDVMGATNPKEAAKGTIRADFAESIDANCVHGSDNADNAKREIMFFFGECEIF

SEQ ID NO: 8013 - protein, 438 aa, Glycine max
MVERLILDDLVHWAVNYKIDGFRFDLMGHIMKSTMVKAKTALQCLTKEKDGLDGSSIYIYGEGWDFGEVAKNGRGVNASQFNLPGTQIGSFNDRIRDAILGGSPFGHPLQQGFVTGLLLQPNGHDHGTGPLPRPPPPASMDHIQIGMAANLKDFVLTNSEGEEVKGSEILTYGGTPVAYASCPIETINYVSAHDNETLFDIVSLKTPMDISVSERCRINHLATSIIALSQGIPFFHSGDEILRSKSLDRDSYNSGDWFNRLDFTYNSNNWGVGLPPQEKNEKNWPLIKPRLANPSFRPQKTDILATVDNFLNLLCIRYSSPLFRLKTANTIQERVRFHNTGPSWVCGVIVMSIEDGHNGFPGLSQLDPIYSFIVVVFNASPKEVSFVSPALQLRNLQLHPIQVSSSDDLVKSSRYEASSGCFVVPRRTTAVFVEPRKT

SEQ ID NO: 8014 - protein, 200 aa, Glycine max
  misc_feature (147)..(147): Xaa can be any naturally occurring amino acid
MFTCIACTKQAAKEKEEEGESGTPSTNKEAVKSLSAQLKDMALKFSCAYKQCKPCTGSSTYKKGQRPYPDFDTISEGVPYPYIGRAISTSTPAWDFTSSNFLGARSDQRFMGGFSGDRTPRGPQSAPACDVVVEDEDETKEWMAQVXTRVHITFVSLPNGGNDLKRIRFSREIFDKWQAQKWWGENYDRIMELYNVQRFN

SEQ ID NO: 8015 - protein, 908 aa, Prochlorococcus marinus str. MIT 9515
MLNLEEYFPFPLDPFQIEAIKAINSGNSVVLTAPTGSGKTLIGEFAIYRALSHESRVFYTTPLKALSNQKFRDFINQFGEKKVGLLTGDISINRDAPILVMTTEIFRNMLYGEFEEFCDPLVNLESVILDECHYMNDPQRGTVWEETIIHCPSRAQIIALSATISNADQLQNWIEKVHGPTVLVNSDKRPVPLDFMFCSAKGLHPLLNNKGNGIHPNCKIWRAPKGQKKKGKVGRIMQPKVPPIAFVVSKLSERNMLPAIYFIFSRRGCDKAVEYIKDLSLVSYSEANLISQRLDVYLKNNEEGVKDKFHCEALKRGIASHHAGLLPAWKELVEELFQKGLIKVVFATETLAAGINMPARTTVISSLSKRTDEGHRLLFSSEFLQMSGRAGRRGKDLQGYVVTLQTRFEGAKEASTLAISQPNPLVSQFTPSYGMVLNLLQNYSLDKSRELIKRSFGSFLYLGESSEEMVILDNLEKDLQELKKITTNISWQDFDLYEKMKSRLKEERRLLRILEKQSAEKLSEEITSALTYIKDGSLISIKAPQIKRKVVPAMICKKIYESNKITSLLCLTIDNLFILIKPSYIVNIFPDLEEIKILKLEEPKMNFSGEVVRGNDESQTLAHKIFEISEKYDLRTPQYDLTTEVLEQRKLITNLDEKISNQPAHKFGDSKKLKRYRKRIIEIEQEIIRRNNLLEDKENHNWKKFTNLTKILNHFGCLNNLELTEVGQSVGAIRSENELWVGLVLLSGYLDDLTPPDLAAIIQAICVDVRRPNVWCNFKPSIKVIEVFNELEGLGKLVASKQKNFNIDTPIFLEIELTGIISEWASGKKWKELIFNTSLDEGDVVRILRRSMDVLSQIQYCVGVSNKLKQKAKLALKAINRFPVSESNDLLKVSDNINPATKRIDNNY

SEQ ID NO: 8016 - protein, 170 aa, Oryza sativa (japonica cultivar-group)
MAAAAQAPAAAKVVVATSPRAGGGGGGGGDRKVVPVVVAAAAGDEAQSEMHVLAVDDSSVDRAVIAKILRSSKYRVTTVESATRALELLCLGLVPNVNMIITDYWMPGMTGYELLKRVKESSQLKEIPVVIMSSENVPNRISRCLEEGAEDFLLKPVRPSDVSRLCSRIR

SEQ ID NO: 8017 - protein, 374 aa, Mycobacterium sp. MCS
MPNPLPLVFDAPRRAKPPRHFADLDATARAAAVAELGLPAFRAKQLATQYYGRLTADPQQMTDLPAAVREQVAEALFPDLLTAVREIETDAGETRKVLWRAVDGTTFESVLMRYSDRNTVCISSQAGCGMACPFCATGQGGLQRNLSTAEILEQVRAAAVELRDRDGEGIAPAARGGRLSNIVFMGMGEPLANYNRVIAAVRRIVAPPPDGFGISARSVTVSTVGLAPAIRKLADERLNVTLALSLHAPDDELRDTLVPVNNRWKVSEALDAARYYADVTGRRVSIEYALIRDVNDQPWRADLLGKRLHGALGPLVHVNVIPLNPTPGSEWDASPKPAEREFVRRVRERGVSCTVRDTRGREIAAACGQLAAEG

SEQ ID NO: 8018 - protein, 389 aa, Triticum aestivum
MASGTDEKAKMESLTSPAAFVEGGVQDACDDACSICLEAFCESDPSALTGCKHEFHLQCILEWCQRSSQCPMCWQPVSMKDPTSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSTQGEGADDLRILVPRVGDLPPHANPIEEAGNQSPGVLTYDAEQDAVVSSGNSTPVSSPRFFNRRHSSGQSTPVGNDRAGPSDVQSFSDSLKSRLNAVSLKYKESITKSTRGWKERLFSRNSSVSDLGSEVRREVNNGIASVSRMMERLETRGSGRPSYSPTTSTSEVCLTTEPSNERVTESNSNTTASTSNTSTPCVTTSGSN

SEQ ID NO: 8019 - protein, 812 aa, Candida glabrata CBS 138
MTASASVPNERSFSNDVTDPMQNINMFDKVQLTKLLIHTLRELGYDESAIKLQEESGGIQVESSIVQNLLKWIRAGSYHYISFVELAQLPLQNGRLTDDQRMAELVAHYQSFESNDAGYSEAKNSMKIENVITTPINTSRTIDRMSTNLEQFNDAIAQIQTLNLSSINIERIRAVLEISILICRQVFLELIFENKDFHTALILLRGTIRRYTEVWDSIDPKIEGLQDEQQTFAPEIILKDMSSLITCPNESIITGLWPNSLTKSRENLIQTISNYINPNDLVPKGRLLTLLRQAVKYQRSKDVFNFSDQEVSNGIEMEDISASKELNKYNLLQDNTSNFQKIAFENEKTLTQHSDEVWYLQFSPDGRYLASVSADATTDRKIYIYDVQNDFQVYKILSGNSQCILYLSFSPDSKLLVSCPFNAIVNIYSIHAEGEPIDINPESDNKIVAEVIKPIDSFYVLPGKEFKRNRSDSNNSMDGASRDVPSNQNRPQDLMATMESGSPLEPRSRSDSPSRHSINPVRIWCCDWFHTERHSGKFVVGSPDREVAIYDTNSSSVVFCFSQNTVIPSSIALQQNILGSSPISGGNALNNITRRDSTFSNNEIFPRVHDIKISNDDNSLILMTHQGKIDVYDISRLPSNNDNYFDIMAEYEKTIIPLASRLNVEKNMTCISIPKPGSFYDPALDSLLLVNLQSSEIQLWNYRENILIQKYFGQKQEQFIIRSCFGFENKLVASGSEDGKVYIWDRVRGNILGVLKAHVNDKPAQSNGNINSNNNKKNGKNCNTVVWNPADHNMFASGGDDGFIKVWKLVKD

SEQ ID NO: 8020 - protein, 103 aa, Glycine max
  misc_feature (18)..(18): Xaa can be any naturally occurring amino acid
  misc_feature (41)..(41): Xaa can be any naturally occurring amino acid
FSFSLAYHTYLSVDNINXVLLERLNTLVYLDHLYKRHRFTXQGDAHTFQSDCDTIYVTPPSLLGLVDHYNNRTIYSHYDAVSDAIVSNGSDITPIAVGGIIDD

SEQ ID NO: 8021 - protein, 220 aa, Pseudomonas aeruginosa PAO1
MRDIIDGFLRFQRDAYPARSQLFKSLATRQAPKALFIACSDSRVVPELLTQREPGELFVIRNAGNIVPGYGPQPGGVSASVEYAVAVLGVGDIVVCGHSDCGAMGAIASCACLDQLPAVAGWLHHAEAARAMNSAHEHASEAARLDALVRHNVIAQLANLRTHPCVARALEQGRLNLHGWVYDIESGRIDALDGASRRFVSLAEHPEVRAVGGEPGQAVA

SEQ ID NO: 8022 - protein, 415 aa, Thermotoga maritima
PEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMDLPFGGGKGGVRVDPKKLSRNELERLSRRFFSEIQVIIGPYNDIPAPDVNTNADVIAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKKAFNDVMKVKEKYNVDMRTAAYILAIDRVAYATKKRGIYP

SEQ ID NO: 8023 - protein, 1081 aa, Methanococcus maripaludis S2
MKREDIKKVMILGSGPIVIGQAAEFDFSGSQACKSLKEEGIYTILVNSNPATIQTDTNIADKVYLEPLNPKILEKIIEKEQPDAILPTMGGQTGLNLAMELSKRGILEKHGVELLGSTESVIETSEDRDLFNKAMEEINQPIAKSAAVHSVEEAIGATKELGYPAIVRPAFTLGGTGGGIANNEEELIEITKKGLKYSMIKQVLIDQSLLGWKEYEYEVMRDKNDTCIVVCNMENIDPMGIHTGESIVTAPSQTLSDEFHQKLRDASLQIIRHLKIEGGCNVQFAVNPEMTDYVVIEVNPRVSRSSALASKATGYPIAKIAAKIAIGRTLDEIQNDVTKETPASFEPTIDYVVVKIPRWPFDKFRTVDKKLGTSMKSTGEIMAIGRNLEEALQKAVRSLDIGRFGIIADGKDKEYSNSEIVDILEHATDERLFVIAYALDKGWSVDGICERTGINPFFIEKIKKIIDCKKELEVISRIPVDDEKLKEILLKAKSLGFSDVQISKIFSKTENEIRDLRKRLEVIPVYKMVDTCAAEFEAKTPYYYSAYERYFDEEQNESVSSDRKKVIILGSGPIRIGQGVEFDYSTVHAIFALKELGIEAIIVNNNPETVSTDYDTSDKLYFEPLVYEEIMNIIENENKNGQLLGVIVQFGGQTAINLAMKLYNSGVNILGTSPQSIDLAEDRDQFIHVLEKLKIPQADGATAFSEEQALKVVERIGYPALVRPSYVLGGRAMQIVYNTEDLKDYMREAVKVSSDHPILIDKFLEEAVEVDVDAVCDGESVFIGAIMEHIEEAGIHSGDSACVIPPQTLSKEVIEKIAEHTTKLALELGVIGLLNIQYAVKDGVVYIIEANPRASRTIPYVSKSVGVPLAKIATNAIMGKKLKEMGYFGLAKSKYVSVKEAVFPFLKLPGVDPVLSPEMKSTGEAIGIDQDFGKAFYKSQLSANMELPTSGTVFISVRNRDKDNITKIAKKYHNLGFEIVATRGTARELRLFDIPVREVRKISESMQNSVLDLMQKGEVDLIINTSSGDKAKTDGYFIRRAAVELNIPCMTTLQGAYAAIKAIEAIKSGELGVYSLNELEN

SEQ ID NO: 8024 - protein, 836 aa, Novosphingobium aromaticivorans DSM 12444
MMGSIVLSAPIAGWVSALDEVPDGVFSARLLGDGVAIDPVEGLLCAPCDGEILSVHAARHAVTMAGEGGVELLMHLGIDTVELKGDGFETLVRAGHRVVRGQPLLRFSLDDLAGRAPSLVSPVIVTNGDRFTISSCTVDALVAVGDDLIRLDPVGVAPSPDRAPVGEAVGAIVVVPLPNGLHARPAARLGEAARAFAAETRIVKNGRAVSTRSPVGLLGLSIQLGDEILVEASGPDASQAVAALVDLIRSGLGEGAEHDAAAEPRASSAGMPPFAPVPDGALRGNLASPGFALGTCHRLDRSEPELPVQGKGKEEERIRLLSAMDHLRSRLAISSEVSPKAAICSAHRALLDDPELEAAALSRIAEGEDAAHAWREACRASAVVLRGSGSARFAERADDVLDLGRQLVTILIGELDETLAFPPGTILLADELLPSQIMQLGAEVTGIALANGGPTSHVAILAASMGIPMLVAIGDALAGVRAGDKAILDADGGFLLPAPGAAALAEAEAEVAARQARRADALASASELCHSRDGARIEVFANLGSLDDARRAVSAGAEGCGLLRTEFLFLERESAPTVAQQAELYAGIADALGGRPLIVRLLDIGGDKPATYLPIAPEANPALGLRGIRVGLAHPDVLEDQLRAILSVERGGALRIMVPMVTGVAEVREVRQRVDRISAELGLAQRVEVGIMVETPAAAATAFLLAPHADFMSIGTNDLTQYVLAMDRDNPAVAGGIDGLHPAVLNLIAQTVRGAQSVGRWTGVCGGLAADRLAVPLLLGLGVTELSVPLRQLPEIKALVRGLSISDCKTLALEALQLESAAEIRALSRAFVETLP

SEQ ID NO: 8025 - protein, 666 aa, uncultured bacterium 560
MEFDANLIAPALGVLGLLIVFFIYQWIKKQPGGSGSVQKIGEQIHIGSIVFMKREYKMLSIFAFVLLVLLYIFLGPASALCFLVGAVASATAGYIGMNTATIANVRTAQAAHEEGSAAALTVAFFGGSVMGLSVAALGLLGLGGLYYFFGETHSEALHGFAMGASVVALFSRVGGGIFTKSADVGADLVGKLEAGIPEDDPRNPAVIADNVGDNVGDIAGMGSDIFESYCGSMIATIAIASTLSAVALDKLGNQSELMFLPLALASLGFVCSVIGIVFVKMSSNKSPESALRIGTIGSALLFIIASYFLINQLEVSNSIWAAVLMGSVGGIIIGLVTEYYTAGKPIRDIAESGKTGAATVMIKGLAIGMQSVVIPVLMICLIIYVANLFVGLYGVGIAAIGMLATVGMTMAIDAYGPIADNAGGIAEMSGLGEDTRKITDSLDELGNTTAAIGKGFAIGAAALAALAIITAYTETVSANSTDFILKLNSAEVLIGLFIGGTIPFLIAALTMTAVGDAAFEMIEEVRRQFKEIKGLLEGKAEPDTAKCIDIATTAALKKMILPGVIAISAPVLVGFLISPEALGGMLAGALLGCVLMALMMANAGGAWDNAKKHVEKGNFGGKGTDVHTATVVGDTVGDPFKDTSGPSMNILINVMAIVSLVIAPLL

SEQ ID NO: 8026 - protein, 411 aa, Zea mays
  misc_feature (275)..(275): Xaa can be any naturally occurring amino acid
  misc_feature (307)..(307): Xaa can be any naturally occurring amino acid
  misc_feature (333)..(333): Xaa can be any naturally occurring amino acid
MSTQTKRTAPPPPRPRRSPSLRLLPRYCYCTCLWFLLLLMLPASTRSQLQLDRIPSQFHHITSVTKTTHPVLLHLSQRSRSQLAAVRGHMEAPRANNGRKRKPTPPAGLGALHDDLLERVLARLPPATYFRLRAVCSRWRAAAASPTFLHACARVPSRDPWFLMLSDSDSGPRPPVAFDAAGRTWNRCHAAPGAAVPVAASAGLVLYRAPATGALTVANPLTGASRALPSPPQAARQLQAIAMYGAGGPYRVALFAGDLPDDLSMAVYDSSSDSXEGPLPLARRPGDSSCPDAPAPDDTVYFLSKSXGDVVSTNMQRSASKQNSSSMGRAPRXDGDADAAFAYFLSYSGTVVACDTARRTFAELPRILPVYFEYSIDVVACGAAAYAVVLSEYLGTASLRVWEFAGGAWRQ

SEQ ID NO: 8027 - protein, 113 aa, Oryza sativa
VGLLNQIAVAGKKIYSEEDRSKMPPELANALSHEREAVENSEIRQQALEAIYMIVLQDEGRRAFWSVNGPRILQVGYEDEEDPKVMEAYELIGSLLVGKGDDEQDQEQGGQKP

SEQ ID NO: 8028 - protein, 464 aa, Silicibacter pomeroyi DSS-3
MATITNHMPTAELQALDAAHHLHPFSANNALGEEGTRVITRARGVWLNDSEGEEILDAMAGLWCVNIGYGRDELAEVAARQMRELPYYNTFFKTTHVPAIALAQKLAELAPGDLNHVFFAGGGSEANDTNIRMVRTYWQNKGQPEKTVIISRKNAYHGSTVASSALGGMAGMHAQSGLIPDVHHINQPNWWAEGGDMDPEEFGLARARELEEAILELGENRVAAFIAEPVQGAGGVIVAPDSYWPEIQRICDKYDILLIADEVICGFGRTGNWFGTQTMGIRPHIMTIAKGLSSGYAPIGGSIVCDEVAHVIGKDEFNHGYTYSGHPVAAAVALENLRILEEENILDHVRNVAAPYLKEKWEALTDHPLVGEAKIVGMMASIALTPNKASRAKFASEPGTIGYICRERCFANNLIMRHVGDRMIISPPLVITPAEIDEMFVRIRKSLDEAQAEIEKQGLMKSAA

SEQ ID NO: 8029 - protein, 336 aa, Prochlorococcus marinus str. NATL2A
MKDKDINNDFNHIFPKDIRDDFLFSLDSYRLFLEGLSINPSLFYQKWSDVHLQSIIDKYWKPTQKSDWKWSLALPIFSLLENYINTFNKPIIIGFSGLPGSGKSTLGLWIDSVARELSLDIKVISLDDFYLPGHEMDVAMTGNPWNVPRGFPGSHSLDLLNQSLDVFLKTGVLNSPTFDKSLRDGKGDRSGWCDSQPRVLILEGWFVGCEAVSDLSKIDSMAADEFNLSLSQSEKDYRILIQESLFEYSHIWKKFEKIWHLKSSQFNNTILWKSQQEGEMIKLKGSGLKGNNLSNFIRMIQTSIPQQSLSFINSDTTVGINQDRRINFLKTSKYYF

SEQ ID NO: 8030 - protein, 273 aa, Oryza sativa (japonica cultivar-group)
MYYTRDEDLRLVSAWLENSTDPIEGNARKGDTYWRQVADTYNATTEDDRKRDPKHLKGHWHKHTRKVSAFNGIYVQLRDNYQSGRSEEMLMDQAMELYQSREGHPFTLGYWWKAVRDSPKWNAHICLLGHGPRKIRAEFDVNAPPVEEQPAQVRPAGIKRAKKGRQSDYSAELAELIKHLCKAHASQQEETASMKDFQQKLSGEKVEAATLNLQAAKEKTKAKLIDQQTKMLDKFTQMISVDTSSMEPWAREAHIKACTLMSDQLWGKGATLE

SEQ ID NO: 8031 - protein, 113 aa, Triticum aestivum
MAASASAAGGEPQKQFLSIIRDFAAEKSHGERTVSGLKRRLDDVVSASDAATAELEAAKRAREAAETELRGSEVHAFIADASIQALEATISRLQEEIAKLGSELEALKITVDI

SEQ ID NO: 8032 - protein, 348 aa, Prochlorococcus marinus str. MIT 9515
MKNLLGCSVKDLENVALNYGQAAFRGRQIYSWLYNYKNRSKSIDEINVLPLNFRNQLKKEGFIFGELILKEKYLANDGTLKLLLNTRDNESVECVGIPTEKRLTACLSSQVGCPMDCKFCATGKEGLKRSLKASEILDQILFIENEMNQKVTNIVFMGMGEPLLNIDELLFSIRSINEDFDVSQRRITVSTVAIPNMIRKLSEMSFQVLGKCQFTLAISLHASNQKTRETIIPSAKNYHIKYIIDDCREFVKKTGRRVSFEYLMLHGVNDKLEHADELSNLIKGFQCHVNLIQYNQIEEVEFKQTPSKNAQLFQNRLSNNGINVSLRKSRGSDRNAACGQLRQNAKIK

SEQ ID NO: 8033 - protein, 256 aa, Zea mays
  misc_feature (172)..(173): Xaa can be any naturally occurring amino acid
  misc_feature (177)..(178): Xaa can be any naturally occurring amino acid
  misc_feature (195)..(195): Xaa can be any naturally occurring amino acid
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRXXLALXXSVFYYEILNSPDKACNXAKQAFDEAISQLDTLGEESYKDSTLIMQLLRDNLTLWTSDLTEDGADEGKEAPKGEAGDGQ

SEQ ID NO: 8034 - protein, 188 aa, Arabidopsis thaliana
MDHTVCKQVQPVVRKAKKKHGKDEFDRIKQAEKKKRRLEKALATSAAIRAELEKKKQKRLEEQQRLDEEGAAIAEAVALHVLLGEDSDDSSRVKFGEEKGFTMDLFRDERTNYVPRQSCASYAVQGIGFVSNGYGLGDSNWSPFTRRGAWDNNMGISADLIAAQAVSALQISENADGNAFVFNGMFRG

SEQ ID NO: 8035 - protein, 366 aa, Escherichia coli
MLPLHLLPVNRWKSLKLTLHHRKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 8036 - protein, 710 aa, Methanococcus maripaludis S2
MEFDEEVFLTLYGDKLKKYMKDQISQKMVKNNVFEFDIGEFLKNYSDSCDINDQIIENPKLVEDPLLYVFKESYIDLFGEDEHVKKELEKTQIAFKNPLGCDKKIDEITSSEMNRLVKFEGNIIKAAKVCALLKKACFVCRACGEISYKTIHDYFEQPRSYCKNQNCRSEMSIDYDSSAYVNIQELEIQQPIDLMRNPDDPPRSIRVFLENSDGIYSGRVDVVGTVMKKLTRPNMPVFEIYAKSNHVKLGESFQKIEVKDIINNYDLINTLDELGKKENIIDILSNYLIPQIKGYDLVKKSIFLQQVKACTKFLPDGSELRKDSHILLITDPGIGKSTMLRKISRLFPQNSYASVTTATGGGLTANVVREATEIGDGWVVKPGVFVRANEGTACIDELTVDKNVMKYILEAMESQTIHVNKGGINVKLPARCAVLAACNPKRGRFDRNMGVVEQIGIPAPLLSRFDLIFPLKDSPDRRRDAEIAEHILDTHVETATKNYSKVLGSIKVDGITVDENLIKNYIIYARTCAYFDENHHLYAGEVDERKIKSPPLSKGAKKLIRDYYVDMRKLGEGNNPVPVTARQLEAAIRISEMHAKARLSRKVEEKDAKIAIDIIEECLRQVAYDPETGKFDIDKGMGEIPKSKVDKMDKIVDIIRELSVLSSNGLADECDIVEKASEFQISEKDVSDMLSKLKKSADVFSPKYGYYRLT

SEQ ID NO: 8037 - protein, 369 aa, Ostreococcus tauri
MPEVDVVSLRFPLRARMSRVASKLAHAQGSSGLPGAVQTKTLVAADIGGTNARFQIWSTSTGVQKHEELLYEKTYDACQFETFDMCFRKLCEDSGLTVFDSSCFAVAGPVKNSRCEMTNLNWRLDSVAIERSFRIPKVSVINDFAAIGYGIMGLDPSQLVALNDVSAEERGPIAIIGPGTGLGEANMLWNDSKQSYEVIASEGSHALFAPKNQIGVQLLEYMWVQNLQVCEVEHVCSGPGLRNIYRFLCRKNDIKCDEIEPAEISARALSKSCDVCVATLNIFLEILGSECLGAALRVLATGGVYIAGGIPPKILPLITETPVLIKAFENCSPPMRDVVTRFPLKVVSDPNVGLLGAKILAKQQISVIL

SEQ ID NO: 8038 - protein, 425 aa, uncultured bacterium 560
MTIKQIKAREVLDSRGNPTVEADVILSNGVFGRAMVPSGASTGQREALELRDGDKNRYLGKGVTQSVNNINHEINNALVGMKISNQQAIDQKMIDIDGTETKSRLGANSILAVSLACAHANANNNKQSLFRSFDFSETYQLPVPMMNIINGGEHANNSIDIQEFMIIPAGAPNFREALRYGAEVFHHLKKLLDQEGLNTAVGDEGGFAPDLSSNEEALKIIIKAIKSAGYKAGKDIFIGIDAASSEFYNNGTYNLSSEGLKLSNEEFTSYLASWVEKYPIISIEDGMDENDWSGWEMLTKKLSDKVQLVGDDLFVTNSKILARGIENNIANSILIKVNQIGTLTETFNAMKMALNAGYTCVMSHRSGETEDTTIADLSVATGCGQIKTGSLSRSDRLAKYNRLLRIEEELGDDAFYPGINAFKHL

SEQ ID NO: 8039 - protein, 423 aa, Aspergillus oryzae
MADLRGRKIFKVFNQDFIVDERYNVTKELGQGAYGIVCAATNIQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKIPFQRLFPSANPDALDLLDRMLAFDPSSRISVEEALEHPYLHIWHDASDEPTCPTTFDFHFEVVDDVQEMRRMIYEEVVRFRAAVRQQSQAQAAAAAQQQQIAQQTNVPIPENQQGVWKQEEPKPQEALAAGGGVHNDLESSLQRGMDVQ

SEQ ID NO: 8040 - protein, 233 aa, Triticum aestivum
  misc_feature (199)..(199): Xaa can be any naturally occurring amino acid
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICAWCGFIILGIVIXVGGVGDQGYIGVKYWQDPGAFTSFKGFCAVFVVA

SEQ ID NO: 8041 - protein, 415 aa, uncultured bacterium 560
MESLSTFWLSVLLFALILASAFFSGTETSMMAMNRYRLKALSAKNNPQAKRVEKLLKNVDYLIGAILLGNNFVNILAASIATILALKLWGEGSVIIASLVLTLVILIFAETTPKTFAAKNPEKIALPASATIELLIKLFRPVIWLISYISQTILKPFGLKHSSKDNLNSEELRMAVVDSKSIVSKNYQKMLLNIIDLEKVKVEDIMVPHNELVSVDINNEVELFDQLKRIQHTRLLIFEGSENNIIGTIHMRDVVNLYAKNEITMTTIKELIREPYFIPEGTSLSMQLEHFKNQKRRLGLVVDEYGEVKGMAVLEDILEEIVGQFTSNQGETIEEINQQEDGSYLVDPRISIRELNKTLKIKLPYDSAKTLNGLILENLQSFPQHSVSLKIEPLIIEIVQVSKQGIRLVRIKKIY

SEQ ID NO: 8042 - protein, 175 aa, Triticum aestivum
EYALKSQFDTNIYLQNVFLYGYGAIFNLLGILGTVIFQGPESFDILRGHSRATFFLICNNAAQGILSSFFFKYADTILKKYSSTVATIFTGLASAAFLGHTLTINFLLGISIVFISMHQFFSPLAKVKDDKPAGTLELGDAQKHRSSDSSFVNMTAGAADDASHISDDRKPLLPI

SEQ ID NO: 8043 - protein, 103 aa, Zea mays
MSGRGKGGKGLGKGGAKRHRKVLRDNIQGITKPAIRRLARRGGVKRISGLVYEETRGVLKIFLENVIRDAVTYTEHARCKTVTAMDVVYALKRQGRTLYGFGG

SEQ ID NO: 8044 - protein, 274 aa, Zea mays
MGKTLLEFQPNKGDVLPSHKFGTHDVVALKPNKADAGSASLGQGVVYRLKDSSITEAYGEEITSMLTVQYRMHEHIMSWSSKELYNNKIKAHSSVAGHMLYDLEEVTRSSSTEPTIVLIDTTGCDMEEVKDEEESTMNEGEAAVSIAHAKLLVESGVNASDIGIITPYAAQVTCLKMMRNKDAKLKDLEISTVDGFQGREKEAIIISMVRSNSKKEVGFLSDHRRMNVAVTRARRQCCLVCDVETVSSDRFLKRLVEYFEENGEYLSASEYQSS

SEQ ID NO: 8045 - protein, 802 aa, Candida glabrata CBS 138
MVFPILPVFGKDLNLASRPYIKLVNQAVLDYTVSKEDIIKFVKDSQLLFVGTLLSSGKFKDDEVIEILNNGVAVLFIEDHSYAGYLVTEVGIPQERISVLNENVYETHFVIVNKFNAKTQLVPVEEITSSTLSQTLIDSLKTDRADGLYTTLVVDSQERCLGLVYSSKESIQMAINEESGIYYSRSRDEIWVKGATSGNTQKLLSISVDCDGDALKFVVDQQGKDRSFCHLNTESCFGGFTHGLASLEQLLRDRFESAPEGSYTKRLFNDPELLNAKIKEEAEELTEAEDKNEISWEAADLFYFALTKLVANNVSLKDVESNLNMKHLKITRRKGDAKDKFIKKQEPQAQNDEELSSKPIHLNVVKTSNKKEVEAALTRPIQKTSEIMHLVNPIIEGVRSKGDKALIEFTAKFDGVQLQSPVLEAPFPPEYFEGLTEEMKESLDLSIENVRKFHAAQLQTEDLEVETQPGVLCSRFPRPIEKVGLYIPGGTAVLPSTALMLGVPAKVAGCKEIVFASPPRKSDGRVSPEVVYVAEKVGASKIVLAGGAQAVAAMAYGTESVPKVDKILGPGNQFVTAAKMYVQNDTQALCSIDMPAGPSEVLVIADNNADVDFVASDLLSQAEHGIDSQVILVGVELTDDKIQQIQDAVHRQALELPRVDIVRKCIAHSSIIVCDSYQSAFDMSNRYAPEHLILQIENAKDYVKLVDHAGSVFVGAYTPESCGDYSSGTNHTLPTYGYARQYSGANTSTFQKFITAQSITPEGLDNIGRAVMCVAKVEGLDGHRNAVKIRMSKLGLLPKDFN

SEQ ID NO: 8046 - protein, 466 aa, Bacillus halodurans C-125
MTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRYGLVSVNLDKNGERTIKKSGKWYKTLSENNGF

SEQ ID NO: 8047 - protein, 356 aa, uncultured gut microbe of Zootermopsis angusticollis
  misc_feature (153)..(153): Xaa can be any naturally occurring amino acid
IGAANNLLAAMVDNHIYQGNKLNIDPRRITWRRCVDMNDRQLRFVVDGLGGKANGSPREDGYDITVASEIMAILCLSSGIDDLKKRLASIIVGYTYGKDAEAKPVTAGQLNAQGAMAALLKDALKPNLVQTLEHTPSFVHGGPFANIAHGCNXVMATRLALKLGDYVVTEAGFGADLGAEKFLDIKCRFANLTPSAVVIVATVRALKHHGGVAKADLNKENLQALEKGLPNLLQHIDNITKVYKLPAVVAINAFPTDTKAELDLVEKLAREKGANVVLSEVWAKGGEGGRKLAEEVVRLTEKPSNFTFCYDLNIGIKEKIEAIAKKIYHADGVNILPAAQKQADQLEKLGYGKVPI

SEQ ID NO: 8048 - protein, 358 aa, uncultured gut microbe of Zootermopsis angusticollis
  misc_feature (354)..(354): Xaa can be any naturally occurring amino acid
IGAAINLLAAMIDNHIYQGNKCNIDPRKIIWHRCIDMNDRQLRFVVDGLGGKANGASREDWFDITVASEVMAILCLSKDIDDLKARLGKIIVGYTYGKQSDGSEKPVTAAQINAQGAMAALLKDALKPNLVQTLEGTPAFIHGGPFANIAHGCNSIMATRLALKMGDYVVTEGGFGADLGAEKFLDIKCRFAGLKPSAVVIVATVRALKSHGGVAKADLEKENLSALEKGLPNLLQHVENITKVYNLPAVVAINAFPKDTKAELDLVEKKCKELGVNVALSEVWAKGGEGGVKLAEEVVKLCEKPNNFTFSYDEKASIKDKIEAIAKKIYHADGINILPVAQKQIAQLEKLGMXKVPI

SEQ ID NO: 8049 - protein, 405 aa, Glycine max
EFGTRGERRLEAGAMVLADRGVVCIDEFDKMNDQDRVAIHEVMEQQTVTIAKAGIHASLNARCSVVAAANPIYGTYDRSLTPTKNIGLPDSLLSRFDLLFIVLDQMDPDIDRRISEHVLRMHRFRSAVDGGEAALDGSSRYGREDEADMDSSVFVKYNRMLHGKKTGRGQKRDTLTIKFLKKFIHYAKHRIQPELTDEASENIATAYAELRNSSSNAKTGGTLPITARTLETIIRLSTAHAKLKLSREVSKSDVEAALKVLNFAIYHKELTEMEEREQERERELDRKRKADHDENDGPDRGPKDRRGPKDKRGPTSTDAMEVDDNSATHAAVGPTPERIEEFNSLFNQHMHANRLEQITIANLGNVINRGEDPPSYSAADVLLLLERLQDDNRVMITDGVVHMIS

SEQ ID NO: 8050 - protein, 210 aa, Brassica napus
KAWVDHLFHRIWPPSCVNYSFWPKNPPEYREVNEEYALHVKKLSETLLGILSEGLGLRREALREGLGGDLAEYMMKINYYPPCPRPDLALGVPAHTDLSGITLLVPNEVPGLQVFKDDHWFDAEYIPSAVIVHIGDQILRLSNGRYKNVLHRTTVDKDRTRMSWPVFLEPHREMIVGPLPELISDDNPPKYKPFAFKDYSYRKLNKLPLD

SEQ ID NO: 8051 - protein, 447 aa, Zea mays
MREQQRAMDPCPFVRVLVGNLALRMPVAPPASGAGAGVHPSTSACYCKIRLGKMPVQSVPAPLVVTDGGEQTPASGALAAAFHLSKADLEWFDGKPSLFSSRRGAGEASLKVSVYAGRKGSACGVSSGRLLGKATVPLDLKGAEAKPAVLHSGWISIGKRAGKGSPAAAAELCLTVRAEPDPRFVFEFDGEPECSPQVLQVRGSMRQPMFTCKFGCRSNSDLRRPGMRRERDAASAKERKGWSVTVHDLKGSPVAMASMVTPFVPSPGTDRVSRSNPGAWLILRPAADGAWEAWARLECWRDRRGAGASDSLGYRFDLLVPGVDHAAVALADSSIPSSKGGKFAIDLTAAQPLSRGGTPGCSPRGSGDLSKWPLGNYRGFVMSAAVQGEGRCSKPTVEVGVAHVGCAEDAAAFVALAAAVDLSMDACRLFSHRLRKELSHPQADLLR

SEQ ID NO: 8052 - protein, 511 aa, Rhodobacter sphaeroides 2.4.1
MHSARPSGQPQIHCPREDQMLDSVTDLRSLLKDPSLLETRAFVAGEWVDADDGATFEVTNPARGDVICTVPDLGRAETARAIAAAEEAMKEWAARTGKERAQVMRKWFDLMMANQDDLGAILTAEMGKPLAEAKGEIAYGASFIEWFGEEAKRIYGETIPGHMRDKRITVLKQPIGVVGSITPWNFPNAMITRKCGPALAAGCGFVARPAAETPLSALALAVLGERAGLPKGILSVITSSRSSDIGKEMCENPIVRKLTFTGSTEVGRILLRQAADQVMKCSMELGGNAPFIVFDDADLDAAVQGAMASKFRNNGQTCVCANRIYVQSGVYDAFAEKLAAAVKKLKVGDGLVEGTEAGPLINEKAVAKVEEHIRDVLDGGGQVLTGGKRHALGGTFFEPTVVTGVKQEMKVSTEETFGPLAPLFRFETEDEAVGYANDTIFGLASYFYARDVGRITRVQEALEYGIVGVNTGIISTEVAPFGGVKQSGLGREGSRHGIEDYLEMKYICLSI

SEQ ID NO: 8053 - protein, 340 aa, Cryptococcus neoformans var. neoformans B-3501A
MLPIQKDVSMGAEPLPIPISHLSTPIRHFTYITDSELGHGAPLSITHPLLPDCDHLKQPPSSPISSTGSGSSSDAEDVWTCTCTSYYESEKQTYLCSAECGDLCDCVAQFGNFYSSTNPQTLKLDALPDNWPLVECSPSCLCGLSCSNRVTQQGVRTPLTIRPTPPKGYGLFYTPSTPQFLPRGAFISLYAGEYILPSEIRSRWSPRSTTDLASDKEGYGEEGQGNYVLSLRLPDQTIHIDPRWKGNVGRFLNHSCGANCVVHYVKWGRGRGWPRAAIFTNRDIHPEEELTFDYANASGEPQRAIQLIQESKTKEDTKGRTRCLCGAEQCRGWIPFDETL

SEQ ID NO: 8054 - protein, 169 aa, Nicotiana tabacum
MSHYDNQFSAGQALQTDEYGNPIRQTDEYGNPVHHTGGTMGDYGTTGTGGAYGTHAGGGAGHTTGILGGEHRPGHEHGTLGGMLHRSGSSSSSSSSSEDDGQGGRRKKKGMKEKIKEKLPGGHKDDQTHSTATTTTTGYGMEGEHHHEKKGIMDKIKEKLPGHHGPGHH

SEQ ID NO: 8055 - protein, 208 aa, Nicotiana tabacum
MADQYEKKVEEGSANVEATDRGLFDFLGKKEEEKPTHAQEEHAISSEFVEKVKVSEEVAEYKEEEKKEEHNKEEKKLHRSSSSSSSSSDEEEEIGEDGQKIKKKKKKGLKDKIKDKISGEHKEEEKAGEDTAVPVEKYEETEEKKGFLDKIKEKLPGGGQKKTEEVAPPPPPAAEHEAEGKEKKGFLDKIKEKLPGYHSKTEEKKKKK

SEQ ID NO: 8056 - protein, 98 aa, Nicotiana tabacum
GTREEEKAGEDTAVPVEKYEETEEKKGFLDKIKEKLPGGGQKKTEEVAPPPPPAAEHEAEGKEKKGFLDKIKEKLPGYHSKTEEEKEKEKEKEVAASH

SEQ ID NO: 8057 - protein, 581 aa, Arabidopsis thaliana
MEIDSEISDSSSSNNSMIPPLPQNPILTVKLSPIILHVRRCSKNIKKKKRTRTPLKKKKKSISSSVESIIGVSFKSASQKHSTTVTRDGGVKKISSWVKSRLLGEGAYGCVYLATSKDDIYKTERAIKSADVLKAWSLMHEGRILRSLQSPFVIRCYGHEIAREGTGHQYNLILEYCSGQCLADMIEDNQGGIPEFDVKQFAIDVLSGLSYIHRRNIIHCEIKPDNLLLSPVDHRFRSNGFLTKIADFGLSMEKGSKEYGNGRGHMRGTTRYMAPELIGGGLVDFAVDIWAFGCSVLEMLTGKTVWGEHGDLVHDDWVDLIGHSDLTPQISTRLSAEAQDFLMRCLVKEPGSRWSIGELVDHLFLCSDVEFSHNVRSCTKYTKITDHPFVIKVNIDTKIIVVYESWLKIEKEKFKVYNYAHLVGFANTNLALPDVVEKILSIEGSNLSDPTSTNQIIVKLWLQPNVIVSLFLWAKTVSRLRAILTDPMSLTSIVLVTYVNPTILDENDLFTITDVTANTPKMEPTCIAKLCEFTSTRIQQVGSPHSNMVSEPGPHILNPIHIGPAQYLARRSMPKHIEING

SEQ ID NO: 8058 - protein, 354 aa, Triticum aestivum
MGSKGTFQMPVQELAGALGTPDVPAQYIARAQEEQQLAAVVVAPVPVIDLVRLSKHGDGTSDEAAKLRSAIKSFGLFMVSSHGIDAVMDNMMAASREFFRQPLEEKQRYANLNGGERFQFEGYGNDWVSSPDQIRDWTDRLYLKVEPEDERSIALWPAHPETFRNALHEYTKKCGEVKDDVLRAMAKLLELDDDDYFGEHFGEKPLTDVRCSYYPVCPRPELVFGLKPHSDATVVTVLMVDDRVGGLQVLKDGVWWDVPIVPHTLLMIIGDQTEIMSNGIFKSPVHRVVTNTKKGRLSVALDYYVDPEREIEPSAQLVNEKRPALYSKVKVKDYFARSYNAFTEGKMVIDTVKI

SEQ ID NO: 8059 - protein, 737 aa, Bordetella pertussis Tohama I
MSATSAPDTPTPFDDAWRQLAAAGLDDAGQRQLAHAAAWAWPRFEAQKALTGEPLASHAAGAVRILASLHTDQATRVAAVLASLPADLNAPAPTLRNDPVASEFGVEVARLVQGARALLRLGIVARHASDSEAESGSQKEMQRKMLLAMAADLRIVLMRLASRLQSLRWHAETKTPCAAGFARETLDLYTPLANRLGIWQLKWEMEDLAFRFLEPERYKQIAHLLEEKRVEREAFIAEAIARMQEALARAGVVAEVSGRPKHIYSIWNKMRLKGLDFSQMYDLRALRIIVDDVRACYTALGLVHEMWTPLPEEFDDYISRPKPNGYRSLHTVVTDAQGRAFEVQIRTREMHQFAEYGMAAHWRYKEAGARGGQVAASSEYDRQLSWMRQLLAWNSDVEDEGEAARRADQRIYVLTPQARVIELPAGATPVDFAYHLHTDLGHRCRGTRVDGQMVPLNTRLATGQTVEVIAAKSGGPSRDWLNTQLGYLASPRARAKVRMWFNAIELQQRITQGQALVEKELQRLGKTAVNLEQLAQGLGFARADDLYVAAAKDEFSLRQIDAVFQQPAPVAEPEPAALAHARSADSAEKSGKSGVLVVGVGSLLTQLARCCRPAPPDEIAGFVTRGRGVSIHRADCPSYKALAEREPERVIEVAWGKTSDSFYPVDISVRAQDRPGLLRDLSEVFARQRLNVVGVNTQSRQSLAHMVFTVEVRGGESLHKALDALGEVAGVTSAARR

SEQ ID NO: 8060 - protein, 194 aa, Brassica napus
HASGDDWLHELSKDHLTRLFHLLGTQLHYLWNTFLGFHRDNNTKILEYLRDVWRKDRRAEWSIWMVYSKVEMPHHFINSGMSDIINHSAHKRASSVLKLTDPAQLAANRAELHRRSIAQMRINNRSIQDMHILGDPMRVPIIIIERVLNAPRRTLSDNSYLRHVDMLDSGLLNAVNDDGEKTIATSSQKSAREL

SEQ ID NO: 8061 - protein, 639 aa, Triticum aestivum
  misc_feature (462)..(462): Xaa can be any naturally occurring amino acid
  misc_feature (491)..(491): Xaa can be any naturally occurring amino acid
MRSSWADSVANAEESAPATGAAPAPVANHQNSRPTRSSYVPPHLRGGGRSPENQVPAAAPTPAGAYPSGAVQPSGGYAAAVGGTRWAAPPGAGSAGVGVVRQGGGGRGAVGGAGGGWNSRPGGWGDRRDREPNPFGDSEPAAVDVDFESQQNTGINFDAYEDIPVETSGHDVPAAVNTFAEIDLGDALNENIRRCKYVRPTPVQRHAIPIVIGGRDLMACAQTGSGKTAAFCFPIISGILKSRPPQRPRARTAFPLALILSPTRELSVQIHEEAKKFAYQTGVKACVAYGGAPIHQQLRELERGVDILVATPGRLMDLLERARVSLQMVNYLALDEADRMLDMGFEPQIRKIVEQMDMPPRGVRQTMLFSATFPKEIQRLASDFLADYIFLAVGRVGSSTDLIAQRVEFVLEADKRSYLMDLIHAQKANDVPGKNSLTLVFVETKRGADALENWLYTNGFPXATSIHGDRTQQEREYALRSFKSGATPILXVATDVAARGLDIPDVAHVINFDLPNDIDDYVHRIGRTGRAGKSGLATAFFNEGNMSLARPLCELMQEANQEVPQWLERYSARSSFGGGGGGRNRRSGGGGGARFGGRDFRRDTRGGGGGGGGGYGGGGGGGGYGGGGGYGGGASSSWD

SEQ ID NO: 8062 - protein, 369 aa, uncultured gut microbe of Zootermopsis angusticollis
ITSANNLLCALLDNHIKQGNALGIDPTSITFKRVLDMNDRQLRFIVDGLQGPNTSKSTLNGVTREDGFDITVASEVMAIFCLATSIEDLKYRLGEIIVGKTYSGENVTAEELKANGAMTVLLKDAIKPNIVQSLEHNPVLIHGGPFANIAHGCNSVIATKTALGISESLTSSINDNNFVVTEAGFGADLGMEKFLDIKCRKADIFPDCVVIVATIRALKAHAGVPESEFTVSNPEAVKKGLPNLIRHLENIKNVYQLPRIVALNFFPTDTDEEIAVIKEACDELNVEVSVTKNHALGGEGAAQLAHEVVKLTSIGKPEPTYAYELEQSVQAKIEKITKRIYRADKVELTPAAKAQIKSIEDQGFGNLPI

SEQ ID NO: 8063 - protein, 360 aa, uncultured gut microbe of Zootermopsis angusticollis
IGAANNLLAAMIDNHIYQGNKCNIDPRKIIWHRCIDMNDRQLRFVVDGLGGKANGESREDWFDITVASEVMAILCLSKDIDDLKARLGKIIIGYTRGKQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVTVALSEVWAKGGEGGKALAEQVVKLCDQGKENDFTFSYDEKDSIKDKIEAIAKKIYHADGVIIQDNAKKQIAQLEKLGLDKMPI

SEQ ID NO: 8064 - protein, 468 aa, Pseudomonas aeruginosa PAO1
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVRSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 8065 - protein, 352 aa, uncultured gut microbe of Zootermopsis angusticollis
ISAANNLLAAMLDNHIQQGNELDIDIKNITWKRAVDTNDRQLRYIVDGLGGKAQGVPREDGFDITVASEIMAILCLATSISNLKERLARVVVAYNRSGAPVIAADLKAQGALAALLKDALKPNLVQTLEGTPAFIHGGPFANIAHGCNSVMATQLAIKLGDYAITEAGFGADLGAEKFLDIKCREANLKPAAVVIVATVRALKNHGGVAKADLNIENLEALEAGLPNLLQHVQNITEVYKLPTVVAINKFPTDTKAELDLVEASCRQLGVNAALSDVWERGGDGGVELAKEVIKLTQQDNDFEFAYSDELSIDQKITAIATKIYHADAVEFTANAQKQAQQLTDLGFSGLPV

SEQ ID NO: 8066 - protein, 672 aa, Arabidopsis lyrata subsp. lyrata
MEKDNHEDDGEDLPPEINQIKEQIEEERFLHIKKIFELRCIPSVAAHASHHQSFDLNQPLAEDDNEGDNKTLLSRMQNPLHHFSALSDSDTYEDQGCVFNKEAPLFPSINLPVVEQLPRSLTWVFIKSSQLMAESDSVIGKRQIYYLNGEALELSSEEDEEDEEEDEEEAKKEKCEFSKDVDRFIWTVGQDYGLDDLVVQRALAKFLEVEVSDILERYNELKLKNDETVGEASDLTSKTITTAFQDFADRRHCRRCLIFDCHMHEKFEPEFRPSEDKSGLFENEDREPCSEHCYLKVRSVTADHAVDNDNSISNKNVVSDPNTTMWTPVEKDLYLKGVQIFGRNSCVITLNILRGLKTCLEVYNYMLEQAQCTMSLVLHKTTKTKNQVNKKVSRKGTRSVRKKSRLRKYARYPPALKKTTNGEAKFYKHYTPCTCKSKCGYQCPCLTNENCCEKYCGCPKDCNNRFGGCNCAIGQCTNRQCPCFAANRECDPDLCRSCPLSCGDGSLGEPSEQIQCKNMHFLLKKNKKILIGKSNVHGWGAFTPDSLKKNEFLGEYTGELITHEEANERGRVEDRIGSSYLFTLNDQLEIDARRYGNKFKFLNHSARPNCYAKLMIVRGDQRIGLFAERAIEQNEELFFDYCYGPEHADWSRGREPRKTGASKRSKEARPTR

SEQ ID NO: 8067 - protein, 360 aa, uncultured gut microbe of Zootermopsis angusticollis
IGAANNLLAAMIDNHIYQGNKCNIDPRKIIWHRCIDMNDRQLRFVVDGLGGKANGESREDWFDITVASEVMAILCLSKDIDDLKARLGKIIIGYTRGRQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVTVALSEVWAKGGEGGKALAEQVVKLCDQGKENDFTFSYDEKDSIKDKIEAIAKKIYHADGVIIQDNAKKQIAQLEKLGLDKMPI

SEQ ID NO: 8068 - protein, 549 aa, Zea mays
  misc_feature (67)..(67): Xaa can be any naturally occurring amino acid
  misc_feature (91)..(91): Xaa can be any naturally occurring amino acid
  misc_feature (106)..(106): Xaa can be any naturally occurring amino acid
MAMASAACSCTDGTWWVYALPALLGSDTLCAHPALLAGLIFLATVSVALLAWATSPGGPAWTNGRGXASASLLSWDPVVCPCSAASSRCPXAAAPRPRRDGPRRRXPRAKELMAFSVGDTPAVVSSCPATAREVLAHPSFADRPVKRSARELMFARAIGFAPNGEYWRRLRRVASTHLFSPRRVASHEPGRQGDAEAMLRSIAAEQSASGAVALRPHLQAAALNNIMGSVFGTRYDVTSGAGAAEAEHLKSMVREGFELLGAFNWSDHLPWLAHLYDPSNVTRRCAALVPRVQTFVRGVIDEHRRRRQNSAALNDNADFVDVLLSLEGDEKLGDDDMVAILWEMVFRGTDTTALLTEWCMAELVRHPAVQARVRAEVDAAVGAGGCPTDADVARMPYLQAVVKETLRAHPPGPLLSWARLATADVPLCNGMVVPAGTTAMVNMWAITHDAAVWADPDAFAPERFLPSEGGADVDVRGVDLRLAPFGAGRRVCPGKNLGLTTVGLWVARLVHAFQWALPDGAAAVCLDEVLKLSLEMKTPLVAAAIPRTA

SEQ ID NO: 8069 - protein, 358 aa, uncultured gut microbe of Zootermopsis angusticollis
  misc_feature (5)..(5): Xaa can be any naturally occurring amino acid
IGAAXNLLAAMIDNHIYQGNKCNIDPRKIIWHRCIDMNDRQLRFVVDGLGGKANGASREDWFDITVASEVMAILCLSKDIDDLKARLGKIIVGYTYGKQSDGSEKPVTAAQINAQGAMAALLKDALKPNLVQTLEGTPAFIHGGPFANIAHGCNSIMATRLALKMGDYVVTEGGFGADLGAEKFLDIKCRFAGLKPSAVVIVATVRALKSHGGVAKADLEKENLSALEKGLPNLLQHVENITKVYNLPAVVAINAFPKDTKAELDLVEKKCKELGVNVALSEVWAKGGEGGVKLAEEVVKLCEQPNKFTFSYDEKASIKDKIEAIAKKIYHADGVNILPVAQKQIAQLEKLNMDKVPI

SEQ ID NO: 8070 - protein, 210 aa, Brassica napus
INLSFAPATGGSSLHAPSMDELRRAMEDVCLRQYKILDPNFSVTRFLNDIASSYLDLATKAEQPANQSPENLPSLTTNVDALKKSAAAMAFTAEGRNDLAAKVMKSADQSPESLRTTKVDVLSKSATATTANTSTDRNGHVRDDENSGVGESTGLVVVPECHISADELRMISSVIDITFGKETVEIPWVNEVNSKVPSPFRYMTQSLVYL

SEQ ID NO: 8071 - protein, 176 aa, Triticum aestivum
  misc_feature (164)..(164): Xaa can be any naturally occurring amino acid
MAPTVMASSATSVVPYQGLKSTAGLPVSRRSNGASLGSVSNGGRIRCMQVWPIEGIKKLETLSYLPPLSTEALLKQVEYLIRSKWVPCLEFSKVGFIFREHNTSPGYYDGRYWTMWKLPMYGCTDSTQVINEVEEVMKEYPDAYVRIIGFDNMRQVQCVSFIAXFKPPGCEESGKA

SEQ ID NO: 8072 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 8073 - protein, 196 aa, Ostreococcus tauri
MRPPSYRGARGSAGRTSTGGRSGLRFDGRGRGRGRSGQFRDEGPPSSLEEIGTFLHACEGEIVCLSTNKKVPYFNGAVYLENKTQVGKVEEIFGPVNDKMFTVKLIEGVNAESYEKGAKFYISPDKLLPVERFINPVRYIRSSILLMKAVLTYLSGSGGRASGRGRAGRAPGMRGGRGGRGTARGAARGRGGRSRF

SEQ ID NO: 8074 - protein, 454 aa, Salmonella typhimurium LT2
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGRGRGQNQGGAGRSQQPRRQDSGAAKAKPKPRTGEGKTAGDKARPPRRPRRITPAQ

SEQ ID NO: 8075 - protein, 1905 aa, Cryptococcus neoformans var. neoformans
MPDGSTSPREPANSTYSTHEPQSKRHSSPQSVAMPAAPRFHRQHTSSQDHGSSSTPISPAASSTGPLSPSIPPGSFVFPIRSVFQGMVHSDSSNGITEGHQQRKKDGLQRSSGSSSPLRSPALSDAHRFSTDAAGALHDEPDAGIQTIAQLLQQDRSAPLKEKGKHQPGVATFVGKAERDRNGSGGGETLKPSSPDASGHLGNSPITHSSSDSEHQKQQDVAKSSRSEEGTNDSPESSHGSGGTLKQATRTDLPAALQRSSTVKGKVSASGLTKPSPSNYRHFPSEHHSGQRERRFSTVNKVNPPSRNSSSHPVDASHPPNPELQHPVPRRNTRQQHTQDAEGNNRTSSHGSRTSLEVDESGMRSLISDMSGIVLLGEAGSWGSMGGSGVSGSKGTDGGTGTTGTLDSASIDSGHATGGRGQGDERQVTKASLAAKHGARQTSRQDSVRSFIQSQAGTTNLQDPNAPTLSPMPSGSPPAEGSQDATVSMEDSANNEKQREQQQEEGEAEQQGEEENGQVEQPVAASAEDAENPDEPAVTMRFEHVVTEEGHHIVAGREGRLRRCQDEPITTPGAVQGFGVLMVLEEDYETGNLEIRQVSEVNIFVIVMSKCTLSANGELQNSTEILGLSPKYLFRLDCFTRLLSSDQETILRDTLEYLPESYGGSNSVEDSGPSVFLLSGFGEPGSGVEEGETEGGPETEVRSTASSAGGKRKEWTCWVAAHRPEHRGWNKVNEIGEPIPPPDWIILEFELERDVYNPLVHPSENAETSTAAANSNARSLRPDSTAASVSASGSNSNSNTLSASTRSGERTLDSLTSTLAGGRAGVSAGLGPGTASSDASPGDLGSSASDFTSVPKQEARMGLDGLEMHIPLEKILESTTNHASPLRALERMRGTTVNASNEARSRGRGRGRGRGGRQRPIRTESGGTGTMDIFAVLGQINDQLVAAPDLDTFLKVAVGLMQDICRFHRVLIYQFDEQMNGLVVSELVEWGKTTDLYMGLRFPATDIPPQARELYKINKVRMLYDRSQTTARMVLRNKEDLDQPLDMTHCYLRAMSPIHLKYLGNMSVRSSMSISIMAFGQLWGLIACHSYGQHGMRVSFPVRQMLRLLSDSISRNIERLSYAQRLHTRKLISTIPDRSHPTGYIISNAGDLLQIFGADAGLLVIGDGCKLLGHNEQGQAMLAIAEYLRIKRFDNLNASSSIQRDFPDLVLPRASDTIAGLLYVPLTAKAGQDFIVFLRKGQVREVQWAGKPYKDDKASEEASLEPRKSFKAWTETVTGCSRAWTDHQLESAGVLALIYGKFIQVWREKQTAMASNQLTAILLSNTSHAVRTPLSQIINTLELALAGNIDDDVRKMLENSHQASRALLFHVHDLLDLTRIETGNETAFNDPFDIRQSISDAVRLYQTEVARRGLEFRVNMAEDLPRYVVGDSRKIKTVISNLVANSVKFTEKGFIEVYCGIQRPFDGESSQTSLTESKEGNTITIEIVISDSGCGIPTVQLEEMFFTLEGAEPLQKNTGVGLGLAVVARIVEQLEGQLRAESEVGVGTRFYFNVPMVAHPSGRPGSRQSSHNSRNTNSSQLRTRTGSSGSKSDSVVSLRSDGSGVPEIESFVQDFGGSHLPAPVGDDDPRLLEAQERMSRLGTFPVTDSSYPVRATKVNTDDQHVKSPKPKKPRFTAIGSSERSTSRHNTTSSKTSSASQSPAFSRPSSNSVQGPKRNKKGPNGKTVMRIMVVEDDPINSQILQKRLKMDKHVVVAVTNGQEAVDQLEKDRDIDAILMDIQMPIMDGRTSAKEIRELEARTPQPDDIEPFKVDGRTPIFAVSASLYEDDRANLAENFDGWLLKPLDFSRVRAILEGLESSEKRGAEVYQQGNWERGGYLKAAPLPASSSASTPSTTQSSPCTSTS

SEQ ID NO: 8076 - protein, 119 aa, Vibrio sp. S14
YTKMKNKEQRFHSIMDIYAFRVLVSDLDTCYRVLGQVHNLYKPRPSRMKDYIAIPKANGYQSLTTSLVGPHGVPVEVQIRTEDMDQMADKAVAAHWTYKDGESSGTTAQVKAQPLDAKL

SEQ ID NO: 8077 - protein, 610 aa, Pseudomonas aeruginosa PAO1
MCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFVRLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLDDGRSPLFELVDAGRVRQALEQGTPLPSPRASASPTAGLAYLLNLDRWLTRHGVDISL

SEQ ID NO: 8078 - protein, 534 aa, Oryza sativa (japonica cultivar-group)
MGNSCQNGTYGNNYQNSNRFQNDRFASRYVDGNDTEDCYSGSSRASLAGALRQGLNLKSPVLGYKTPNVRELYTLGRELGQGQFGKTYLCTEISTGCQYACKTILKSNLRCVSDIEDVRREIQIMHHLSGQKNIVTIKDTYEDEQAVHIVMELCAGGELFSKIQKRGHYSERKAAELIKIIVGIIETCHSHGVMHRDLKPENFLLLDADDEFSVKAIDFGLSVFFRPGQVFREVVGSPYYIAPEVLEKRYGPEADIWTAGVILYVLLTGVPPFWADTQSGIYEKVLDGRIDFKSNRWPRISDSAKDLIKKMLCPYPLERLKAHEVLKHPWICDNGVATNRALDPSVLPRLKQFSAMNRLKKLSLQIIAERLSEEEIVGLREMFKAMDTKNRSVVTFGELKGLKRYSSVFKDTEINDLMEAADDTTSTINWEEFIAAAVSLNKIEREKHLMAAFTYFDKDGSGFITVDKLQKACMERNMEDTFLEEMILEVDQNNDGQIDYAEFVTMMQSNNFGLGWQTVESSLNVALREAPQVY

SEQ ID NO: 8079 - protein, 225 aa, Triticum aestivum
  misc_feature (126)..(126): Xaa can be any naturally occurring amino acid
  misc_feature (209)..(209): Xaa can be any naturally occurring amino acid
MMMGTDVCSSRMLSLPRYESGDEELTVLPRHTKVVVTGNNRTKSVLVGLQGVVKKAVGLGGWHWLVLKNGVEVKLQRNALSVLEAPTGNEDDDEIDGGNNSFCGSFDMGDKDMNYSSIEYQKPTKXPRVRHTRPWSSCTTTSSSRANLQSTSKLRARVNLTKLGTPTLWRYWKHFNLVSMNPTPSEEQLFHGGQQHFQSHHLDELQVIXGFIQTARRFRPLKKSS

SEQ ID NO: 8080 - protein, 159 aa, Zea mays
PHDLASLKEKLEQEAKENLGMAMVYTLVSSAKEWLSEIYGQNGGDEEPEETEAEEEVIRPHGEAVTVESFLAWRDRFEAELALQRAKLMPDSALTSSKEKKLTGRQYFESGRHAVKGASTVADEDEEEEEDIEFDDDFEDDEEDMLEHYLAQQSENSAA

SEQ ID NO: 8081 - protein, 103 aa, Neisseria meningitidis MC58
MASIHDQIKEVVTTHRVVLFMKGTKQFPQCGFSSRAVQILNAAGCTDYVTVNVLENPEVRQGIKEYSDWPTIPQLYVNGEFVGGSDILMEMYEAGELQELLKA

SEQ ID NO: 8082 - protein, 436 aa, Candida albicans SC5314
MEDKNAATQLNLPNVQSIGSHLSIQDHEIALQQVIDNPLSIGEVATTLTESQKWFVLKRLHFDALVSLEELPPQATFMFEKIEQMTIEEAVEILEKNIKEHETDVNIPENDLILWKELVEMSHKHTKAELQEKLGNNSSSSVEGEKTADVEQGHEIVDWGLQVRLEAVLVAYWSPYPEVRAVTFPYDDPTIPVETFRVYLIGIIWTAIGAVINQFFTERQPAITLAMAVVQVFLYPSGLLCEWFLPKWKFKIWKYTIDLNPGPYTYKEQMLATIFCGVTGGSTSYVSSNILMQKSEIFYDNKWVDFGYQVLLILSTNFLGVGFAGIMRKFAVYPTKAVWPSILPGLALNKTLLTPAKKEVINGWKISGYNFFFITFVASFLYFWIPDYLFQALSTFNWMTWIKPDNQNLAVITGSVGGLGLNPITTFDWNYFSSML

SEQ ID NO: 8083 - protein, 793 aa, Glycine max
MATKKVKAIGIDLGTTYSCVAVWQHNRVEVISNDQGNRTTPSYVAFSDTQRLLGDSAMNQRSMNPKNTVFDAKRLIGRRFSDQTVQQDMKMWPFKVVPGNKDKPMIAVTYKGEEKLLAPEEISSMVLYKMKEVAEGYLGHFIKDAVITVPAYFSNAQRQATKDAGKIAGMNVLRIINEPTAAAIAYGLDKKGLRVGEQNVLVFDLGGGTFDVSLVTIYEGMFKVKASVGDTHLGGVDFDNRLVNHLVNVFREKHKKDISGNAKALARLRSECEKAKRILSSTSQTTIELDCLYEGLDLYAPVTRALFNELNKDLFMKCMDTVEKCLLEARIDKIQVHEIILVGGSTRIPKVQQLLKDMFSVNGNTKELCKGINPDEAVAYGAAVQAAILSGEGDKKVEELLLLDVMPLSLGFEGAGGVMSVLIPKNTMIPTKKERICSTFYDNQKSFNVKVFEGERVKTKDNFFLGKFVLKGFDPLPKGVPQINVIFDVDADGIVEVTAEDKATGIEKKITINNKHGRLNPEEIRRMVRDSKKYKAEDELAKKKVKAKNALENYAYEMRERAKKIEEAVEETIEWLECNQLAEIGEFDYKKQELGRYLRDDPNYSNTSNSGVKVPIWCTWRCPPNGWVCLNTDGSVFENHRNGCSGSACGGLVRDSSGCYLGGFTVNLGNTSVTLAELWGVVHGLKLAWDLGCKKVKVDIDSGNALGLVRHGPVANDPAFALVSEINELVRKEWLVEFSHVFRESNRAADKLAHLGHSHSLESGAKRFSDPPSALVAILQDDLAGLAKQRGVN

SEQ ID NO: 8084 - protein, 344 aa, Cicer arietinum
GFREFKDDSDFDEDEEDDDDDEGLLVGGKGFTFSSNNTKSFKTFSRGSTAAKSVSPKSNEQAEKACKRKRKNQYRGIRQRPWGKWAAEIRDPRKGVRVWLGTFNTAEEAARAYDAEARRIRGKKAKVNFPEEAPVTSSKRFKPNLENKLVNKNLNSFNPNGNKMFNFGENVENYYSPMDQVEQKPLVNNNNQYANMGPFSGNGVQHSQISPSADVTAYFSSEHSSNSFDYSDLGWGEQGPKTPEISSMLSAAAPLESESQYVQNNMQSNNNQNMLPVEDNSAKTLSEELADIESQLKFFETPYDDNWGDASLASFLGGDATQDGGNPMNLWSFDDLPSISGGVF

SEQ ID NO: 8085 - protein, 550 aa, Chromobacterium violaceum ATCC 12472
MAAQRHIDINSTQVWAKLHQHQRATRHMHMRELFELDPQRFQRFSLELDGLLLDYSKNRVTERTLELLFDLARKADLRGWMDRMRSGERINVSENRSVLHTALRLPAGARLDLEGHNVAADVHQVLARLKDFSEQVREGRWLGFAGQPIRDVVNLGIGGSDLGPLVAADALAAYAHPDLKVHFVSNVDGQHLARTLERLNPATTLFIVASKSFTTPETLLNAQAARAWFLQAAGEAQIAKHFVAVSTNEPAVRAFGIDPQHMFGFWDWVGGRYSVWSAIGLPVMLSIGYDNFRAFLDGGHAMDRHFFESPFDANMPVLLALIGIWYNTFYRAHTHAIMPYDHGLRRLPAHIQQLDMESNGKRVGRLGEALDFDTGPVIWGEEGANSQHAFFQLLHQGTRLVPCDFILPLNSHYPLGNQHDVLVANCLAQTEALMRGKNEAEVMRELSHLSGEQLDMLLPQKLFPGNQPSNTLALDRVTPYSMGMLMALYEHKVFVQGVIWGINSFDQWGVEYGKQLARRILPELSGDTGALGHDSSTNGLIRHYRERHGK

SEQ ID NO: 8086 - protein, 499 aa, Oryza sativa (japonica cultivar-group)
MPAARRMRRAAAAAGVVERFAGMGSALAGVMFVWSMLSPLLPRQLFEHFVGRFLRRHARRLAGLVDPYLTVTISEHCGERMKLGDVYEQAKAYLSHRCARRARSLRAERAARDGGGDRFLLTMGDGEEVYDVFQGATVWWNSVSSGGGRRYESPWFGGGGVVYDDDRRAYRLLFHRRHRDLVVDSYLPHVCREGRAIMLRNRRRKLFTNAGGDRYRKSAWSYVAFEHPSTFDTLAMDPAKKKDIMDDLDAFRDGKDYYARIGKAWKRGYLLHGPPGTGKSTMIAAMANYLDYDIYDVELTSVATNTDLRRLFIETKGKSIIVIEDIDCSVDLTGKRKKRSPHAAAAAAEPVDAAKDESASKVTLSGLLNVIDGLWSACGGERIVVFTTNHVGKLDPALIRRGRMDKHIEMSYCCFETFKILAKNYLAIDAHHLFDDVRSLLQDARIKITPADVAEHLMRKCATAAADEAAACLASLVKALEKKAKGKETVEEEETVVDE

SEQ ID NO: 8087 - protein, 337 aa, Zea mays
PRRIDIYTQRSEHATNLTNSKAAKQIEHGMYNMNTSSINAASSWSIMKEEFTFQAHDRPFNNCHASTIVEVEKEIFLVSYFGGSIEGAPDVKIWTQRYSDGYWHPPVVADEENATAMWNPVLFQLPSHELLLFYKIGEHPQNWSGAMKRSLNGGMSWLEREQLPPGILGPIKNKPFLLDDGRLLCGTSVESWNSWGAWLEVTEDAGRTWSKYGPIFIQGEKLGVIQPVPYQTTNGSIRMLLRSHQTIGSVCMADSYDGGLRWSFARKSVLPNPNSGIDGIKMKDGRVALAYNTVSRGTLKVAVSTDDGLSWQEVVTLENAEGWEFSYPAVIQTQGRP

SEQ ID NO: 8088 - protein, 650 aa, Novosphingobium aromaticivorans DSM 12444
MNAPKITDRPVAADAVDRALLRQGVDEANIPALLMVLVQLTGDRRYLEPPYAPRRGKGLDDNDSGGLPDEIQHEVREAAWGAITGWLDGREPALARPSNPELAAMLAVAMTEAVPPEYGDIVAATMHLDPAPQPAAPSKPLKAIIIGAGISGMVASVRLREMGIEHTIFEKNNEFGGTWWENRYPGCGVDTPNLTYTFSFRPNDWSAFFPLRDEIENYLLETARESGLYDRVRFGTKVERAEWLADRNQWQVTVRAEDGSEEVHHADIVMSAVGILNMPVVPDIKGLSGFAGRVVHTSDWPQDIDLKGKRVAVVGNGASAMQVVPAIADQVAELTIFARSKQWAAPFPQFRKPVPNGVRYLMQVVPLYRAWVEQRLSWTFNDRVHGTLFRDPDWKEPARAVNAINDGHREFFTRYVREELGERQDLLPLVLPDYPPFAKRMLLDNGWYRTLRKPHVKLVPQRLAEVRGHTLVAQDGQEIEADVLILATGFQAANVLGSYDVIGRDGRDLHEFWEGDNAAAYLGTLVPGFPNFFILLGPNVGSGHGGSMIRNIENQAHYATRVIEALVKSGADAVEVREDVYGDYKARIDAAHEKLVWTHPGATNWYRNSRGRVVAITPWRNDAFWRMTREARPEDLSFSGAPTDKTEQAA

SEQ ID NO: 8089 - protein, 1609 aa, Arabidopsis thaliana
MDRISSLSNDIISNIVSFLSAKDAAVASVLSKRWQNIYTIVPNLEFDNTLENQGSLTDFLNGLLALPASTRIKNVSIKRRGRDGPNRDADLNRFLCNVLKRGVLKLKLDIWVTLDGRYSLPVEVFTCKTLVELELGSILQIDLVPENALLPALKTLIIDAVQFSDQSGCAFQKLLSSCPVLVELRMLNVQWEHWQWSRRVSSPTLEKLTMNHRYHFGNTYYDMEGITFDTPSLTSLKYYDLPPKSYPTVNLDSLVEATISLTLPLHHAWTGKHARRGDTVPSVTNLIKGLRNVETLNLSSTDTVAAFYFSNEAIPVFENLHRLSIATEREFCWRTLPYLLKKSPNLESLVIGGPLHYNYQLGDGYESEEIYSEDDDEEESESDDDEPICECLSDYSFLESCLVKTVEISEYSGTKIELKHMKHFLEKLSCLELVKVFSHERDEEEHVQLRTNLLNLPRSSKCKTQFEFIPPRSSDPTEAIEVYYFDSIPHIEEEGSSWVLRREGGSASSAAAIFFLPDLSGAGAGESLSDGADAEKMDLFSSLPDEVLCHILSFLTTKEAALASVVSKRWRNQFALVPNLDIDEEGKREREEILLSFMDFVDNVLALQADSPIKKFSLKCKTGVHPRRLDGWICNVLQRGVLDMDLYIDFDEESFLPRKLFFTWARLGPVLPMLKTLIIDSAWIRCDTIETFLPTFPVLEELSMSINEWPDWDETVTSASLRKLSIFTIGCENFSNPKSISFDIPSLVYFEYYDMVAEDYPKVNLTSVVEARISLLLDQDQIKRGRAPNNDEDDVLLRLRNGWKLMSGIRNVQKLYISLDTLQVLSLCCKSMPVFNNLKLLSVKTAENEGWEGMPVLLRNCPHLETLVFEGLRHFVTNKCGDACDYVSREDKGRSLVSCPVKKLQIKGFRGTIRELEMIKHFLYSFRCLEKVEIYAEEKGRTRTDLEVPGMFELIARMLRLYNEFYSCDVQFLKMDRVSNLPEEVRCHILSFLPTKHAALTSVLSKSWLNLWKFETNLDIDDSDFLHPEEGKAERDEIRQSFVEFVDGVLALQGDSPIEKFSLKCITGIHPDHVNRWICNVLQRGVSDLYLFTDFSDEDTEEDGGYRLPQEMFVSRTLVKLKLRSEHCVNWWHWDIGASLPNLKSLNIDSDLIFFGEMEKFLSSFPVLEEVHMANMEWRELDETMSSASLTKLSIHGTGVEEFEHPKSISIDTPNLLYLNYSDLVAEDYPLVKMGKSDQADKRTNLLEDDEGDVVLQFCNVVKLINGIQNIQTLYLTEDTLEVLTMCCESMPVFNNLKTLGLKSDEGRGWQAVPALLRNCPHLEFLIIEGLLHSVTDKCGDACDCISREDKGRSLISCPVKKLEVRGFRGTIREKEMIRHFLEYFPCLDEMEIDAEENDSTNFEVPRILKVVAYRLHDVVSTEIVGHWQSSAQSGGWSQTQMDEMYYELAPRNKERIYDMFFFMRRASSTVPPPPPQEMSQDYLQMQLEVADLKERQRDQEAKLADLKERLRAMLDMIVDQNPIIASALRAREATNSEREKASSGQEMTEKERDYDALFDIIVEQNPMLASAVRALRATDSERAETSSNQEMTELGQATATYFPPREGE

SEQ ID NO: 8090 - protein, 524 aa, Mesorhizobium loti MAFF303099
MSSVGAGFRLARAGWVLVREGVIAALPGEELSGLPKFGWQLARLFTRRRALAYQRSDRLAKAVVRLGPSYVKLGQFLATRPDVVGNDMALDLAMLQDKMHTFPKAEAVAAIEASLGRKVRDLYAEFGDPVAAASIAQVHAAEAIHDGVATKVAVKVIRPGVRRRFFQDLESYFLAARLQEKYIPSSRRLRPVEVTETLAQTTKIEMDLRLEAAALSELGENTKDDPGFRVPSVDWERTGRDVLTMEWVDGVKMNNIAGLEEAGHDLKAIAANLIQSFLRHTLRDGFFHADMHPGNLFVEANGTIVAVDLGIAGRLGKKERRFLAEILYGFITRDYLRVAEVHFEAGYVPRQHNVAAFAQAIRAIGEPIHGQPAETISMAKLLTLLFEVTELFDMATRPELILLQKTMVVVEGVARTLDPAFNMWKTAEPVVGGWIAGNLGPRIMMIDARDGAKALLTLARQAPELAARTDRLSREIDLMAEHGLRFDETTARAIGKAEARYSRSGRVALWVIALTLVYIAWKIL

SEQ ID NO: 8091 - protein, 938 aa, Bdellovibrio bacteriovorus HD100
MDNTNLKNAKPEVLDSIARRAHYLATQMIWQANHRTDKEKGDPKIGGHPAGCASSLHIMGALHLLVKSGFDHIANKPHASPTDHAYNYLLDNLLKSDLSKLSLEEANQAMHGLRKFSNGDEYVFQSYHSAYDPDQHNFFPSGSVGIPPVEAGYMALAYRYAAEHGYDVPKDAHFWAVCGDSEFREGSMYEAVPDFSEREIGNLTWILDYNRQSLDGHRLVNNAILGGTDADRVERTMAANGWEVIQVRHGGKREALFAKKEGEAFKNFLEKELTDYDLQALLLVHDLKLLKDTLMKDYPSLKKFLTATADQDVYEALRDFGGHDMMSLAKAMMKSKESKRKPTIIIAHTLKGWGLKAAAQQGNHSSLPHEDEVEELRAKQGITGNTLYARFDEKSVEGKFLAARGEKIYADIKAQNALKAKNQEFFLTKLAEFGDMPSSLEINTKMTSYPHTQWMLGQLTAKLTRISNTSLNESELKAGQKALTDNEKPFKLPGELFISMAPDVGTSTNLNPAMDGKIFGAQEVQDIEAELGVKDGKLPDLVPGEDVTDRFLRFEIAEGNVMSCVGAFGKMRDIVGVPIIPLMTVYDFFLKRALDQYFYNLYWKSSFICVGTPSGVTLSPEGAQHGWKSDVQIPNQITWEPYFCQELDWIMVDAIRRHVLNDNAGRSGVLLRLVTRGAEQKDFTKYLSKQARFKVGLEGKLSRAEFPVAGAVNEEEVAAMSEAEMFAVVREEVLKGAYFLIDYRGYAGYEPGDNVINIFAMGALVAEAMKASEALLARGIYANVIVVTSSDLLTGIQAHENDYHYLRNELGINADLYLKKAEEISSGDLITVAGRRIPIVSVHDGEAGLLDNLGSIIGVRQECLAVRKHSKCGRPSEIFKYHHLDDASIVEACGKVLSETALEKVMVSEQALGDANQASHKAAHWTDLWPSATHSQKH

SEQ ID NO: 8092 - protein, 571 aa, Oryza sativa
APPHPHEIAPHTKLLHSSCAIDSYVLHSRACACMAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 8093 - protein, 377 aa, Bacillus cereus E33L
MKAVTYQGPNQVQVKQVDDAKLEKKDDIIVKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 8094 - protein, 206 aa, Brassica napus
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTDPIYEGYALPHAILRLDLAGRDLTDYLMKILTERGYSFTTTA

SEQ ID NO: 8095 - protein, 531 aa, Oryza sativa (japonica cultivar-group)
MPSIRRLLLAGAAVAVVVVSCAVVCAEASVHEYAGERFAGVGNGFVLHGGSEGVYASATAESFVRFEKVAFRRTPEAASVAEEDGNRTVTVAAVIFEAGDRDAVGAVSDVVGGERALCCTPGMARRGGCTEGAVVYRAPASSNATGRWPKVLAASFLPGSLVAAFPDETVAVARTGMYSLHFVHCDASLAAGQVVAAEGKTIWKNSRGYLPGRMAPLKPFYGAMSLAFAALAALWFARYARFWREVSPLQNFATAAIALGMVEVTTWYLDLAEFDASGVRPAGTTFWAATSGAVRAAACRVLALLVAMGYGVTRPALGCGNARVAALGAAFLAAAEVLDVGDNVGIVSDHSPARRLFFILPVAALNTVFIYWIFTSLSRTISKLKARRMTAKLEMYRKFANSLTIAVALSLGWITFEVHFKTTDEHNERWRVAWVIPAVWELISFFLLCTICILWTPSQNSMRFAYSREECEDDTEHNDEDDDVEDTRPLIRAGPLSYVDNWACYVTQDAKIILRTDSGVYAKAGEEYKRV

SEQ ID NO: 8096 - protein, 111 aa, Ustilago maydis 521
MSQYVNVPKSELDQSQIRELEQYEISQGPLSVLQQSVRNHTQILIALRNNKKLLARVKAFDRHSNMVLENVKEMWTEVPKGKGKKPVNKDRFISKMFLRGDSVVLVLRNTA

SEQ ID NO: 8097 - protein, 491 aa, Pseudomonas aeruginosa PAO1
MHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLREKIRFHCEVEEARFDAGSGEWQVRCADGQTLRARALVCATGQLSRPLLPRLPGLERFQGPAFHSANWDAEVELAGKRVAVIGTGASAIQFVPRIAPQVQRLSLFQRSAPYVIAKPDRTYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQEQGLRYLDVKPEVQRRFNLEVQQGLRHTVWERGCDSWYKTAAGKNTNNWPGYTFVYRWRTRRPELADYDLAR

SEQ ID NO: 8098 - protein, 434 aa, Nocardioides sp. JS614
MVTRRPVAPHTAAVRISRRQLIGAASLSGLATATGVSRLLPAAAAPPPLPAPDASGIEHVVVVMMENRSFDHYLGWLPGADGKQAGLSYVDRKGVRHATHRLTAYDGCGFEDPDHSWEGGRIQLNNGLLDGFLKSGNNDLLAIGYYTDEDLSFYARAARDWTVFDRYFSAVMAETYPNRFYQHAAQTDRLHNNTDRSTLPTIWDRLAEKGLRGTYYYSDIPFTALWYEKHLDISQHFATFLLDAAAGTLPAVSFVDPRFLNEEGGTSNDDHPLADIRAGQSFLNQVYDAVRTGPGWERTVLVINYDEWGGFFDHVRPRRAPDVSRKTALRGFRVPALMISPLARRGHVSHHVYDHTSVLRMIEWRWGLRPLTPRDRYARNMAEALDLAGGPDTASSTYDVPDIAPVGCAPDETKSADWAALKHLARDLGWRLPR

SEQ ID NO: 8099 - protein, 305 aa, Mycoplasma mobile 163K
MIILGIESSHDDTSIAILENKKVLFQLSLSQVKTHEKFGGTIPEIASREHVKNINILLTMLIEKFDLSKLDYIAYTEKPGLIGALQIGFLFASALSISLNKKLIPINHLEAHFFSSEITNEILYPAVGLVVSGGHSLIYYVKNVNSLEIIGETLDDAIGEVFDKISRKLNLGFPGGPIIDRISSEIVGDIKFTIPKTERDLDFSFSGIKTQVINYINNSKNLDINNVASSFQKTTIDYIEEKLKLAIKKHHPQSLVVGGGVSANTELRKRLSTLHANVLFPKKEYTTDNGAMIAITAFLKLNKSS

SEQ ID NO: 8100 - protein, 265 aa, Zea mays
  misc_feature (45)..(45): Xaa can be any naturally occurring amino acid
MRDMPVVRRQEPTVVRTEDDVVSGGEDSDGEFEFPSVSRESAAGXWRAPRLADELFAGGHARAFYPVFGRVLDEAAAPAPRAPLGRLFQLEQARTSSVASTSSSSSSSSASTAAGTGADLDGVGASPDSYCVWTPGSSPASSPSRPPRKSGSTGSIARWRRIGELVVGRSRSDGKDKFLFLSAPPSPARDREHAPASKAKAKLPPKGSKAAATELDTVSAGRRLSYGGGGAKASTGGRRTFLPYRQDLVGLFASVHGLSRSPHPL

SEQ ID NO: 8101 - protein, 468 aa, Nicotiana tabacum
MGMKRVYTGFLCLLTVLILSSRAQLSDGGITSNYVRKYNSNVDMPLNSDVFRVPPGYNAPQQVYITQGDHEGKGVIASWTTPDEPGSNSVLYWAENSNVKSSAEGFVVSYRYYNYTSGYIHHCTIKDLEFDTKYYYEVGLENTTRKFWFVTPPKPGPDVPYTFGLIGDLGQTYDSNSTLTHYELNPLKGQTMLFVGDLSYADNYPFHNNIRWDTWGRFIERSAAYQPWIWTAGNHELDFVPEIGESKPFLPYKHRFSTPYRVSDSTSPLWYSIKRASAYIIVMSSYSAFGTYTPQWKWLKNELPKVNRSETPWLIVLMHCPMYSSYVHHYMEGETMRVMYEPWFVNYKVDVVFAGHVHAYERSERISNVAYNIINRKCSPVRDESAPVYITIGDGGNQEGLATEMTQPQPRYSAYREASFGHGILDIKNRTHAYFGWHRNNDGYAVEADSLWLFNRYWKLDGPSVSMS

SEQ ID NO: 8102 - protein, 390 aa, Thermus caldophilus
YATLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 8103 - protein, 499 aa, Citrus jambhiri
MNASMMMINSMSVSPDMPSSSPFQSQSISTPTSSPPSTSLPLRTIPGSYGWPLLGPISDRLDYFWFQGPETFFRKRIEKHKSTVFRTNIPPTWPLFLNVNPNVIAVLDCKSFAHLFDMEIVEKKNILVGDFMPSVKFTGGLRVSAYLDTSEPKHAQLKGFAMDTLKRSSKLWVSEVVSSLDTLFDTVEKELSEKNSISYMVPLQKCVFNFLSKSIVGADPKADAEIAENGFSMLDKWLALQIVPTVSINILQPLEEIFLHSFAYPFALVSGDYSKLHNFVEKEGKEVVQRGQDEFGLTKEEAIHNLLFILGFNAFGGFSIFVPKLINAIASDTTGLQAKLRSEVKERCGTSALTFESVKSLELVQSVVYETLRLNPPVPLQFARARKDFQLSSYDSVYDIKKGELLCGYQPLVMRDSKVFDDAESFKAERFMGKKGSELLSYLYWSNGPQTGTPNDMNKQCAGKDYVTLVACLIVAYVFQRYESITGNSSSITAVEKAK

SEQ ID NO: 8104 - protein, 166 aa, Medicago sativa
MASNNLSALIILFSLLAYSTFSHACGSCKPTPPSPPPPSKTPKACPPPPSTTPKASPPPKASTPPPTPTTPKPSPPTPSTSQKCPTDTLKLGVCADVLGLVNVIVGSPASSKCCTLIQGLADLDAAVCLCTAIKANILGINLNVPITLSLLLSACEKSIPNGFQCS

SEQ ID NO: 8105 - protein, 450 aa, Streptococcus mutans UA159
MTKQYDYIVIGGGSGGIASANRAAMHGAKVILFEGKQVGGTCVNVGCVPKKVMWYGAQVAETINNYAADYGFDVTTQAFHFDVLKQNRQAYIDRIHDSYERGFDSNGVERVYGYATFVDAHTVEVAGEHYTAPHILIATGGHALLPDIPGSEYGITSDGFFELDAIPKRTAVVGAGYIAVEISGILHALGSETHLFVRRDRPLRKFDKEIVGTLVDEMKKDGPHLHTFSVPKEVIKNTDNSLTLILENGEEYTVDTLIWAIGRAANTKGFNLEVTGVTLDSRGFIATDAFENTNVEGLYALGDVNGKLELTPVAVKAGRQLSERLFNHKPQAKMDYKDVATVIFSHPVIGSIGLSEEAALDQYGEENVTVYRSTFTSMYTAVTSHRQACKMKLVTVGEDEKIVGLHGIGYGVDEMIQGFAVAIKMGATKADFDNTVAIHPTGSEEFVTMR

SEQ ID NO: 8106 - protein, 473 aa, Photobacterium sp. SKA34
MATVITEERSNGTLSLEKSDLNKNVFIACLIAALAGLLFGLDIGVISGALPFIAKEFGLATHTQEWVVSSMMFGAAFGAIGSGPLSNKFGRKYSLVVASILFTIGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQVMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNSQTFWLYAVLNIIFLFVTLILIPETKGISLEKIEQNLMTGVPLSKLGKK

SEQ ID NO: 8107 - protein, 306 aa, Rhizobium leguminosarum bv. viciae 3841
MEMARMPRLGGAITALVTPFRHGGLDRPALRALAEWQILSGVDGLAVCSVTGEGPTLSPQERAEVIDLSIQSVTGRVPVIAATGTNSTESTIALTREAEALGAAAALVTVPYYSKPGQKGIIHHFEQVVAASGLPVIVDHAPAQTASDLSTKTLGSLAAIPGIVGIRDATGDIARFAGLSPILRQRFRFFSGHDPSALAFTIAGGDGAISPGANVLPRLFTSMQQAARAGNLSAARSLQDRLLPLISALGPEGDPARIKHALQLMRGLEAELRLPLVAVEPEMRFAIGKALAPFLDESSAGMGLSL

SEQ ID NO: 8108 - protein, 158 aa, Brassica napus
MDRVSNLPDEVLCHILSFLTTKEAALTSILAKRWRNLLAFVPSLTIDDTVFLHPEEGKQNRQDIIQSFMNFVDRVLALQCNSPLKKFSLKSFTVDDTDRVDGWISNALARGVSDLDLKIIIRSDKWNFYPMSPKCFECSTLVKLSIGCEVDVTLAAGR

SEQ ID NO: 8109 - protein, 962 aa, Hordeum vulgare
MPMPMRTMLLRHLSPPSAVPNPRRSSVSSPQRIPVRARPPPLHSARATALRARRRTPMAVGETGASVSAAEAEAEATQAFMPDARAYWVTSDLIAWNVGELEAQSVCLYASRAAAMSLSPSNGGIQGYDSKVELQPESAGLPETVTQKFPFISSYRAFRVPSSVDVASLVKCQLVVASFGADGKHVDVTGLQLPGVLDDMFAYTGPLGAVFSEDSVSLHLWAPTAQGVSVCFFDGPAGPALETVQLKESNGVWSVTGPREWENRYYLYEVDVYHPTKAQVLKCLAGDPYARGLSANGARTWLVDINNETLKPASWDELADEKPKLDSFSDITIYELHIRDFSAHDGTVDSDSRGAFRAFAYQASAGMEHLRKLSDAGLTHVHLLPSFHFAGVDDIKSNWKFVDECELATFPPGSDMQQAAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKVDGFRFDLMGHIMKRTMMRAKSALQSLTTDAHGVDGSKIYLYGEGWDFAEVARNQRGINGSQLNMSGTGIGSFNDRIRDAINGGNPFGNPLQQGFNTGLFLEPNGFYQGNEADTRRSLATYADQIQIGLAGNLRDYVLISHTGEAKKGSEIHTFDGLPVGYTASPIETINYVSAHDNETLFDVISVKTPMILSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTANDIKQRVRFHNTGPSLVPGVIVMGIEDARGESPEMAQLDTNFSYVVTVFNVCPHEVSMDIPALASMGFELHPVQVNSSDTLVRKSAYESATCRFTVPGRTVSVFVEPRC

SEQ ID NO: 8110 - protein, 375 aa, Oryza sativa (japonica cultivar-group)
MEDVRSTLLVQELAGMRSKSVPRQYIVQQEDQPTIAATASFPIVDLGRLSQPDGDANEAVKLRQAMESWGLFMVTNHGIEDALMDNVMNVSREFFQQHLGEKQKYTNLIDGKHFQLEGYGNDQVKSDTQILDWLDRLYLKVDPADERNLSVWPKHPESFRDVLDEFLIKCDGVKNSLLPSMAKLLKLNEDYFVRQFSDRPTTIARFNYYPQCPRPDLVYGMKPHSDATILTILMVDNDVGGLQVLKDGVWYDVPTKPHTLLINLGDHMEMGDGGILDVVTTMVASFSEPRLCGVAIMSNGIFKSSVHRVMTNPEKERISVVLFYFMNLEKEIEPALELIDERHPARYKRVKIMDYLAGLFEHFLQGTRVIDTVKI

SEQ ID NO: 8111 - protein, 126 aa, Zea mays
DARDIFASDSIELLRRSGIDLRLNAERGVDARRFAELLMSSGVVLNDSVYWVTFHAGYDFGLHGGLNKLAELLDVERVGESHQAGSDSLVTSCAFWKLKDSFFTGSTEKYAGVLYGLNAEIDVSAH

SEQ ID NO: 8112 - protein, 363 aa, Solanum lycopersicum
MESPRVEESYDKMSELKAFDDTKAGVKGLVDSGITKVPQIFVLPPKDRAKKCETHFVFPVIDLQGIDEDPIKHKEIVDKVRDASEKWGFFQVVNHGIPTSVLDRTLQGTRQFFEQDNEVKKQYYTRDTAKKVVYTSNLDLYKSSVPAASWRDTIFCYMAPNPPSLQEFPTPCGESLIDFSKDVKKLGFTLLELLSEGLGLDRSYLKDYMDCFHLFCSCNYYPPCPQPELTMGTIQHTDIGFVTILLQDDMGGLQVLHQNHWVDVPPTPGSLVVNIGDFLQLLSNDKYLSVEHRAISNNVGSRMSITCFFGESPYQSSKLYGPITELLSEDNPPKYRATTVKDHTSYLHNRGLDGTSALSRYKI

SEQ ID NO: 8113 - protein, 447 aa, Onion yellows phytoplasma OY-M
MKVIVVGCTHAGTAAVKTIKKNNPQADVVVYERNDNISFLSCGIALYVGGVIKDSLGLFYSNPDELVSMDVCTKLKHEVLKLNFDKKEVLVQSLETGKQFKDNYDKLVIATGSWPVIPPIKGIDCKNVLMSKNFDHAKDIINYSKNVNKITIVGAGYIGIELAEAFAVQKKEVVLVDAEDRIMSKYLDKEFTDVAQKTLTDHGVTLALGQKIAGFETKDGLVTHVKTDKNTFETEMVIMCISFKPNTQLFAHHLETSFNGALVVNEYMQTSDPDVYACGDCVNVYYNPTQEVKYMPLATNAIRMGTLVGLNIEKPCVKYLGTQGTSGIKIIDLSISSTGLTENVAKALGKNYGTVTIKDANRPEFMPDYDAVMLKLVFDKETRKILGGQIVSRVDLTEKMNTLSVCMQNQMTVEQLAFVDFFFQPHFNKPWGLLNLAGLKALEVKSQ

SEQ ID NO: 8114 - protein, 263 aa, Lilium longiflorum
MSPVESSRDESVYMAKLAEQAERYEEMVEFMEKVAKTVDAGEELTVEERNLLSVAYKNVIGARRASWRIISSIEQKEESRGNEDHVVLIKDYRGKIEAELSKICDGILKLLDSHLVPSAATAESKVFYLKMKGDYHRYLAEFKTGVERKEAAENTLLAYKSAQDIALADLAPTHPIRLGLALNFSVFYYEILSSPDRACNLAKQAFDEAISELDTLGEESYKDSTLIMQLLRDNLTLWTSDITEDAGDEIKEAPPKRDSVEGQ

SEQ ID NO: 8115 - protein, 110 aa, Triticum aestivum
  misc_feature (56)..(56): Xaa can be any naturally occurring amino acid
SEERVPEERNIKLLIAQMHVVKGDLDLASEKLRTLINEDPRDFRPHLCQGIVYALXDKKEEADEQFDVYRSLVPDEFPDKSFINDVILSAKVESKDRLQKDFRSEYLSKK

SEQ ID NO: 8116 - protein, 475 aa, Bordetella pertussis Tohama I
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLARFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 8117 - protein, 508 aa, Rhizobium leguminosarum bv. viciae 3841
MVMTVLVNPTALSDHKARDFKMFIDGRWEAGSSDPIERVAPSHGVVVSRFPTGSKKDAERAIAAARKAFDLGPWPRMTASERSAILLKAADLIAARAEELAFLDAIEAGKPITQVRGEIAGSVDIWRYAAALARDLHGESYNTLGDGTLGVVLREAIGVVSIITPWNFPFLIVGQKLPFALAAGCTTVVKPSELTSGSTLVLGEILEEAGIPDGVVNIVTGTGPEVGAVMTSHPDVDMVSFTGSTGVGKLTMSNAAQTLKKVSLELGGKNPQIVFPDADLDAFIDAAVFGAYFNAGECCNAGSRLILHKSIASDVVKRIAELSKAVKVGDPLDPSTQVGAIITPEHLEKISGYVAGARGSGARLAHGGETLDLGMGQFMSPTILEEVTPDMAVAREEVFGPVLSVLTFETSAEAIRIANSIDYGLSAGVWSRDFDTCLTIGRSVRAGTVWMNTFMDGASELPFGGYKQSGLGRELGRHAVEDYTETKTLNMHIGKRTSWWMPQTEKLA

SEQ ID NO: 8118 - protein, 377 aa, Solanum tuberosum
MADGEDIQPLVCDNGTGMVKAGFAGDDAPRAVFPSIVGRPRHTGVMVGMGQKTPYVRDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDSLMKILTERGYSFTTSAEREIVRDVKEKLAYIALDYEQELETSKTSSSVEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 8119 - protein, 154 aa, Oryza sativa
MASSSSPLTALYSSFLSYTPSTPSMAALPRRRRAGCRYPRIQAVDLDQNTIVAISVGVVSVAIGIGIPVFYETQIDNAAKRDNTQPCFPCSGSGAQVCRFCTGKGTVTVVIGGGETEVSNCVNCDGVGSLTCTTCQGSGIQPRYLDRREFKDDD

SEQ ID NO: 8120 - protein, 308 aa, Candida albicans SC5314
MSSISNVYHDYSSFSNATTFSQVYQNFNQLDNLNVFEKLWGSYYYYMANDLFATGLLFFLTHEIFYFGRCLPWAIIDRIPYFRKWKIQDEKIPSDKEQWECLKSVLTSHFLVEAFPIWFFHPLCQKIGISYQVPFPKITDMLIQWAVFFVLEDTWHYWFHRGLHYGVFYKYIHKQHHRYAAPFGLAAEYAHPVEVALLGLGTVGIPIVWCLITGNLHLFTVSIWIILRLFQAVDAHSGYEFPWSLHNFLPFWAGADHHDEHHHYFIGGYSSSFRWWDFILDTEAGPKAKKGREDKVKQNVEKLQKKNL

SEQ ID NO: 8121 - protein, 389 aa, Euphorbia esula
MEDASATTTAPSDSLNNHQLPPTAGIENIPATLSHGGRFIQYNIFGNIFEVTAKYRPPIMPIGKGAYGIVCSALNSETGEHVAIKKIANAFDNKIDAKRTLREIKLLRHMDHENVVAIRDIMPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEEELGFLNENAKRYIRQMSVFRRQSFTEKFPTVHPAAIDLVEKMLTFDPRQRITVEDALAHPYLTSLHDISDEPVCMTPFSFDFEQHALTEEQMKELIYREALAFNPEYQQQ

SEQ ID NO: 8122 - protein, 318 aa, Zea mays
  misc_feature (104)..(104): Xaa can be any naturally occurring amino acid
MACYNNTASLAATLLAFALMFQACVAGRRRLTALVQEPAITMKYHKAALLSGPIAVNFIWYGDFTAPQRAVITDFVSSLSAAPRAAAQSQPEPSVATWFKTARXYYASSKVPFPALRLGSHAVDRNCSLGRRLTERDLLRLAARGAPSRAINLVLTAADVAVDGFCESRCGTHGASPRSRSGRFAYAWVGNPASQCPGQCAWPFHQPVYGPQAAPLTPPNGDVGVDGMVISLASMLVGTVTNPFGNGFYYQEGSADAPLEAATACAGVYGKGAYPGYAGALLVDPASGASFNANGAHGRKYLVPALVDPDTSSCATLG

SEQ ID NO: 8123 - protein, 477 aa, Nocardioides sp. JS614
MADQTFKNVINGQLVDSASGETYDIVDPTTGEVYAQAPRSGAEDVDRAYAAAAAAFESWGSTTPKERSEALLKIADAIEARVEEINAVECKDTGKPIGLTMSEEMPYASDHFRFFAGAARVLEGRSAGEYMTDHTSWIRREPVGVVGQVTPWNYPLLMMIWKIAPALAGGNTIVLKPSDTTPASSTLLAEIAQEFLPPGVLNVVTGDRDTGRALVAHPTPQMVAITGSVRAGMEVAESASHDLKRVHLELGGKAPVIVFDDADIEKAAEGIAGAGLFNAGQDCTAATRVLAGAGVHDDFVAALTEAAKGMPTGDPTNEDTYFGPLNNQNQFDRVSGMVDRLPDHASVETGGARHGSVGYFYEPTVLSGLRQDDEQIQTEIFGPVMTVQRFTDEAEALRWANGVEYGLSSSVWTKDHARAMRMSRGLDFGVVWINTHIPFISEMPHGGFKHSGYGKDLSMYGLEDYTRIKHVMSYIGS

SEQ ID NO: 8124 - protein, 253 aa, Oryza sativa (japonica cultivar-group)
MRGEEEPAVAAAAYTTASKAGFLFFSAALTRLPTREEEISRRLLMELSPPNHESSPPTAGGGGGGGGDGAGGSSSAGASSSAGGGAATPQTPSRYEAQKRRDWNTFGQYLRNHRPPLGLAQCSGAHVLEFLRYLDQFGKTKVHTAACPFFGHPNPPAPCPCPLRQAWGSLDALVGRLRAAFEENGGRPESNPFAVRAVRLYLREVREHQARARGVSYEKKKRKKPQPADTSGGGGHPHPPPPPPPPPSAGAAC

SEQ ID NO: 8125 - protein, 339 aa, Haemophilus influenzae Rd KW20
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 8126 - protein, 334 aa, Rhodococcus sp. RHA1
MRASVLVEPGVIEIRERPVPTPAPGDVLVRVASVGVCGSDAHYYREGRIGEFVVEQPIVLGHEASGTVVGVGDGVPATRIGQRVSIEPQRPDPDTDESRRGLYNLCPHMQFYATPPIDGALAEYVTIGSAFAHAIPDEMSEDAAALCEPLSVAIATTRKAGVTAGSRVLIAGAGPIGIAMVQTALAFGATEVVVSDLDPRRRDVATKFGATAVLDPREQDVAGLHVDAFVDASGAPSAVLAGIQAVRPAGSVVLVGMGAPEMTLPVQTIQNRELVLTGVFRYANTWPTAIALARSGRVDLDSMVTGRFPLAEAEQALNADRTPGSLKAVVRVQE

SEQ ID NO: 8127 - protein, 456 aa, Nocardioides sp. JS614
MHPDYDHLQRAAKDHLWMHFTRHSSYAEADVPIIVRGEGAYIYDAKGKRYLDGLGGLFVSQLGHGRTELAEAAAAQARELAFHPLWSYAHPNAILLAERIAGYAPGELNRVFFTSGGGESVESAWKLAKNYFKLTGKPLKHKVISRAIAYHGTTQGALSITGLPPLKQQFEPLVPSTFRVPNTNIYRAPLHGEDPEAFGRWAADQIAVAIENEGPDTVAAVFLEPVQNSGGCFPPPPGYFQRVREICDEYDVLLVSDEVICAFGRLGHMFGAERYGYQPDIITCAKGITSGYAPLGAMIASDRLMEPFLRDAQMFAHGYTFGGHPVSTAVALKNLEIFEEEKVLEHVRSNEAAFRSTLERLHDLPIVGDVRGDGYFYGIELVKDKTTKESFTDEECERLLYGFVSKQLFAEGLYCRADDRGDPVIQLSPPLICEQSHFDEMEQILRVVLDKAGTLV

SEQ ID NO: 8128 - protein, 438 aa, Oryza sativa (indica cultivar-group)
MAKYGEGDARWIVQERADGTNVHNWHWAERDCLEWSRSRLTSLLAGLPVLSGEGGLALRTTALDKLDGEAYVNIRKGKVIPGYELSLTLAWEAEATTESGVVKVSGAAEVPYLADENADEDPELRVTVRGDDGPVARRAKDAFLTKGKPLVLEKIREYVAAMAKGGPAKDELDSKKTPTKAAAVEAGGAATAPAPAAEKKEEAPAVKEKKAKAKDKEGFKTIEMTEKFYCRAKDMYEILMDENRWKGFTQSNARISREVGGQFSLFDGSISGVNEELQEGKLIVQKWRFGSWPDGVHSTHFRQRVISMEACDCSSRLWGAVFMVGDSAPGTWHYATVFLGGSIFTCHLSMDGVGAGAAPVGGVCECRLSLRLPLLRAHSGEVRLVFDEPESGVTVISLKQTDVPEEDRYGNSTVVENTERGWRELIFQRIRGVFGFGI

SEQ ID NO: 8129 - protein, 307 aa, Rhodococcus sp. RHA1
MSLVIGEALIDIVTASSGATTEYVGGSPLNVAVGLGRLGRPVEFVTRIGDDTRGGAIVRHLEQSGVSLAPGSVTAQRTATAHATLDSAGSATYEFDIEWDLPSPSGSSTPALVHTGSIAAVMEPGCDVVADMLDRRRSSATISYDPNVRPVLITDKARARQRIEHLVSISDIIKVSDEDLRWYDPERDPDDIAREWLSRGPAMVAVTKGAEGAFAVCAAGLVEVAARNVEVVDTVGAGDAFMAGLLDGFWAHGFLGAESRDALHAIDPEEVRNVLDNAALMSGLTVARAGADLPSRETLDRAAGVRQ

SEQ ID NO: 8130 - protein, 230 aa, Rhodothermus marinus
MAENERPKTHEALKFYFTPVDPPRGDELNPHAKATTYVPEVVEALKERFGDVIEEVELYAGEHTVRVRADKIVEVCRFLKEEQGFNYLADLGGIDRFTDEGRFEVFYNLVSIERRKRIRLKVRVEEDNPVVPSVTSVYRAANWNERECYDMFGIRFEGHPDLRRMYMPEDFEYHPLRKEFPLLGIPGSLPLPPQTPGGPLTYDPFARAHGYVPPPGFEEPPAEDEEVSEH

SEQ ID NO: 8131 - protein, 335 aa, Rhodococcus sp. RHA1
MTPSTQIQLIKRPVGWPTQDDFRTATVELPDLGPDQVRVANEFVSVDPYMRGRMNDVKSYIPPFALGETMTGGAVGRVVESTAATHPVGSVVVHDLGWRDLAQGDASAFRVVDEIPGVPISAYLGILGLTGLTAYVGLVHVAHLKAGDSVFISGAAGAVGTAAGQIARLEGASRVIGSAGSAEKVALLTDRYGYDAAFDYKQAPVREQLRGLAGDGIDVYFDNVGGDHLEAALDVMRNGGRAALCGAISAYNATERTPGPDNMVNIISRGLTLEGFTLGNYTHVFPEFAAKMGPWLASGDVVHDETVVDGIENSVDAFLQLMHGGNVGKMLVKVA

SEQ ID NO: 8132 - protein, 131 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGYGGGGGHHGGGGHGLNEPVQTKPGV

SEQ ID NO: 8133 - protein, 441 aa, Rhodothermus marinus
MSTAPSLVGPDRHGLFNFWPRHNEAIYRRLETKHAWLEERHRPPGGDGEPDPLEHEMILNIGPQHPATHGVLRCIVKLDGEVMEKCVLDLGYLHRGLEKVAEHKTYQEFMPYTDRMDYLSPYSNNVAWCLAVEKVAGIEVPERAQWIRMIMCELARISSHLLWLGVGLMDAGAVSVFLWAFKYREEIYSIFDEVCGARFTVSHSRIGGVASDLSPTAIAMIRRFVEEFPEELAGWEKIINRNKIWIDRNEGIGVLTAEEAIELGVTGPNLRGSGVDYDIRRFEPYLKYDEVDFNIPIRTEGDSLARYFVRMEEMKESVRIIRQCLERLPEGPIRNDNAKLAYPSKEEVYYSMEGMIHDFLYTDVGVCPPKGAHSYHAIEAPKGELGFYIISDGTGKPWRVRIKAPSFSNLQGLEYMMEGAMIGDMVILIGTIDPVMGEADK

SEQ ID NO: 8134 - protein, 605 aa, Onion yellows phytoplasma OY-M
MNIEQLKERQKRIRNFSIIAHIDHGKSTLADRILEFTGTIDKRIMKEQILDSMDLERERGITIKLNAVEINYKSKDGKNYIMHLIDTPGHVDFSYEVSRSLAACEGAILIIDAAQGIQAQTLANVYLAVDNNLTLIPVLNKVDLPSADVPKVKEEIKETLGLDPEQALIASGKTGLGVIDILEQIVTRISPPQGDIQKPLQALIFDSYFDSYKGVVPSIRIVNGTVKKGDQIRFMASNSVYEVVEVGVYNPKQIVKDFLAPGDVGYLTAAIKSINHVRVGDTITSQTNQALLPLPGYKQMNSVVFCGLYPVETNKYDILKEALEKLKLNDSSLIFEPESSNALGLGFRTGFLGLLHMEIIQERISREFGVEVIATAPSVIYHVYSIKGEKLLVDNPSKLPSTQMIDRIEEPFIKATIMCPEIYIGKVMELSQNKRGALQNIEYIDSQRVMINYLLPFSEIIYSYFDKLKSLTKGYASFDYEIDKYRVSKLQKMDILLNGEIVDALSLIVHHDFAYERGKAICETLKEFIPKQMFEIPIQAALGKKIIARQTIKAMRKDVTAKLYGGDVTRKKKLLEKQKKGKKKMKTLGKVQLPQKAFLAILATK

SEQ ID NO: 8135 - protein, 249 aa, Glycine max
MVKITLGTFDDSFGVASLKAYLAEFHATLIFVFAGVGSAIAYNELTKDAALDPTGLVAVAVAHAFALFVGVSVAANISGGHLNPAVTFGLAIGGNITLITGFLYWIAQLLGSIVACLLLNFITAKSIPSHAPATGVNDFQAVVFEIVITFGLVYTVYATAADPKKGSLGIIAPIAIGFVVGANILAAGPFSGGSMNPARSFGPAVVSGDLAANWIYWVGPLIGGGLAGLIYGDVFIGSYAPVPASETYP

SEQ ID NO: 8136 - protein, 439 aa, Rhodotorula mucilaginosa
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 8137 - protein, 53 aa, Brassica napus
  misc_feature (34)..(34): Xaa can be any naturally occurring amino acid
PLVPKAARVRRNKSDAVWSEPTSPKVSCIGQIKXVKSKRSSSPKKNMIPRSQN

SEQ ID NO: 8138 - protein, 224 aa, Oryza sativa
GSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCRRVKFLSLEGCSQLTTRGLESVITSWSDLQSLKVVSCDKIKDEEISPALSELFSTFKELKWRPDNKSRLAASLAGTGMGKKGRVLCKRILPGHQRVKGTMLNYSTGVAA

SEQ ID NO: 8139 - protein, 153 aa, Brassica napus
ITKGEKKRMCKLMDCRKLSVEACMHAVQNDRLPLRVVVQVLFFEQVRASASSGSSTPDFPKGIRELRSCGTYGSSRSVPTVMEDEWDAVATEEEMRALKSEIAALKLQEESGRKSTDKAAVTAISRVKSLIMSRKMFGKKLQGKGGGGEKNYG

SEQ ID NO: 8140 - protein, 662 aa, Oryza sativa (indica cultivar-group)
MTSGGDSFVRMMSEDTDVEVLIPNEDLRTSTNGAKGSAKRSSNYTRKEDIQLCISWQSISSDPIIGNEQPGKAYWQRIAEHYHANRDFESDRNANSLEHRWGNIQKEVSKFQGCYNQTERRHPSGIPHQELVLEAEALYSSTAPKNRAFQFNHCWLKLRNSPKFQTLESHKRPRSRKSSTPIERAGEEDKGDDASKSTAPDLSQPSAKKRPIGRKQAKEKLKNGGEDGPYKEAMKDLLDAKEKEAKLKEERWKETKEIQERKLLFAERKLVWDQEQKIMFCDVSTLEPDVRTYVLAMRAQIAASKVAAHNGGFDGSSGFGVFEIVNLSMVKLCMACGQSCRAGPAQRAGGEAQAWPGGRTGPARARPLTGRAVGRAVGPRAFCPSIHVGRSSLVSQSNPLMSNPRNLSMKMMLAGVPSLNNDDHRRRGHGRSDLITVKVMAILLLLISTPAHSIGGVVDDDDDVEYVEITCYIDTQPFDYCFEQAYLLLSDNEPRKTVHGNHPVLAPKRKGQDTFTAPPRKWLKMHLVGRKPRIDRCTIALRFDTIYLMAFSTNQNQWYSMYSGFPIAHTRLPFDEDYFALAGGTSNLVTVPLGKESALDAIHTLATFDGESANDLKIPLVKLRIMFSEALKLKPVRLAFSRDWNEETHITKQDANYIGCWA

SEQ ID NO: 8141 - protein, 297 aa, Triticum aestivum
MSFYARRGGDRGSERFQGGGRGGYAMRGRSGFPPRGPLGINARPSARIIAKSFSRTKDMTWRPDLFSDSMAASGIETGTKLYISNLDYRVSNEDIKELFSEVGHLKRFAVHFDGYGRQNGTAEVVFTRRSDAIAALKRYNNVLLDGKSMKIEVIGSDLGLSMTPRINVAGASNGRATRTVVMTPETGRRGGGSSTRPLSNPTTRLNRGAFQAGRGAFQAGRGGGRGYAPSQAQFQGRGRGRGQFRGRGRGRGRKGAEKSADDLDKDLESYHAGAIEDRTDCGPSRWLCYLLGARFIS

SEQ ID NO: 8142 - protein, 793 aa, Zea mays
  misc_feature (644)..(644): Xaa can be any naturally occurring amino acid
MEFSKQGQAPMPNNIGLQPLPSSNVQSNQTEYPSLFYPSSLPGDWSSHMGTSVPVSSYYIVPMNQQSVQLGASRPEVSHPAQPLLSRVSLRPPQQVLNIQTSLPAMAGSQPSPSMAGRKSQQKVASPKVQMLKSPSFQSSNKRSAQKELPSKVQHHQLESVRSKFRESLIAALSLDLDQQNRSQSPDMCSLMVHGKEDVQEKDKASDGTSQDEGGRTGNNDMPGDVQYIDNEKADLMQELILDDVKDTVNLPPIPSLDEFMQGLDSEPPFVDLSVGTPQEDVNDSEEPGTTMEPEDLPETEDNASTPEKFESESDKSSAQVNSEPKLESPGDTAVPNSDLTEPRDGELNKSSPSHDKGEAKKTTTDNASNPDSVHQDQAASLPMIRESIWEGAIQLNVSSLSNVVAIFKSGEKPSLKDWRSFIEIKGRVKLSAFQEFVDQLPKSKSRAIMITELCWKEGSSESGRQNILQTIDAYISDERVGLAEPAEGIELYLCPPHGKTVEILSRHLPKEHQESLAVAGSSFIGVVVWRRPSISRAPTSHHNNRHDGSKRQSILGKPQVTNPAARPSLPLNSYGAPPGFTSQREEEDVTDDAPPGFGPGVARDEDDLPEFNFVKSSHHAANVTAHAYKGPWPHVPPPSARPXEQMRELVQKYGKRSSVQEKKKKKDDDDDDIPEWNPTHQTIKQPPLPHAPQQLPLPPPPVQQMNAAYQQQYHIPSAVQPQVPITSLPHAYLRTQQPQPGQAWQQPSNAWWPAQGVAAPAAQQPQYGVVPGSSGVQGYDSSNAGGMAWRPR

SEQ ID NO: 8143 - protein, 153 aa, Triticum aestivum
  misc_feature (60)..(60): Xaa can be any naturally occurring amino acid
  misc_feature (91)..(91): Xaa can be any naturally occurring amino acid
  misc_feature (120)..(120): Xaa can be any naturally occurring amino acid
  misc_feature (126)..(126): Xaa can be any naturally occurring amino acid
  misc_feature (131)..(131): Xaa can be any naturally occurring amino acid
  misc_feature (144)..(144): Xaa can be any naturally occurring amino acid
  misc_feature (149)..(149): Xaa can be any naturally occurring amino acid
MAPAVMASSATTVAPFQGLKSTAGLPVSRRSSGSLGSVSNGGRIRCMQVWPIEGIKKFEXTLSYLPPLSTEALLKQVDYLIRSKWVPCLEXFNKVGFVFREAKQLPPGTTTVDNGTMWKXLPMFGXCNDPXKVLKQVEGRSKKXYPDAXVPRQ

SEQ ID NO: 8144 - protein, 237 aa, Brassica napus
MSPGNQEKIHREKNSQRTKREFPRMPSPPATTSLSVTQTINGSHSFTIKGYSLAKGMGIRKNPEDNSAYVSVFIALASDGTDVRALFELSLLDQSGKGKHKVHSHFDRALESGPYTLKYRGSMWGYKRFFRRTLLEASDYLKDDCLKINCTVGVVVSEIDCPRLHSIHVPASDIGSHFGMLLENEDGSDITFNVSGEKFRAHRLVLAARSPVFESEFLDVIGEEEGREIEVNDMEPK

SEQ ID NO: 8145 - protein, 510 aa, Bdellovibrio bacteriovorus HD100
MNASSDVEQLSTPERMRMSFEELGPTFVKLGQLLATRPDLVPDEYVTEFEKLHDRVQPLSFETVETVLREEFGNSLYQKFESIEQEPLGSASIAQVHRARLSTGESVVIKVQRPGIIQTINDDLNVLYLLAELLVTYIPETRTYNPVGIVDEYFRTLELETNFVVEANNIRRFQENFSEDENVKIPKVYLDLTTERVLVMEALPGVPLSQEASLQQPGIDPEEVIRRGLKAYLKMVFQDGLFHGDLHAGNFFVLPENRIGLIDFGVVGRLNTRTQASIANMLLALSREDYERLAYEYVDLAPFTDRVNIDIFAKDLRELIAPYFGLTLKNVNLGKVLMRSSGIAARHHIQVPTDLMLFFKSIVSIEGMGRKIHKDFDFLQYSLEFAGDLAKTHFGPERILNDMSQMARESKTFLNALPRQLNFFLRKVNSPDHAFKLNVTEIKELKRSVESSSNLLFLGVIIAALIMSASFVYVHETVSHIAGMPTISFIGYIIAGFLGMFAFLNYIRKP

SEQ ID NO: 8146 - protein, 983 aa, Candida albicans SC5314
MSSDQSTSNHLNQNTKPGLQKPNLTFAPDIKHPPHSSFIKDQTKTIRTVPNSPYIDSCSTPPPPSSSNTLLSGSRPLTKVKSLGKIDIRSPIPINSVLQTPRIPALDQLQDETYSLRTTQTNESMRSRFFGKVHDTFISIRIFYNDFTTIDWTKAYLKGNQFNYSIEKKQWIGDDSVNDGQAIPFLHRAYYTLGKWFLILIIAFFFSIIAFCIDKVEILLVGFKHGYCRSNWFASQISCCIDNPKKLNVFKSGYVTNNTCDNWVSWNKFFHEHWLNTMRFDFIIYVVLTILLAMFACLITLSTKITGGSIPEDQSNHGKEIHADDNENATNQGRSVSVKPRVIYTATGSGVPEVKTILSGFVIRRFLGTYTLIAKTVALVFAIASGMSLGKEGPYVHLATCVGNITSRFFPFIYENDFFEKQILSASASAGVALAFGSPLGGVLFILEEINNYLPSNQLFQIFFCAIISTLFLKFLNPYGTGKTVFFELEYFSDWSPMELIFFVVIGIMGGVFGASFIKFSQWWAKKFRSNKHIKTHPIFEVFLVAAVTGIISFWNPYTKQASAELVLDLATPCSGGELDRSLCPQTEKQLLNELASLLFAFVVKVFLTFITFGLKLPCGIYVPSMVCGALFGRIFALFIRWLEFLSRKSSSSSSAFSTLSLPAPPLEFGLLCSSAGPHCVDMGIYAMISAGAFMAGVTRMNITLVTILFELTSSYTYVLPISIAIAVANWSGGLLEKNSLYESLLISNDYPFMAPETEPIDPYVSAGDIINQDSVPTTRISRHIPPDRQLYIDVSDSGYVPVSTLESKLQMLADRCLLDGCIALIKNQLCVGLLFFSELEICLDQIRAFTLKHDVKEELYCNLFDDDDGDGGGVDNKSLSKSRAMHNDKVVKNILNQSLDYFNYGAINEDEYLEMKSSIDVLTNLTNFVDRVPMFINYDTELCFAHLIFDRIGNRVIVLIKDGKYYGVLHKKVLIDYLRRTE

SEQ ID NO: 8147 - protein, 160 aa, Euphorbia esula
GGAPVGRIVMELYADTTPRTAENFRALCTGEKGVGRSRKPLHFKGSSFHRVIPGFMCQGGDFTAGNGTGGESIYGAKFADENFIKKHTGPGILSMANAGPGTNGSQFFICTAKTEWLDGKHVVFGKVVEGMDVVKAIEKVGSSSGRTSKPVVVSDCGQLC

SEQ ID NO: 8148 - protein, 245 aa, Bacillus cereus E33L
MIFVQQFEEVRLILEKAKKITVLTGAGASTESGIPDFRSANGLYADANVEMYLSRGYYNRSPKEFWKHYKEIFQINTFHQYKPNRGHRFLAELEEQGKDITILTQNIDGLHQVGGSKHVIDLHGTLQTAHCPKCKTGYDLQYMIDHEVPRCQKCNFILNPDVVLYGDTLPQYQNAVKRLYETDVLIVMGTSLKVQPVASFPEIAKREVGATTVLVNEELTGQEYNFDYVFQNKIGEFVEGLSSRK

SEQ ID NO: 8149 - protein, 144 aa, Glycine max
  misc_feature (33)..(33): Xaa can be any naturally occurring amino acid
  misc_feature (101)..(101): Xaa can be any naturally occurring amino acid
  misc_feature (132)..(132): Xaa can be any naturally occurring amino acid
  misc_feature (141)..(141): Xaa can be any naturally occurring amino acid
LKQEQNFRADALMEFYRSDMKLKKFLHIIENSXVYPVIYDSNRTVLSLPPIINGAHSAITLKTRNVFIECTATDLTKANIVLNTMVAMFSEYCENKFEVEXVEVVSYDGSTAIYPDLSCYKMEVALSDIVGXIGISLDETXVIS

SEQ ID NO: 8150 - protein, 406 aa, Oryza sativa (japonica cultivar-group)
MAAAVVARCGGAKKRKGEGLGEMHDDVLERVLARLPPASYFRLRGVCRRWSDAASSPTFLAACGRVPARDPWFLMLSEGEGQERRLPAVAFDAGEGEWARCGGAPGHVMPVVAASGGRVLYRAPDTGELTVANPLTGASRVLPAPPPGAALHAVAMYGSSPYRVVLITGDLPDLSMTVFDSSKNAWDDAVALSRKPDASSPERDAEGGVGGGGGGGDDETVYFLSKSGDVMATNMQRSASRQYSSAVTCGDGGEAVAYFLSNSGAVVACELSRRAFAELPRILPVYFEYSIDVVACGGRAYVVVLSELLGTASLRLWEFAGGAWRQVAAMPPAMSHAFHGKKADVNCVGHGDRVMVCVSSGEANGCFMCDVPTNRWEELPPCAGAGGEPMDFVAAFSFEPRMEVTV

SEQ ID NO: 8151 - protein, 453 aa, Rhodococcus sp. RHA1
MAVDTADAFTAQNIVTTPPQTLSEVARATGTTFILALFVTLSGKPCAKLVPIEAVEQLQDDGVGFAGYAAGHMGQEPKDSDLVAVPDVSSFTPIPFVKPGLAIVHCDPHVEGKPWPYAPRVILKETLRKASDLGLSVNVGAEIEYFLVHRTGDGALTTADTADVSRQPCYDARDVTRMYDHLTEVSAAMNALGWGNYANDHEDGNGQFEQNFDYADALTTADRVITARYLLSVIAEKRGMKATFMPKPFSDRTGSGMHLHLSLWNDAGSVFPDGDDPKGLGLSRTAYAFIAGILEHACALQGVIAPTVNSYKRTGATSTSSGATWSPRYATYGGNDRTHYLRVPDRNRVELRGGDGSANPYLAAAAAIAAGLDGIERDLDPGTPGSGDSPSDMLPMTLLHAMDALESDPVVTGALDVAGPGVAEYFAKLKREEFFAWHNTVSPWELDHYLTAF

SEQ ID NO: 8152 - protein, 397 aa, Rhodococcus sp. RHA1
MTQTVKFVIVGGGLEGLAIAWSLADRGETDVLVLERDTLCSGMTGKSSGVVRCHYGTPSLAAMSWYGVDIFTRATEIFGDDMAFRQCGYVVGVGENNIDPLKANVAMMQGLGIDVDYIGHDTMAELWPGLHLDDFAAFAYEPLGGRGEAYMAGMAFGASARKLGVRIRQSTPVASLLQNADGRVYGVTLANGDEVHAEQVILATGPWAPELGAGVGVDIPVKAQRAQLVLIDQGVPTPEVPVLSDLAGLQYICREPNGELLVGNSDHAAPEYIDPDKYSNRADDSTIEKNIGKLGNRLPDMPDPRITSSYVGAYDVTPDYNPIIGPAPVDGLFLATGFSGHGFKISPAVGRLVADMLLDDGKTGLPNVEPSDFRYSRFEEGDLLFSLHPYEGAGEMR

SEQ ID NO: 8153 - protein, 912 aa, Zea mays
MAAAGPAAMNRASWLLLVLVQLSCLHCYSATHHGGGRKHGRPLLPAPPATVVVGSVVGVQSGSSEASTTVVASGPLVGVRCQEENGRTPLRTRGVLTDRISRSRVRLAPRPRFASALGSTLQTPFTPDLDRRERLLPSVVLALPGPLPPASCSSQEPVTSDDILEDKMSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGVLAIPSLFFFGLTIFYLPESPRWLVSKGRMAEAKKVLQKLRGKDDVSGELSLLLEGLEVGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 8154 - protein, 58 aa, Allium cepa
RISGLIYEETRGVLKIFLENVIRDAVTYTEHARRKTVTAMDVVYALKRQGRTLYGFGG

SEQ ID NO: 8155 - protein, 455 aa, Odontella sinensis
MVRDEDLDNLIKNLPFLIRQNINQHPSKQKLIEIVIDLGRRPEARFTTGPEYLSQKVISWQDINHFTKRISKFSNDNRAGIERTLHRISCIRNRQFLINGLTCRIGRAIFGTISSVRDLLESQQSILLLGKPGVGKTTIIREIARVLSDEMEKRVVIVDTSNEIAGDSDIPHSAIGRARRMQVATTDLQHQIMIEAVENHMPQVIVIDEIGTELEALAARTIAEKGVQLVGTTHGNCLENLIKNPPLSDLIGGIQSVTLSDDEAKRRGTQKSIIERKAYPAFQIAIEINTENSWTIHEDIKSSIDLLLRKSFTGTQVRELFLDKRTFIKYKKLQIDTFTLLKDSNSLKIQTINRSNNWFTRSQKSLFYFQNSKAKKCFIFIYSLPSNLISEILNKLKFQYVLTKELQKSSLIVGSKVSLNQNFKLKKLAQQCSIPVYSVNKENIYQIISLVKLFK

SEQ ID NO: 8156 - protein, 779 aa, Ostreococcus tauri
MPDFKVQSILNAPYVPCATVYAQGRLFVSTGGAISDIDTRVSTSGRTFVSGTSYIKAFDIDVDGNLLAALDQGGNLLVFNTSTGKKVQQKNVKRPRKVKIISNANVNGIHIAVLCEELIEIWQMSSSKSLGSMMRAFVDKGTFTSFAGKNQLGWFMAHGSNLQQLYWYAESEGYQSMSFGEYFTPVALAFSDETNAIGVNHDGTLLLWSLAQVNIDGFIHLSKLTRHQKLIVDDKVECAAFNTTATHLAAVSPSGILKLFETRSAEQVEKHIFGFRIQHCCFDTMTDCLALIGRERVVVWESGSESFKLDIRNEAASVNCVSLSLEGNNLVTGSHSGIINLWNIRASLCVATFIEHKSVVSSVKHLQSGNVFVSAGYDGTVRAYDTVRLRSFRVFTSPFDSRFNEVAIDESGEIVCASAIDSCQILLWSFKSAQLLDVLSGHTGVISSLRFSTGFIVSGSWDNTVRVWDMERSEHNCQLLPHTREVLAVAVAPGKRQLVAAVMGQQLLIWNFQNNQMLGSADYSRDTLGDRGVSANFVSLQYNSSETLLFASSSDANLCVYDSHDFVLLKKYTSQPSASLSTQNNVGQLVYSAGSDTWGLIAEEGVHIYKYEGENGNHGRTHLSEDTSLSNVLGAWQRKDFNSVIHSAILLSKNTSLLMAVLYNTPIQEQKVFLCGHSGVVTQDFLTVCKELLSVSEHLEYFLMIILKVISTSHDSETDTKQLKQLSIEIDRKQGGLGRTTSTNLGTLNFLCTAKNFTRAVLPRTITTFSEQSTLSFLS

SEQ ID NO: 8157 - protein, 196 aa, Triticum aestivum
  misc_feature (155)..(155): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQADYLIRSKWVPCLEFSKVGFIFREHNASPGYYDGRYWTMWKLPMFGCTDATQVINEVEEVKKEYPDAYVRIIGFNNMPXGQCFSFIPFNPPGLQGARQGPKQLPHEEAIIKRRLCSFGPI

SEQ ID NO: 8158 - protein, 336 aa, Antirrhinum majus
APIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 8159 - protein, 147 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGGHGGGGHYGGGGGGYGGGGGHHGGGGHGLNEPVQTKPGV

SEQ ID NO: 8160 - protein, 240 aa, Ostreococcus tauri
MISREDDVDRQRRWIYCDFLKEAGMKLKVPQLTIATAVVFCHRFFHVETAYEFDTMVMATACLFLAGKVEETPKPLNDLAHTSYYLQQKRNDPTHVEGSEQEGHVELRETILRAERILLHRLAFDFNVQHPYKHLLSVIKRLSQTGLIEEDSTKSLAQVSWNFANDSLRTSLCLEYDAKHIAEAVVYLATKFLSSKFELPKKWWESVDIDPNTSELIGNRILDLYEQSGREGVIHVQSSV

SEQ ID NO: 8161 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 8162 - protein, 358 aa, Glycine max
MSSHNGMHHNNVVEDHEALMYQNYPCAYYVQSPSTLSHANSADIRSNIQNDAESTFHSPNRSETTHPLNPTHEEDEASRFALCRYTSSRGSSHSFLHHKKISYDGSHATATENGDVNRLVIIDGGGDDKGDENENVEEGSFYEYYYGKRKGGWKRFFSYGNSDSCAWIWLQMGWRILVSFGIALLVFYIATKPPSPNVSVEIARFPEFKLAEGIDRSGVTTKILTCNCSLNLIIENKSRFFGLHIRPPTMDMKFSNLPFAFSNAPELYAESGITIFALQLGAKNKPMYGAGRSMQDMLDSGTGLPLVIRVILSSSFKVVPSLIKPRFHHHAECLVFLKKAYDKKHRTLAFDSTCKVTS

SEQ ID NO: 8163 - protein, 376 aa, Nocardioides sp. JS614
MSDSERTSLPLVFDEPRGRKKPPRHLADLAPDERTAYAKELGLPGFRAKQLSTHYFSRLVDDPDQMTDLPAGQRAELVAGLLPGLMTPLRTMEADRGTTRKTLWRLFDGALVESVLMRYPDRATMCVSSQAGCGMACPFCATGQGGLQRNMSTAEIVEQVVAGARSLARGEVPGGPGRVSNVVFMGMGEPLANYKAVLGAVRRLTDPAPDGLGMSARGVTVSTVGLVPRMRQLADEGIPVTLALSLHAPDDELRNELVPINTRFSVAETVEAAWNYAKVTKRRVSIEYAMMRGINDQAWRADLLGDVLRGYGDWGWVHVNLIPLNPTPGSKWTASDPADEREFVRRLEAKAIPTTVRDTRGREIDGACGQLAATEA

SEQ ID NO: 8164 - protein, 482 aa, Burkholderia thailandensis E264
MTTTNTTTPAAAATPAIRDCGDRYCIIGGGAAGIATAKNLREHGIAFDLIEREDDIGGTWYYGKPCSAIYKSVHMISSREFSEYTDYPMPADYPTYARGDQALAYLRDYARRFGVYEHAEFNRTVLEVAPLAQGGAWRVELDGGEVRHYKGVFVCNGHLSKPQVPDYPGRFDGLQLHSALYKTPDVLKGKRVLVVGAGNSGCDIAVEAVHHASAVFHSTRRGYFYWPKFLFGIPADRWAEWPLKLRMPLWARRFFGERLLRLTTAGQPEDYGLPKPDHKLFEAHFIINSTLFYHLGHGDLVAKPDVVELKGDRVAFSDGSEEQIDAIVYATGFQLSFPFLDQSYLQWDKMQPRLYLNVFDRAHPNLFFIGLFQTSTGNWPLMDYQAQLVARYLRARDAAPRKAARLDRRIGRDRSNWNGGIHFSDTQRHVIEVEHFAYRLQLKRLIRALPDSRVAPRQARPVAVASAAQAAASGARVRTGDA

SEQ ID NO: 8165 - protein, 170 aa, Spinacia oleracea
MFPMVTGFINYGQQTIRAARYIGQSFMITLSHANRLPVTIQYPYEKLITSERFRGRIHFEFDKCIACEVCVRACPIDLPVVDWKLETDIRKKRLLNYSIDFGICIFCGNCVEYCPTNCLSMTEEYELSTYDRHELNYNQIALGRLPISITDDYTIRTILNSPQTKEKACD

SEQ ID NO: 8166 - protein, 393 aa, Spinacia oleracea
MAVPTTRKDLMIVNMGPHHPSMHGVLRLIVTLDGEDVIDCEPIVGYLHRGMEKIAENRTIIQYLPYVTRWDYLATMFTEAITVNGPEQLGNIQVPKRASYIRVIMLELSRIASHLLWLGPFMADIGAQTPFFYILRERELIYDLFEAATGMRMMHNYFRIGGVAADLPYGWIDKCLDFCDYFLIGLTEYQKLITRNPIFLERVENVGIIGGEEAINWGLSGPMLRASGIQWDLRKVDHYECYDEFDWEVQWQKEGDSLARYLIRIGEMAESVKIIQQALEGIPGGPYENLEIRRFNRIKYPEWNDFEYRFISKKPSPAFELSKQELYVRVEAPKGELGIFLIGDQSVFPWRWKIRPPGFINLQILPQLVKKMKLADIMTILGSIDIIMGEVDR

SEQ ID NO: 8167 - protein, 490 aa, Leptospira interrogans serovar Lai str. 56601
MRKFDKTLFHEFRRIYKFMPESYDLTVIGAGPGGYVAAIRAAQLGMNVCIIEKDKPGGICLNWGCIPTKALLESAHLLEKLHSAKEYGINLSDPKPDFAAIIRRSRNVADGMASGVEFLLNKNKITRKKGTAVFKDPNTIWLPDSSKEEITSKYFILATGARARELPGLPFDSHTVLSSKTAMIQDKIPESLLIVGAGAIGVEFADFYSTMGTKVTLVEMMDQILPVEDKEISTFLEKSFVKRGIRVLTGVGVSDPKIVNGKVKVLLKGKNLPEAVESFEAEKILVSIGLVPNTDSMHLEEIGIFLQKGFVKTDTKYKTSVPHIYAIGDCNGPPLLAHVASMEGIKAVEAISIHAGNPHHLSYIPIDYNAIPGCTYCHPEVASIGFTEKKATDMGYTISVGKFPFVASGRAKAMGDTGGFTKVIVDKTSGEILGAHLIGPGVTELLPAVSLGITQELTAKEIASTIFAHPTLSETVMESFGAALGEAINL

SEQ ID NO: 8168 - protein, 495 aa, Rhodococcus sp. RHA1
MTAVHENVSATGLPDGAATQLFIGGQWRPASDGGTFTDLNPATGKPLVDVSAGTAQDIDDAVRAARTQLNGEWGSLPGAARGRILNKVADLIERDGEILARLEALDVGKPVGQPTMLDIPMAAGTFRHFAGWADKITGQSIPTAGYFGQPTHSYTVREPVGVIGAIVPWNTPLMISAWKIAPALAAGNTLVVKPPEDAPLSILHLATLLEEAGLPAGTVNIVPGLGEVAGDALAGHPGVDKISFTGSPRVGRIIAKRAADTFKRTTLELGGKSPQIILPDADLEAAVGGTAMGLFFNQGEVCAAGTRILVHRSLYSQVVDGLAAAASAQVLGDPFDPATTMGALVNAKQRDTVLGYIEAGRSEGARVVAGGGRPDGDGFFVQPTIFADANNDMKIAREEIFGPVGTVIAFDTTDEAIAIANATDYGLAASIWTRDVSHAHTLAGKVRAGAVAVNGWAPIDPALPWGGMKTSGTGRELGWAGIEANTEEKVVTIIL

SEQ ID NO: 8169 - protein, 470 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 8170 - protein, 470 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIHGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 8171 - protein, 114 aa, Oryza sativa (indica cultivar-group)
MESPTKVDDEQWLAYWILYSFITLLEMVAEPVLYWIPVWYPVKVLFVAWLVLPQFKGASFIYKKLVREQLRKYRARGGAAATVTAGEDHKVHIAKTSRDLNMKIKQRVMCGVLF

SEQ ID NO: 8172 - protein, 200 aa, Pseudomonas fluorescens
MTTGSALYIPPYKADDQDVVVELNNRFGPEAFTAQPTRTGMPVLWVARAKLVEVLTFLRNLPKPYVMLYDLHGVDERLRTKRQGLPDGVDFTVFYHLMSIERNSDVMIKVALSESDLSVPTVTGIWPNANWYEREVWDMFGIDFPGHPHLTRIMMPPTWEGHPLRKDPGPCHRVRPVQPVPGQATCSRKKPRASSLKTGA

SEQ ID NO: 8173 - protein, 470 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIKGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 8174 - protein, 233 aa, Oryza sativa (japonica cultivar-group)
MDMDSWERLAADARLQDALIGMEEAEGSEGEEEAAEVACPFCDEEFDGFGLCCHIEDEHQAENRAGVYKLIHEVFLSCFHYRVLKVCPICYDAVGMDLVSHITSEHPSFFKGKWRNRRVSHGSHSSTRATLKKDAAYLQYRYGGSTRAASHNTDPDPLLSSFVGNFTDTDLPKDVQQEFRDETDEKSDSLVQKEQKPVESADEPLLPEVKEERTRRSQFVQGLVLSLMFDDIL

SEQ ID NO: 8175 - protein, 463 aa, Escherichia coli
  misc_feature (176)..(176): Xaa can be any naturally occurring amino acid
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAXGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 8176 - protein, 440 aa, Escherichia coli
  misc_feature (176)..(176): Xaa can be any naturally occurring amino acid
  misc_feature (206)..(206): Xaa can be any naturally occurring amino acid
  misc_feature (399)..(400): Xaa can be any naturally occurring amino acid
MMLPFLKAPADAPLMTDKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMXAAALHYGWRAGMMIAGCMAIVVGIFLCWRXRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGXXLAKVLDTWHWSGFFVVISIAAGISALLLLPFLNAQTPREA

SEQ ID NO: 8177 - protein, 580 aa, Ostreococcus tauri
MRDVADDDAFTSDLTRSFATSAHSSQSDAHVERDDRVESDEFERSDAHVRTTSSPEMGEREDESANERARTIDELYTERIGDANRAQLTQYALAAVAWFPAAFLTLTPVFAARSPDWKCATENGCVHADTGASLDLCSLDREAWTWVDAKASIVSEWDLVCAHEYKVQLADSIFFLGFLFGAGILGQIADSKGRLFGLYVSTALASAGALFASWAGGYWTYLLHTVLRGFGCGGLGVASYVLCLEFLGLKWRAVLGIATQYFWSGGIALMSGVAYGMPRWRSFTAFCGVFGFVYIGLSVKFLLESPRWFLATGRSDKAMGVLTQLAKGNPKFTGRLPPLKQPRAAKGLNVTAVLPFPALRHRLYAMAYIFCITSMVYYGLSLNVGSLSGSIYMNTFIGAITEFPAHAFAQISADKLGRRKTQLILMGTACSGTFASSLFTGSMQVFVSMFGRFGIAGSFNMIYLYTTELFPTIVRSACLGTCSLAARVGGICAPAIIYSQIIHPVLPYIILSIAAASACAVTLTLPETQGMVIEESLAGAAQQDMGAGRAHWTSAREVGFTRLVDRGDAESGAFDDDANL

SEQ ID NO: 8178 - protein, 412 aa, Rhodococcus ruber
MIIIGAGQGGLQAAMSLRDHGYTGRLTIVGDEPGLPYQRPPLSKAYLINDDAMSEELLLLRPHSVFERLDIDLITGDGVTRIDRVRSTVSLSSGRELAFDHLILATGARPRELSVPGADLAGVEALRTCDDAKAIRAGLTGPARVVVIGGGFVGTEVAAAATKRGHSVTIVDMEARLLNRAVSPEISALVTAAHRRRGTAVVLNAGVSRLCGSDGTVEAVELTDGQRIPADFVVVGIGVVPNTEIAHDAGLAVDNGILVDDRLRTNDHRISAIGDCARFPCAHADGQMLRLESVQNAVDHARHVAARLMGDAGPYDAVPWFWTDQCGLKIQIAGIGAQGAESVVIGDEAAERCSVLRFRSGELSCVESVNSSGEHMAARKILRGGPRPVAPVDGSPAAFDLKHIAREVATAR

SEQ ID NO: 8179 - protein, 118 aa, Onion yellows phytoplasma OY-M
MSQLKGQNLIESVNQHQLKDVPFFKPGDTVKVFIKIDEGNRKRVQIFEGLVIKRQGRLVTETFTVRKIFAGVGIELTFPVHSPTNEKIEVVRRGIVRRAKLHYVRNLSSKASRIKEQR

SEQ ID NO: 8180 - protein, 295 aa, Myxococcus xanthus DK 1622
MKTFEGSMTALATPFRNGALDEPAYRALVRQQIEGGTSVLVPMGTTGEAVTMTADERARAVKVVVEEAKGRVTVVGGAGSNSTAETIDGVRRVRDAGADGTLIVTPYYNKPTQEGLLEHYRAVAKAHPGFPIIAYNVPGRTGVDLLPDTVLRLCDIPEVVALKEATGSMPRAIDILEKCGDRMTLLSGDDFTVLPFIACGGKGVISVSSNVAPRMMADLVAAARAGNIAVARDLQVRMNELHRLLFIESNPTPVKWGLHVMGLFGPEVRLPLVQMTEPNAAKLRDTLRQLGLLTG

SEQ ID NO: 8181 - protein, 81 aa, Zea mays
  misc_feature (28)..(28): Xaa can be any naturally occurring amino acid
SWSSDSHYFFTRNDNMPTVLWIWDICRXSLPLYMWTPSGACCVNIPFLNFRIVDLKWSSNGSCLLLKERESFCCATIISAL

SEQ ID NO: 8182 - protein, 122 aa, Oryza sativa
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKC

SEQ ID NO: 8183 - protein, 929 aa, Candida albicans SC5314
MVLKDCKLNLKLIETISSYDTQQNNSNMTEKDLAGQPTIQSVGSHLQVQDHEVNLQAIISNPLSIGEVATTLTESQKWFVLKRLHFDALVSLEELPPQASFIFEKIEQMTTEEAVEILRKAIEEHATDVNIPEHDLDLWKELVENSHKFTKVQLQEKLGSNSSSSVEGEKTADVEKGHEIVDWDLQVRLESVLVAYWSPYPEVRAVTFPYDDPTIPAETFRVYLIGIIWTAIGAVINQFFTERRPSITLAMSVVQVFLYPSGLLCEWILPKWKFKIWKLSIDLNPGPYTYKEQMLATIFCGVTGGGTSYVAWNILMQKSPVFYDNKWVDFGYQVLLILSTNFLGVGLAGIMRKFAVYPTKAVWPSILPGLALNKTLMTPARKEIINGWKISSYNFFFIAFIGSFLYFWVPDYLFQALSTFNWMTWIKPDNQNLAVVTGSVGGLGLNPITTFDWNYFSSMLQPLQVPFFNPVNNIIGMSIAFFCILGVWYSNYKWTGYLPINDNGLYSNTGEPYSVRSVVDANSLFDQAKYNEMGPPFYTAANLVVYGAFFAIYPFHFVYEIGMNYDQMWDACKSFWRVIKDFKKSTYDGFDDPHSTMMRAYPEVPEWAYLIIVVISLVLAILCVKVYPAETPVWGIFFALGINFVFLIPLTTIYARTGFAFGLNVLVELIVGYAIPGNGLALAFIKALGYNIDGQAQNFVNDLKQGHYAKLPPRAVYRVQLLSIFIASFIQLGILNFQVNGGIKDYCDPKNTQRFTCPNGRTFYSASVLWGVIGPKKVFNGLYPILRWCFLIGFLIAFPCIAIKKWGPRKYVKYFEPSIVIGGFLNYAPYNLSYYIPGLYVSFTFMSYIKRKYEAWWQKYNYILSTGLNAGIAFSSIIIFFAVMYHAKDINWWGNTVMYEGMDGSMTGWLNATVDAPDGYFGPRIGHFP

SEQ ID NO: 8184 - protein, 409 aa, Pseudomonas fluorescens
MLEEEAARFKPEDWGMKRSGANEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQKAYTVIEAITGFRLHPAWYRIGGVAHDLPRGWEKLVKDFVEWMPKRLDEYTKAALQNSILKGRTIGVAAYNTKEALEWGVTGAGLRSTGCDFDLRKARPYSGYENFEFEVPLAANGDAYDRCMVRVEEMRQSIKIIDQCMRNMPEGPYKADHPLTTPPPKERTLQHIETLITHFLQVSWGPVMPANESFQMIEATKGINSYYLTSDGGTMSYRTRIRTPSYPHLQQIPSVIKGSMVADLIAYLGSIDFVMADVDR

SEQ ID NO: 8185 - protein, 905 aa, Candida albicans SC5314
MDEKNPTTELSVPNIEAVGSHLQVQDHEINLQAIISNPLSIGEVATTLTESQKWFVLKRLHFDALVSLDELPPQASFIFEKIEQMTTEEAVEILEKNIEEHETDVNIPENDLVLWKELVENSHKFTKVQLQEKLGSNSSSSVEGEKTADVEKGHEIVDWDLQVRLEAVLVAYWSPYPEVRAVTFPYDDPTIPAETFRVYLIAIIWTAIGAVINQFFVERQPAITLAMSVVQVFLYPSGLLCEWILPKWKFKIWKLSIDLNPGPYTYKEQMLATIFCGVTGGGTSYVSSNILMQKSEIFYDNKWVDFGYQVLLILSTNFLGIGLAGIMRKFAVYPTKAVWPSILPGLALNKTLLTPAKKEVINGWKISGYNFFFIAFVASFLYFWVPDYLFQALSTFNWMTWIKPDNQNLAVVTGSVGGLGLNPITTFDWNYFSSMLQPLQVPFFYPVNNIIGMAIAFFCIIGVWYSNYKWTGYLPINDNGLYSNTGEPYSVRSVVDANSLFDQAKYNEMGPPFYTAANLVVYGAFFAIYPFHFVYEIGMNYDQMWDACKSFWRVIKDFKKSTYDGFDDPHSTMMRAYPEVPEWAYLIIVVISLVLAILCVKVYPAETPVWGIFFALGINFVFLIPLTTIYARTGFAFGLNVLVELIVGYAIPGNGLALAFIKALGYNIDGQAQNFVNDLKQGHYAKLPPRAVYRVQLLSIFISSFIQLGILNFQINGGIKDYCEPGNTQKFTCPSSRTFYSASVLWGVIGPKRVFNGLYPILRWCFLIGFLIAFPCIAIKKWGPRKYVKYFEPSIVIGGFLNYAPYNLSYYIPGLYVSFTFMSYIKRKYEAWWQKYNYILSTGLNAGIAFSSIIIFFAVMYHEKDINWWGNTVMYSGVDYAMTGWLNATVDAPDGYFGPRVGHFP

SEQ ID NO: 8186 - protein, 604 aa, Pseudomonas putida GB-1
MCCKSVAFQPFRQFPGLGQQHGWPIAACHFATGCFRLRQHLTCRLLALRAAVSPPSHTVSLCNSAPLQTEPCVTAKPSQLKALPPSAQVGTAIAPVPATSNDKRHRPMLSELPILPATRAFLERKLKMRIGAEWQDAASGRTLSFRNPATGEVLGEVPAAEAEDVDRAVRAARQAFDDSPWSRLRPRERQNLLWRLADLMERDARQLAELECLNNGKSAAVAQVMDVQLAIDFLRYMAGWATKIEGSTVEASMPLMPNDQFHGFVRREAVGVVGAIVAWNFPLLLACWKLGPALATGCTVVLKPADETPLSVLKLAELVDEAGYPAGVFNVITGTGLNAGAALSRHPGVDKLTFTGSTEVGKLIGKAAMDNMTRVTLELGGKSPTIVMPDANLQEAAAGAATAIFFNQGQVCCAGSRLYVHRKHFDNVVADIAGIANGMKLGNGLDPAVQMGPLISAKQQDRVTGYIELGRELGATIACGGEGFGPGYFVKPTVIVDVDQRHRLVQEEIFGPVLVAMPFDDIDEVIGMANDNPYGLGASIWSNDLAAVHRMIPRIKSGSVWVNCHSALDPALPFGGYKMSGVGREMGAAAIEHYTELKSVLIKL

SEQ ID NO: 8187 - protein, 116 aa, Nocardioides sp. JS614
MSNVIAELGNATKRTDLPDFRSGDTVKVHVKVVEGNRSRVQIFQGVVIRLQGSGVGRSFTVRKVSFGVGVERTFPLHSPIFEQIEVVTRGDVRRAKLYYLRNLRGKKAKIKERREA

SEQ ID NO: 8188 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYCHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 8189 - protein, 335 aa, Chromobacterium violaceum ATCC 12472
MSRITLSRFLIEQQRKAGTLPPELRLLIETVGRACKAISYSVNKGALADVLGEAGTGNIQGEAQKKLDVIANDFLLDANEWGGSLAAMASEEMELPYHIPGEYPKGEYLLMFDPLDGSSNIDVNISVGTIFSILRCPEGVTQPTETDFLQPGTHQVAAGYTVYGPQTMLVLTFGSGVHGFTLDREHGSFVLTHPDMKVPERTAEFAINMSNMRHWEAPVRRYVEEMLAGKTGPRGRDFNMRWVASMVAEVHRIITRGGIFMYPKDARDPSKAGKLRLMYEGNPMAFIIEQAGGAATNGHQRILDIVPTKLHERVAVFLGSKEEVELVTRYHSEQQ

SEQ ID NO: 8190 - protein, 148 aa, Nicotiana tabacum
MAKFAISSIALLLTLNILFFTMVSSTNVPCPPPPHSKPHPTPKPHPKPTPTPSTPSTPSSKGKCSKDTLKLKVCANLLNDLVHLVIGSDPAKTPCCSLIHGLADLDAAVCLCTAIKANLLGINLNVPLSLSLLLNNCGKYVPKDFQCA

SEQ ID NO: 8191 - protein, 374 aa, Arabidopsis thaliana
MTMAANLARRLIGNRSTQILGAVNSSSGAASSVARAFCSSTTPITATLFPGDGIGPEIAESVKKVFTTAGVPIEWEEHYVGTEIDPRTQSFLTWESLESVRRNKVGLKGPMATPIGKGHRSLNLTLRKELNLYANVRPCYSLPGYKTRYDDVDLITIRENTEGEYSGLEHQVVRGVVESLKIITRQASLRVAEYAFLYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKFNEQAEQIHSAIINTIAEGKYRTADLGGSSTTTEFTKAICDHL

SEQ ID NO: 8192 - protein, 989 aa, Acidovorax sp. JS42
MLLTKKSSHAPQGAQVSSPFVHSLRRGLSQALPTMDRRAFLRRSGLGVGVGIAASQLTLVKKSQAAEGAKVGLGDSKIEVRRTVCTHCSVGCAVDAVVENGIWVRQEPVFDSPINLGAHCAKGASVREHGHGEYRLRYPMKLVNGKYERISWDTALTEISAKMLELRKASGPDSVYFIGSSKHSNEQAYLLRKFVSFWGTNNCDHQARICHSTTVAGVANTWGYGAMTNSYNDMQNSKVALYIGSNAAEAHPVSMLHMLHAKETGCKMIVVDPRFTRTAAKADEYVRIRSGTDIPFLFGLVYHIFKNGWEDKKYIHDRVYGMEKVRDEVMAKWTPDKVEEACGVKEEQMFKVAKMLADSRPGTIVWCMGQTQHSIGNAMVRASCILQLALGNVGKSGGGTNIFRGHDNVQGATDVGPNPDSLPGYYGLAEGSWKHFANAWGVDFEWIKGRYASPAMMSKNGITVSRWIDGVLEKNELIDQDSNLRGVFYWGHAPNSQTRGLEMKRAMDKLDLLVVVDPYPSATAAMAAMPGKPEDLNPNRAVYLLPACTQFETSGSATASNRSLQWREKVIEPLWESRSDHMIMYQFAQKLGFDKELVKNYQMQKVKGMDEPVPEDILREINRCVWTIGYTGQSPERLKAHMKNMHVFDVKTLKAKGGKDKETGYDFAGDYFGLPWPCYGTPELKHPGTANLYDTSKHVMDGGGNFRANFGVERNGENLLAEDGSHSLGADITTGYPEFDHVLLKKLGWWDELTDAEKTAAEGKNWKTDPSGGIIRVVMKNHGCHPFGNAKARAVVWNFPDAIPQHREPIYGTRPDLVAKYPTHEDKKAFWRLPTLYKTVQDKNMADKVYEKFPLILTSGRLVEYEGGGEETRSNPWLAELQQEAFVEINPKTAADRGIRNGSRVWLSSPTGARLNVQALVTERVAPDTVWMPFHFSGRWQGADMLAYYPKGAAPLVRGEAVNTATTYGYDSVTMMQESKTTICNVEAA

SEQ ID NO: 8193 - protein, 154 aa, Brassica napus
MMMSCRNIDLGTSVLDLMPCGCSSPTSRRIFFGNCSKTVCSIGRRSYGAGNLVFLRRDSGSCRAIPAKPKESALVNGLGEDKTVMINLRQESRKPISLESLFEVVADDLQSLNDNLLSIVGAENPVLISAAEQIFSAGGKRMRPGLVFLRITSH

SEQ ID NO: 8194 - protein, 130 aa, Nicotiana tabacum
MASKKTTSLALFLLVNLLFFSLVSACGTCPSPKPKPKPSPSPSKGKCPIDTLKLGVCANVLGNLLGLVIGNPPKKPCCTLIQGVADLEAAICLCTAIKANILGINLNVPLSLSLLLNVCGKQVPSGFQCP

SEQ ID NO: 8195 - protein, 483 aa, Anaplasma marginale str. St. Maries
MFSVIKSCARMLRIVTAILCHGILPYTGFLSLRLRSKTRAERLCILLQSLGPTFIKFGQFLAARVDIVGEDAAKNLLRLCDALPPFSFDDVVKTIECDLRRQMGSIFREFDTVPVAAASVAQVHKAKTLDGELRAVKVLRPGVEQDFRRDIRLMRLLARIFGGCRGLQRFQLGQLVEMFASICRLELDLRFEAANAEELRENTKADRGIFCVPKVDWNCTSKRVLTLQWVDAVPIYEIDKLQDRESLARNLILCFCNQVYKDRFFHADMHPGNLMVDSNNRIVAVDFGIMGRIDEETCVYISEIFIGFLSRDYRRVAEAHLDAGYIPGRCDEFITACRAIWEPIADMSAQGFSMAELLTQLFMVTSEFNMKVQPQLLLLQKTMVLVEGICRQLAPDMNLWKIAELWVQEHGDNHGYTERFKKSQVYRSMRGMRMLASKIDRSLDIIISHDGYRQGRGQTTQLGAAPFLMLVIVGLLVVLVIVK

SEQ ID NO: 8196 - protein, 174 aa, Brassica napus
MGKKRKSDASRLDEVDRTMYGAFRGAANSLSQLYTHAMNHQRVSFLAGERRGLEKLHQWIVRQEEEGTRVSTDDITTYLQNELEYEPEETSTPAPMQEFHQIHTQFAPPSVHTSSAAHAPPSHIAQHYDFNQEKVFLTQPNGLSSPVRRTLQDFNLREAEPGNHHPNSTGQGLF

SEQ ID NO: 8197 - protein, 327 aa, Bdellovibrio bacteriovorus HD100
MRTLETASHSENSTLRKVPTLSLASYTKGTAGERSEFIGKLFTGLKEYGFIILKDHNVQAADLHKAYDILKNFYALPTEVKKSYISPKAGFQRGYTPFGQEHAKDSPVMDLKEFWHVGRELSEGNPLKAVYPANVWPSELPEFQSHFSKLYAALEEAGDVMLEALTMPLEVEKDFFAKMTKDGNSILRLLHYPPIPEGVDPRCVRAAAHEDINFITILPAATASGLQLKDRDGTWLDIDSEPDTLIVDVGDMLARLTNDVLPSTTHRVINPQDGTNQSRYSMPFFMHPHPEAMLSCLPSCKGTGAKYADITGQDFLMQRLREIGLLK

SEQ ID NO: 8198 - protein, 543 aa, Yersinia pestis CO92
MTPGELRRLYLIIRVFLSYGLDELIPNIRLTLPLRVGRHLFFWLSNRHKDKSLGERLRLALQELGPVWIKFGQMMSTRRDLFPPNIADQLALLQDRVASFDGALARKHIEIAMGGALETWFDDFDSQALASASIAQVHTARLKENGKEVVLKVIRPDILPIIKADVRLMYRLAGWVPKLLPDGRRLRPREVVREYEKTLLDELNLLREAANAIQLRRNFEDSPMLYIPEVYSDYCRESVLVMERIYGIPVSDIAALEDQGTNMKLLAERGVQVFFTQVFRDSFFHADMHPGNIFVSYEHPHDPLYIGIDCGIVGSLNKADKRYLAENFIAFFNRDYRRVAELHVDSGWVPRDTNVEDFEFAIRTVCEPIFEKPLAEISFGHVLLNLFNTARRFNMEVQPQLVLLQKTLLYVEGLGRQLYPQLDLWTTAKPFLESWLRDQVGLPAVIRALKEKAPFWAEKFPELPELVYDSLQQHKLLQQSVEKLTIQIQGQQQRQGQSRYLFGVGATLLVSGTILFLADATEVSTGFIVAGALAWFIGWRRTC

SEQ ID NO: 8199 - protein, 762 aa, Myxococcus xanthus DK 1622
MSAAPRLLWFSELSREDVALAGGKGANLGEMTRAGLPVPPGFVITATAFQEAMAPVRARLQALWAQVDPDDPSSLTQVTQQLREHVRSAPVPERLRAAILEAYQQLGADRAVAVRSSATSEDSAATSFAGMHESFTHVLGEDALMDALRACWASAYGERVVAYRKAEGLTEEPAIAVVVQAMVDAARAGVMFTADPSSGDTGRIVIEAAWGLGEVVVGGQVEPDTYSVSKKEPCVREVRVGDKSVRLVRNAEGHTQRETLSPEQAHERVLSDVAVLELARLGLRVEQHYGAPQDIEWAEERGRLFLVQTRPITTLGKSAVPPPEEGHAGKALVQGLGASPGVAAGRVRVLASPAEGRQLQPGEVLVAEMTSPDWVPTMRRAAAIVTDRGGMTCHAAIVSRELRKPCVVGTRTATRTLRDSEAVTVDGSMGEVREGQEAPRPRAVEVPATASTVGTAPVLATRLYVNLALPAQAREAAALPVEGVGLLRAEFMLTEALGGVHPRKLIAEGRRGEFVERMAGALLQTTRAFHPRPVVYRTTDFRTNEFRGLEGGAEFEPEESNPMIGFRGAYRYLREPDVFNLELEVLARVREQTPNLQVMLPFVRTLWELEACLELIARSPLGRQRGLKTWVMAEVPSIVYRLHDYAKCGIDGVSIGSNDLTQLMLGVDRDSESCAELFDEADAAVLAAIGDIIRGCEEAGLTSSLCGQAPSNRPDFAEHLVRAGITSISVDPAAVLATQRVIAAAEQRLLLAASKRATLQGC

SEQ ID NO: 8200 - protein, 529 aa, Zea mays
  misc_feature (83)..(83): Xaa can be any naturally occurring amino acid
  misc_feature (124)..(124): Xaa can be any naturally occurring amino acid
  misc_feature (151)..(151): Xaa can be any naturally occurring amino acid
  misc_feature (159)..(159): Xaa can be any naturally occurring amino acid
  misc_feature (173)..(173): Xaa can be any naturally occurring amino acid
MAGGVVVSSGGGKDYPGKLTMFVLFACIVAATGGLIFGYDIGISGGVTSMNPFLMKFFPSVYRKEQEAERNQSNQYCKFDRPXLLTMFTSSLYLAALVASFFAATVTRVAGRKWSMFGGGVTFXLSAAALNGAAKDVGMLILGRVLLGVGXVGFANQSXVPVYLSEMAPARLXRGMLNIGFQLMVTIGILCANLINYGTAKIRGGWGWRVSLALAAVPAAIIAVGALFLPDTPNSLIDRGYTDAAKRMLKRVRGTDDVEEEYSDLVAASDESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKAYAAIVVLFICAYVAGFAWSWGPLGWLVPSEIFPLEIRSAGQSINVSVNMLCTFIIAQAFLPMLCRFKFILFFFFGAWVVVMTIFVALFLPETKNVPIEEMVLVWKAHWYWGRFIRDEDVHVGADLEMPSANAKLGGMQ

SEQ ID NO: 8201 - protein, 994 aa, Candida albicans SC5314
MSTIPSQVEINFNKIHQRSNSSSSTSSYRIPSGNSCIPRTVEMPSLPPTSTHHQHQQMPSSSSHAHIAKKIHREVRFGAYILGSTLGEGEFGKVKLGWRKDGKHPSQVAIKLIKRSTITKDSDSEIKIHREINSLKLLNHPNIVNLVEVMKSGKYIGIVLEYASGGELFDYILQHKYLKENVAKKLFAQLVSGVDYMHAKGLIHRDLKLENLLLDKHRNVIISDFGFVNSYNRDKNDLMKTSCGSPCYAAPELVLSQTAYEGRKVDIWSLGVILYAMLAGYLPFDDDPENEDGSDIIKLYHYICKTPLTFPEYVSPLARDLLRKIIVSDPKKRISIDDIRNHPWLSSHANLLSIRQPEWDKVHSEKQQPIAVEPPQPNKRYSMINERTNSSSLMSPAPRVTHTQPLSSHARSYSSTSISLLYSSPSATPSMANAVTNGEGATTTTTNGSINESNDTLQLSGTPSPKKPSTVSPVRGHQKSASISNSYSSASIALKAVVHEENRLHNHQQSQQYIPRSSTISTIVESPTKANTATETETTDGHKILLPPPSKDAQKLPHAAKKPRPTSYHPSSMSSALIHNNQNPTDVLKMPSPINFPMTQFISTSPPKSNGSLNDSGNFTNCSPKATSRRNSVVTHVHVNGVLSKENLIHSSSSPDNKRNSVLSYLEDKIDTLELTESHSPSKNTFEEIVDAAIATPEINQVPVFDSQTSPNGIGLDIKHKEFDETSLVVEKKSKETVSDSKSEESTKETQQQENVVMYEPIVPVEEYIKKPEEVNSVEAKQPEEVKSEDKSLQGQKSQQQQQQPEKHSADIGKTKVDLKKSASQKKKVKEESIKKQKDVDSKPIERRHTIAARRHHNDENKENKDVKKRNRFSLLSFYSSYNSSNSNVSLATSKVPSNSENNTTVLKPTSMNTTRKVLEPSNETNIMRKETKQTNSNGSTTSKSTTSSSSSSAPAASSSSSSSTSKRASTATKETSAARKVMDFFKRRSVRVG

SEQ ID NO: 8202 - protein, 472 aa, Erythrobacter sp. NAP1
MADHPYDYDCLVIGAGPGGYVAAIRAAQLGLKTACIESRETLGGTCLNVGCIPSKALLHASELFEEAEGGHFATWGIDAKATFDLSKMMAEKTSAVGDLTKGIEFLFKKNKVTWLKGHGAFEDAHTVKVGDETITAKDIVIATGSSVTPLPGVEVDNEAKRIVDSTGALELEEVPEHLVVIGGGVIGLELGSVWRRLGAKVTVVEFLPQILPGMDEEVRKEANKIFKKQGMEMMLGHKVTGAEVKGKKVTLTIEKAEGGDEQKLEASHVLVSIGRRPNTDGLALEKAGLQVNNRGQIEIDHAFRTGVEGVWAIGDVVPGPMLAHKAEDEGVAVAENIAGQTGIVNHDVIPNVVYTTPEIAGVGLTQEQAIKKAGGDKKAIKVGKFPMMANSRAKANRDTDGFVKVIADAKTDRVLGVWMINTLAGTMIAQAAQAMEFGATSEDIAYTCHAHPTHAEAFKEAAMAVQGKPIHM

SEQ ID NO: 8203 - protein, 242 aa, Oryza sativa (indica cultivar-group)
MQKSLATTPLPLPNNFPQSQFTQSFNPHFLHNFYPFRSPSNYPSYGHSPPSFQVRATANSSSHGSESSTPCPARQQEAPVNLKESSESNENEVRTATRTNWTDEENLRLISAWLSNSVDPIDKNDKKGKYYWKDVADEFNNNCCTNGHKRTVKQLKTHWGNVKDIGKFCGVYAQVRRTCTSGHSDDMIMEKAHLWYKNQSNQKKPFTLEYMWRELKDQPKWRSIIKKEENKNKSTKISELGA

SEQ ID NO: 8204 - protein, 404 aa, Thermobifida fusca YX
MSQARAWDTRLSHHWAQSTSGEKQTSMSTKDYLEKDYYKVLGVSKTATADEIRSAYRKLARKYHPDANKGDAQAEKKFKEISEAYSVLSDEKRRKEYDEARSLFGGAYRPGGGGIGDFNLGDLFGHTTTGGERLTDLFGGLFGGRGRATQSRRGADLETETTLSFTEAVSGTTKSFTLTTTVSCPTCRGSGAKPGTTPRVCPRCAGTGHESTNLGGFSLSEPCALCKGRGYLADDPCLTCSGTGNVKGTRTVQARIPPGVSDGQRIRLRGKGEPGERGGPAGDLFVTVRVTPHPVFGRSGDNLTLTLPVTFPEAVFGAEVRVPTLSGPPVTVRIPPGTRNGRVFRVRGKGATRRDGTTGDLLVTVEVAVPQNLNSEAREALQRFQAATADHNPRADLEARAKGA

SEQ ID NO: 8205 - protein, 963 aa, Acidovorax sp. JS42
MSAAPHTGAGAVPFELDGELLQALPGETLWQAARRYGVQIPHLCHTDGLRPDGNCRACVVEIEGERTLAPSCCRAPTPGMRVHAQSPRALKSQQMVLELLLSDMPETGYKWNDATKIIADSACQESVGAQFDQVPTPPGQHGELSAWADALGVAVRPALAALRRAQPAPDLSHPAMAVHLDACIQCNRCVRACREEQVNDVIGYALRGADSKIVFDLDDPMGASTCVACGECVQACPTGALSPKTHIGPQKVDRTVDSVCPFCGVGCLVTYHVKDEKIVRVDGRDGPANRGRLCVKGRFGFDYAHHPQRLTVPLVRKPGVPKDWQGAVRPEDWREVFREATWDEALQRAAGGLRALRDAHGPKALAGFGSAKGSNEEAYLFQKLVRTGFGSNNVDHCTRLCHASSVAALLEGVGSGAVSNPVSDVAHAEVILVIGSNPTSNHPVAATWIKNAARRGAKIVLADPRVTDIGRHAWRVLQFRPDTDVAVLNALIHTVIEEGLADEAFIRDRALNYEALRENVRAYSPEAMAPLCGIPADTLREVARAFATAKASMVLWGMGVSQHVHGTDNVRCLIALATVTGQIGRPGTGLHPLRGQNNVQGASDAGLIPMMFPNYQRVDNAEARAWFEQFWGLPLDDAPGYTVVEIMHKALAHEADPHKVRGMYIMGENPAMSDPDLNHARQALASLAHLVVQDIFLTETAWLADVVLPASAWPEKTGSVSNTDRMVQLGRRALTPPGDARPDLWIVQQMAKGMGLAWDYEGAEAGVAAVYEEMRQAMAGAIAGISWDRLERESSVTYPCLSAEDPGQPIVFTERFPTPTGRVTLVPADIIPADERPDAHYPLVLITGRQLEHWHTGSMTRRSAVLDAIEPHATASLHGDELARLGLAPGDWAAIRSRRGAVQVRVRRDDGTPRGAVFMPFAYVEAAANLLTNAALDPFGKIPEFKYCAVAVRGIAPPQGQGG

SEQ ID NO: 8206 - protein, 140 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGGHGGGGHYGGGGGGYGGGGGHHGGGGHGLNEPVQTKPGV

SEQ ID NO: 8207 - protein, 1536 aa, Cryptococcus neoformans var. neoformans JEC21
MAFAGVGAMGPYDRTEHSAGAALNRTTSRSHYYDDHPNDNLPSPTDEYRNRELGQLARSWSRRSQTGALGPGFSQAPQGESIAEELTGDVFTYQKDSDLDPFSSNFNPKKWTKLMFRAHETTSPPRKAGLSFKNLGVFGYGSDADYQKTVGNLALAGLGALRDLIGNRKRKVQILNGIDGVIEAGEMLVVLGPPGSGCSTMLKTIAGEMNGIYIDESSELNYRGITPKQMYGQFRGEAIYTAEVDVHFPNLTVGQTLSFAAEARAPRHTPNGIPKKDYAKHLRDVVMSVFGITHTLNTIVGNDFVRGVSGGERKRVTIAEAALAGAPLQCWDNSTRGLDSANAIEFCKNLRINADYMDISSVVAIYQAPQRAYDLFDKVSVLYEGEQIFFGKCTEAKQFFVDMGFHCPSQQTVPDFLTSLTSASERTPREGFEGKVPTTPQEFAAAWKKSNKYAELQEQIAQFEQKYPVHGENYDKFLESRRAQQSKHLRAKSPYTLSYGGQVKLCLRRGFQRLRADPSLTLTQLFGNFIMALIVGSVFYNMPSNTTSFYSRGALLFFAILMSAFGSALEILILYAQRGIVEKHSRYAFYHPSTEAIASALTDIPYKVLNCICFNLALYFMANLRREPGPFFFFMLISFTLTMVMSMFFRSIASLSRSLTQALAPAAIMILALVIYTGFAINVQNMRGWARWINYLDPIAYGFESLMINEFHDREYACSVFVPTGPGYEGATGEERVCSTVGSVAGSSVVNGDAYINGSYEYYHAHKWRNFGILIGFFLFLTAVYLLATELITAKKSKGEILVFPRGKIPRTLLAQSTASHNSDDPEPGKYAGGGNVQTKVTGADRADAGIIQRQTAIFSWKDVVYDIKIKKEQRRILDHVDGWVKPGTLTALMGVSGAGKTTLLDVLATRVTMGVVTGEMLVDGQQRDISFQRKTGYVQQQDLHLETSTVREALRFSVLLRQPNHISKEEKFEYVEEVLKLLEMDAYADAVVGVPGTGLNVEQRKRLTIGVELVAKPALLLFLDEPTSGLDSQTSWNILLLLRKLTEHGQAILCTIHQPSAMLFEQFDRLLFLAKGGKTVYFGEVGKESRTLINYFERNGAEKCPPGENPAEWMLSAIGASPGSQCTTDWHQTWLNSPEREEVRRELARIKETNGGKGDAAKQDKTQEKSKAEIKAEYAEFAAPLWKQFIIVVWRVWQQHWRTPSYIWAKAALCIGSGLFIGFSFFKSGTSQQGLQNQLFSVFMLFTIFGQLVQQMLPNFVTQRSLYEVRERPSKTYSWKVFIMSNVIAEIPWSILMGVVIYFTWYYPIGYYRNAIPTDAVHLRGALMFLYIEMFMLFTSTFAIMIVAGIDTAETAGNIANLLFLMCLIFCGVLATKETFPHFWIFMYRVSPFTYLVEGMLGVAIANTNIVCADNELLTFNPPSGRTCGQYMSNYIAAAGGYLTNEDATTGCSFCSMSETNAFLAQFDIYYSHKWRDFGLLWIFVIFNAVAAVAIYYVARVPKNTGKEQASEPEQLEKSAGLETTEKRSRRSEST

SEQ ID NO: 8208 - protein, 301 aa, Anaplasma marginale str. St. Maries
MKLNGVFTALATPFRDDLSLDERALASFVDWQISSGISGIVPCGTTGESATLNFEEYCTVVRLCIETARGRILVIAGAGSHCTTETISRALFVQSAGADAALIVVPYYNRPSDEGVYQHFRAVHDATNIPIVLYNVPQRTAIDISNDTIRRIAELPRVVGIKDCTGAERVAALKAILPEKVAILSGEDETALASYMNGGSGCISVVSNVAPKMAVELYRLHALGKINMAKQVSGNLAALSRVLFIEPSPSPTKYALSLMGKMRPKVRLPLVELTSSGQTAVKNVLETLDLLRQQKAMHSQL

SEQ ID NO: 8209 - protein, 123 aa, Anaplasma marginale str. St. Maries
MTNSAAIGEYDSGNVFARILRGEAPCRKVYEDEQVLAFHDIRPEAPVHVLVIPKGKYISYDDFIRSDCDIAGFFRTVGAIARELGLHHGGYRLVTNHGKSAGQVVPHFHVHILGYPKPEAQKP

SEQ ID NO: 8210 - protein, 123 aa, Panax ginseng
MGSNKAFLLLGLSLAIVLLISSEVAARELAEAQTTTTNKNTEAATVDGRSGYNGYGGGGYHGGGGYHGGGGYHGGGGYHGGGGYHGGGGHGGGGCSHGYCRYRCCNYAGEVVDAETTGVKPQN

SEQ ID NO: 8211 - protein, 420 aa, Streptococcus pneumoniae TIGR4
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASLLAIVLNAVLNHKKK

SEQ ID NO: 8212 - protein, 465 aa, Burkholderia xenovorans LB400
MDDHYDVIVIGGGPGGYVAALRAAQLGRRTALCERDQLGGICLNWGCIPTKALLHTADTLRTVRKAAHLGIGIDDPVVDFTRVMARSREVAQKLNRGVSHLLRKAGVTVLAGTAAFAADRSVRVHGADGALRTLQARHTIVATGAAARQLPALPWDGERIWTYREALAATAVPKSLLVVGAGAIGMEFAGFYAAMGTEVTVVEVAPRILPASDADVSEFVARACERDGIRLRTGCSVVHSAAHAEGVRVMFRSENAEEQREFERVLVAVGLDGNTEGLGLEHTRVAFERGLIIADAAGATSDPVVHAVGDVTGAPMLAHKASHQAIACVERIAEVNRGERHASPKIPGCVYSHPQTASVGLTEDEARRTGRALRVGRFPLDANGKAIALGDPSGFVKTIFDAASGELLGAHIVGPEAPELIHGFTLAATLEATESELIETVFPHPTLSEAMHESVLAAFGRPLHI

SEQ ID NO: 8213 - protein, 428 aa, Burkholderia xenovorans LB400
MRRELLVPKLGLTMTEGTLIEWMISPGDRFDADQGLYVIESDKAANEVSAEGSGVLLEVTAELGMPLSVGSVIGYWDDDPQAATNHAVRAEPSAHAAAASASSPDSNAANAAPSAQTSRPPAAMNGQSGQSGQSGARGISTPLARRLARERGIDLTNLAGSGPRGRIRARDVELAPANSPASAPDVPLPATASRAAQVAQAATVRAATSIEKTIARRLVTSKQTIPHFYLSVEAEISAVQRLRSQLNDAQSNRRFTVNHFVVAAVGRALALVPEANRVWDDSGITSFAATDVGVAVHTERGLLVPVLRDVGRQALGEVARHASEAIGRAQAGQLNAAEMAGGAITVSNAGMHDVTLMTSIINPGQSMILGVGSVRQVFRPDAHGQPALKNEVGLVLSVDHRVLDGVTALKFLRQVVAAIERPASLLVT

SEQ ID NO: 8214 - protein, 404 aa, Rickettsia typhi str. Wilmington
MPIKILMPALSPTMKDGNLARWLKKEGDKVNPGEVIAEIETDKATMEVESVDEGILAKIIIPQNSQNVPVNSLIAVLSEEGESTADIDAFIAKNNSVSLSLKTDTTLKKANESITNVEVVKHDLSKIFASPLAKRLAKIRNIRLESVQGSGPHGRIVKQDILSYSPSTAYNRDTEEYRSVPNNNIRQIIAKRLLESKQTVPHFYLSIECNVDKLLDIREDINKSFSEDKLTKISVNDFIILAVAKALQEVPNANASWAEDAIRYYNNVDISVAVAIENGIVTPIIKDANKKNIIELSHEMKILIKKAKDNKLTPVEFQGGGFTISNLGMYGIKNFNAIINTPQSCIMGVGASTKRAIVKNDQIIIATIMDVTLSADHRVIDGAVSAEFLASFKRFIEHPVLMLI

SEQ ID NO: 8215 - protein, 324 aa, Burkholderia xenovorans LB400
MSAPEIRYAQAVAQALHDSLRDDESVMVMGEDIAAAGGSFKATRGLLDAFGPQRVRDTPISEASIVSAAVGAALTGMRPVVEIMFMDFITLAMDALVNQASKARFMFGGQGSVPMVLRTPHGGGMNAGPQHSQCLEAWLAHVPGLKVVCPSTPQDAYSLLRAAIADPDPVIVVEHKGLYARKGVVEPVVGRIGEASIVRAGRDLTLVSYGATVAACLDAARTLGAEGVEAEVIDLRSIQPWDKAAVLASLARTHRAVIVHEAVSAFGVGAEIAATLSDEGFDDLDAPVRRVGAPFMPVPFASSLEKGYAVDAEKIVAVARETLN

SEQ ID NO: 8216 - protein, 148 aa, Brassica napus
  misc_feature (6)..(6): Xaa can be any naturally occurring amino acid
  misc_feature (12)..(12): Xaa can be any naturally occurring amino acid
  misc_feature (14)..(14): Xaa can be any naturally occurring amino acid
  misc_feature (17)..(20): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (47)..(48): Xaa can be any naturally occurring amino acid
  misc_feature (53)..(56): Xaa can be any naturally occurring amino acid
  misc_feature (59)..(59): Xaa can be any naturally occurring amino acid
  misc_feature (68)..(68): Xaa can be any naturally occurring amino acid
  misc_feature (71)..(71): Xaa can be any naturally occurring amino acid
  misc_feature (73)..(73): Xaa can be any naturally occurring amino acid
  misc_feature (77)..(77): Xaa can be any naturally occurring amino acid
  misc_feature (99)..(99): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(131): Xaa can be any naturally occurring amino acid
  misc_feature (139)..(139): Xaa can be any naturally occurring amino acid
  misc_feature (144)..(144): Xaa can be any naturally occurring amino acid
KREQVXASSMFXSXAVXXXXAQATMVAPFTGXLKSSXAXPVXRKANXXITSIXXXXGRXSCMKVWPPXGKXKXESLXYLPDLTEVELGKEVDYLLRNKXIPXVEXEXEXGXXYXEXGSXPGYYDGXYXTMXNLPLVGCXDSAQXLEGS

SEQ ID NO: 8217 - protein, 334 aa, Burkholderia xenovorans LB400
MSRSSSRQPSALEADRRKLIDIYRTMVLVREVELSLSRLFADSEVPGFIHLSLGQEAVSAGVASVLEVQDTLATTHRGHGHVLARGIDVGGFFKEIMGRVGGLCKGRGGSMHVADLALGVLGANGIVGAGIPIALGSAVAHHVRKTRGVAVAFFGDGAMAEGVLHETMNMAALWKAPLLLVCENNGWSEFSPTERQFAARLEALAGAFGIAYKRVDGDDAVAVSEASGIAAAAARSGAGPFVLECVTHRVRGHYEGDPQKYRDPTELDGLAGKDPLKRMHTHLESAGVSASEIDQIGRAVLTRVEAAIEAARADALPDFDEASRDVYTGREAIV

SEQ ID NO: 8218 - protein, 916 aa, Burkholderia thailandensis E264
MNDLSNGIRPVLATARRHDDTDPQETAEWLDALDGVVAHAGAERAQYLLAQLAEHAARRRLAPPPAGATPYVNTIPVDEELPYPGDPQLEERLAAVLRWNALAMVVRANRAYGELGGHIASYASAADLFEVGFNHFFRAAGDASGGDLVYFQPHSSPGVYARAFLEGFLSDAQLDHYRREIAGPGLCSYPHPWLMPDFWQFPTGSMGIGPINAIYQARFMRYLQNRGLLRTDGRKVWGFFGDGEMDEPESIGALSLAAREGLDNLVFVINCNLQRLDGPVRGNGRIVDELESQFAGAGWNVIKVLWGSDWDALFARDATGALARAFAQTVDGQFQTFSANDGAYNRARFFGQDDALAALVAHLRDEDIDRLRRGGHDARKLYAAYDRAVRHEGRPTVILAKTMKGFGMGAIGQGRMTTHQQKKLDVEHLLAFRDRFRLPLTDDDVAQLRFHKPAEDSPEMRYLHARRAALGGCLPRRRTAATTALTVPSLPSWGQFALDGGREMSTTTAIVRMLGGLLKDATLGPRIVPVVADEARTFGMANLFRQVGIYSPLGQRYEPEDLGSMLYYREDTRGQILEEGISEAGAMSSWIAAATSYSVHDLPMLPFYIYYSMFGFQRIGDLIWAAADQRARGFLIGATSGKTTLGGEGLQHQDGTSHVAASTVPNCRAWDPAFAYEVAVIVDEGMREMVERQRDTFYYLTVTNENYAQPPLPADRLDAVRDGILKGMYPLDAAALPAARVQLLGSGAILGEVQAAAHLLRDDWRIDAAVWSVTSFTELQRDGIAAERARRLFGADDAADADDAADANERAPAPYVASALAATQGPVIAATDYARALPELIRAFVPRRYVTLGTDGFGRSDTRQALRAFFEVDRASIAIAALQALADDGVVARAVVRDAIVRYGKQDASRAPPWER

SEQ ID NO: 8219 - protein, 888 aa, Shewanella oneidensis MR-1
MSEDMLQDVDPLETQEWVDALQAVLEQEGPERAHFLLEKLIDKARRNGTHLPYNATTAYLNTIPAGQEPHMPGNQEMERRIRAIIRWNALAMVLRGSKKDLELGGHISSFASSATIYDVCFNHFFRGPNEKDGGDLVYFQGHIAPGIYARSFLEGRLSEDQLANFRQEVDGKGLSSYPHPKLMPDYWQFPTVSMGLGPIQAIYQARFLKYLTDRGLKDCSAQTVYCFLGDGECDEPEALGAIGLAAREELDNLVFIVNCNLQRLDGPVRGNGKIIQELEGEFRGAGWEVVKVIWGRYWDPLLARDTSGKLLQLMEETVDGEYQNCKAKGGAYTREHFFGKYPETAEMVANMSDDDIWRLNRGGHDPVKVYAALDHAQKTKGRPTVILAKTVKGYGLGDAGEGKNIAHNVKKMGIESIRYFRDRFNIPIPDDQLEDLPFYHPGPDSEEVKYMMSRRAALHGSVPQRREKFSEELEVPSLKIFDSILQGSNGREISSTMAFVRVLTALLKDKKIGKNIVPIIPDEARTFGMEGLFRQVGIYAHEGQKYVPQDSDQVAYYREDKTGQVLQEGINELGAMSSWVAAATSYSVNDTPMIPFYIYYSMFGFQRIGDMAWAAGDMRARGFLVGGTSGRTTLNGEGLQHQDGHSHVLANTIPNCITYDPTYGYEIAVVVQDGIRRMYGEKQEDIFYYLTTMNENYIQPEMPEGAEEGIVKGIYKLETVSGSGKGKVQLLSCGTILEQTRKAAQALAKDFGITADVFSVTSFNELTRDGQAVERWNMLHPTQTPKQAYISQVISSDAPAIAATDYMKIYGEQLRAFMPTDYKVLGTDGFGRSDSRDNLRHHFEVDAKFIVIAALKSLVDRKELPVDVLANAIKEYGIDADKINPQYA

SEQ ID NO: 8220 - protein, 569 aa, Gibberella zeae PH-1
MASEINPKTEAFDAHDGSPRYDEKHGTTEPIQTPKGSWALRNGLTIESFKAHDDYAKGTVELSRDMKPRHLNMIAIGGSIGAGFFVGSGGALQTGGPGSLTIGFLIMGVMIFNVVYALGELAVMYPVSGGFYTYANRFVDPSWGFAMGWNYVMQWAFVLPLELTVFLAVIIIVNIFGTLGYAEEEFWAALLKLSATVIFMIVAVVLVCGGGPSNGIYDEYWGARLWHNPGAFQHGFRGFCGVFVTAAFSFSGTELVGLAAAEAKNPAKALPGAIKQVFWRITLFYVVGLLLVGFLVSSTDERLLNAGNNNPSASPFVIAASNAGLKGYDSFMNVIILVSVLSIGVSCVYGGSRTLVALAQQGYAPKFFSFIDKSGRPLPAVVSIIAIGALGYISVDGEGTTVFIWLQALSGLAALFTWGSICLCHIRFRSAWKYHGHTLDEIPFQHVFGVWGSWLGLAIIVIVLIAQFYTAITNIDGSIGTAEGFFQSYLAMPVVILFYIIGYIWKREGWRKISEIDLDTGRREHDWDAINAYRQQLANGPAWKHGVQTFPVTGGLIIHVLPWTQMGPE

SEQ ID NO: 8221 - protein, 441 aa, Synechococcus sp. WH 8102
MATHDIFMPALSSTMTEGKIVEWLKQPGDKVGRGESVLVVESDKADMDVESFQDGYLAAVLMPAGSTAPVGETIGLIVETEAEIADAQAKATSAAPAASAPAPTPAPAAVQAPAPTPAPTQAPAAPAPVAASAAPVANGRVVASPRAKKLASQMGVDLSTVRGSGPHGRIQAEDVEQAGGQPISVPRVAEGTAAAVAASAAPSAAAPSAPAGNSFGRPGDTVAFNTLQGAVNRNMEASLAVPCFRVGYTITTDKLDAFSKLVKPKGVTMTALLAKAVAVTLARHPQVNAATTAAGMTYPAEVNVAIAVAMEDGGLITPVLRNADRTDLYEMSRQWKDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIEHRPESLAL

SEQ ID NO: 8222 - protein, 533 aa, Zea mays
  misc_feature (146)..(146): Xaa can be any naturally occurring amino acid
MATARGMTPAAADAVEELTRLYRELPPRPAVEEVEAAAAVLASADAEEEARLAEIAREEEAARVQAQDVPAELFDVLWEARRNSVRLRSLLQRKEAAHVVELERRFKLFDDLIQRASRVVSPGDGARGGGDAVVDLEVEANRNPAXAAAVAAAATEIDRGSKGGLGLEPKSVSSLHRATSAGTDTEKLGLIQVASLIESSAKKGTTELNLRGKLVDQVEWLPVSLGKLQDVTELDLSENRIMALPSTIGSLRYLTKLDLHSNQLINLPDTFGELSSLIDLDLRANQLKSLPTSFGNLTSLANLDLSSNLLKVLPDCLGKLKNLRRLIAETNELEELPYTIGSCTSLVELRLDFNQLKALPEAIGKLENLEILTLHYNRIKGLPTTIGHLTRLRELDVSFNEVETIPENICFAASLVKLNVSRNFADLRALPKSIGELEMLEELDISSNQIRVLPDSFGHLSKLRVFHADETPLEVPPKEVVKLGAQELVNYMKNMVAAREVSQNQTDKRSFWTWLRSLFGCYKKNQGLGPVPA

SEQ ID NO: 8223 - protein, 405 aa, Bacillus thuringiensis serovar konkukian str. 97-27
MPKHRKQSKIKIYRITSYKKDKRSELDSDKFELEQQEVENKQGKHSKQDKQDKQDNLDKQDNLDKQDNLDKQDNLDKPDNLDKPDNLDKQDNLDKQVQSENVVIVPTDSHNLDIWDEISLKEIQAGEHTNLFAEQSNYQNINLLQVSDIRLYLDKQLQFSSIDEQIYHEALVHPIMSKVIDPKRVLILGGGDGLALREVLKYETVLHVDLVDLDGSMIDMARNVPELVSLNKNAFFDNRVNTHVCDAKEFLSSPSSLYDVIIIDFPDPATELLSTLYTSELFARIATFLTEDGAFVCQSNSPADAPLVYWSIGNTIEHAGLTVKSYHTIVPSFGTDWGFHIAANSADVLDQIEQLYVVPTPRTLPSLLFPLFQFKEEHLEQRNFALLNSESNLILHQCYKKEMEF

SEQ ID NO: 8224 - protein, 178 aa, Oryza sativa (indica cultivar-group)
MVETLAFCEEKGEEREEETDRRIPGGTASGGGGTAGRYTDIAADLIDSDSDESRDRSRKRSRSQKGPKERSSRKKKSRRDGSTRKKEANEGARFALEDGNGGTGYVMSGSRHARITAVRLRKENQVYSAEEKHALAAFNSEQRARRESKVRDDLRCLVDRTLGKLAGSVHDDDPSSAR

SEQ ID NO: 8225 - protein, 350 aa, Oryza sativa (japonica cultivar-group)
MASFSTVFLLLSLVCLASPCAAQRVICEAPPCTTASQVKTTPTNRASHVRLPEGVTGAESLAFDSSNRGPFTGVSDGRVLKWGGDSAGWTTFAYNRNYRSNPTCASSSEETESTCGRPLGLAFHLKTGILYFADAYKGLMRVGPRGGQADVLATEADGVPFNYLNGVDVDQDTGDVYFTDSSTTITRRYQENIMRNRDATARLMKYDAKTKQVTVLKDRLPYANGVAVSHDGRYLVVAHTGPAQVFRYWLKGAKAGQYELFADLPGYPDNVRRDAKGGYWVGLNREKITFNVPAAASPAKHLVGVRLNGDGVEVEELTAASRAVTLSEVVERDRKLWLGSVDLDYVGLLQ

SEQ ID NO: 8226 - protein, 330 aa, Magnaporthe grisea 70-15
MFKIRLSAAARPQLHLRQLTRLASSCYQKNSSCPPQPSVLQSVRAIASGPSGSGSAQSSSPFSSSAAPPSAASRQKGSTTTTTTTTTTTTNSSANASTASMADQKKEIATYLQQTHDRVFEHNRVWAAEQTKKDPDFFLKLTAGQKPEYLWIGCSDSRIPAEQITGLGPGEAFIHRNIANLVCSIDLNVMSVINYAVQHLQVKHIVVCGHYGCGGVKAAMTPRDLGILNPWLRNIRDVYRLHEAELDAIPEEEARYDRLVELNIIEQCRNVIKTAAVQQSYEANSFPIVHGWVFGFQDGRLKDLKVDHEAILKDVQKIYNLTGTPRMGGP

SEQ ID NO: 8227 - protein, 684 aa, Oryza sativa (japonica cultivar-group)
MAQSRSHAMAAFAFVVVFLLSGAPGARSQQPYGSQVADCPNKHNDTGLLGYFCSSGGGGGGAPSSSSSSCQTYLTFHATPRYPDLAAIASLLGADASSLAAANSAALPTAALAPGAKVLVPATCSCTGAAYYQRNATYVAVAGDTLLVIANDTFQGLSTCQAVQEQALGDAPARSLLAGQRVTVPLRCACPSAAQAAAGLRYLVTYLVDEFDEVGAIAARFGVDAGNISAANEMAITDTIYPFTTLLIPVKSKPDVSQLRSPPPPPPPPPAAPAPTTNRKNHTGVYVGIGAAAVAVLAVVTAVVAALAVRARRQRRRATAAVAAAGGKGGKGNDKASPAFTGGEVSVSISEAFSGLSDIKSSLKVFTYAELAAATDGFSPDRRVGGSVYRAVFNGDAAAVEVVDRDVSAEVEIMRKINHLNLVRLIGLCHHRGRWYLVSEYAEHGTLRDRLLAGGGAPPLSWSQRVQVALDVAEGLRYLHGYTRPPYVHMDVSSDSVLLAGGADLRGKLRNFGGARVIRGGGGEAFTMTSNIAGTRGYTAPEYLEHGVVSPKADVYSLGVVLLELVTGKGVDELEADGAGDPFAGMNALAGDLDGGSEDDAAVTRRMEEFLDPAMAATGSSCPREAVAMMVKLIERCVRRDAAARPGMGEVAQHLLMLHGVSGDGWHSSLEHYRSSGGDGGEQP

SEQ ID NO: 8228 - protein, 345 aa, Streptococcus pneumoniae TIGR4
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 8229 - protein, 315 aa, Ralstonia solanacearum GMI1000
MHDDLRPSLLAGLIGAGIQRSLSPAMHQQEGDAQGLRYVYKRIDLEALGLTPDALPELLTAAERFGFAGLNVTHPCKQRVLHYLDDLSDDARALGAVNTVVFDNGRRIGHNTDWWGFAESFKRGLPGAPMGQVVQLGAGGAGAAVAHAMLTLGAQSLTLFDVEPERARQLAASLCGRFGPGRAQAGTDLAAAMAAADGLVHATPTGMAGHPGLPLPPDLLQSRHWVAEIVYFPLETELLRRARALGCRTLDGGGMAVFQAVGAFELFTGIAPNAHRMLAHFAALQDAEATAHAGATDPHGVARPGIGLAAVALGR

SEQ ID NO: 8230 - protein, 120 aa, Solanum lycopersicum
ETSTTTSEEDSKKSSNKNEVHEAEYGGYPGGGGGYPGGGGYPGGGRGGGGGGYPGGGRSGGGGGYPGGGYPGGGGYRGGGGRYPGGGGGGRGGGRYSGGGGRGGGGGRGGRGGGGRKCCS

SEQ ID NO: 8231 - protein, 475 aa, Shewanella oneidensis MR-1
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFSGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 8232 - protein, 321 aa, Arabidopsis thaliana
  misc_feature (142)..(142): Xaa can be any naturally occurring amino acid
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAXAILGGVDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 8233 - protein, 274 aa, Glycine max
MASEGDHHHHHHHHQDHDHHHHDHDHHHHHDGEGETNSWVGKDGKVYHSHDGLAPHSHEPIYSPGYFTRRAPPLLNRNFNERAFTVGIGGPVGTGKTALMLALCELLRENYSLAAVTNDIFTKEDGEFLVKHKALPEERIRAVETGGCPHAAIREDISINLGPLEELSNLFKADILLCESGGDNLAANFSRELADYIIYIIDVSGGDKIPRKGGPGITQADLLVINKTDLAPAIGADLAVMQRDALRMRDGGPFVFAQVKHKIGVEEIGNLVLS

SEQ ID NO: 8234 - protein, 106 aa, Brassica napus
  misc_feature (74)..(74): Xaa can be any naturally occurring amino acid
MSISILHDEPITGEQSAPPKCHTASLSTKILSKILACLIMIPVAATALLFILMSLSFSLFFFSLYWFLHRHRHXRRESSDGLLSPKFVKSLPQFKFYEPTVYGSEC

SEQ ID NO: 8235 - protein, 525 aa, marine gamma proteobacterium HTCC2080
MLPNNPAFAPVLELTMPSNTTYADNKARAAGYLSRFSLKPAGHFINGKWDPSEGQETFSNLDPATNQSLGEIVAGTEADMDRACEAAANAFPEWAAMPGAARKKSLHHFADLIERRADEIALIESSDCGQAIRFMKQAALRGAANFRFFADKAPEARNGQSLFQPDHTNFTLRSPIGPVGIITPWNTPFMLATWKIAPALAAGCTVVHKPAELSPLSAQLLAEISAEAGIPPGVWNTVQGYGETVGRRLCEHPAIKAVALVGETRTGSQILRQGADTIKRVHLELGGKNPVIVFNDADYDRALDAVIFMIYSLNGQRCTSSSRLFIHNDIREQFLQDVRKRVETLVVGPPLDPATEVGPLIHEGHLKKVMHYLNAAVEDGATVAAGGNRREDLGPGNYVSPTLFIDANNKMRVAREEIFGPVLTAIGFDTEEEVIGLANDTDFGLAGYIWTKDTGRAMRLAQRIEAGMLWVNSENNRNLPSPFGGMKMSGMGRDGGDYSFDFYMETKNVCVAHDTHSIPVLGHHN

SEQ ID NO: 8236 - protein, 423 aa, uncultured bacterium
MAETITIIDDRTGKRVTVPIHDGVFASSALRELDPTLRMYDPAFLSTAACASSITYVDGDAGVMRYRGYPIEQLAAKSTFLEVAYLLLNGELPTKDQLDAWSFDVTHHTMVHENMRKTICHGFHYDAHPMGMFISAIAALGTFYVDAKDISNVKVLNKQILRLVAKVPTIAAMTYRFSSGLPFVLPNNSMGYAQNFLNMMYRIGDDYVVNPVLARALDVLFILHADHEQNCGTTAMRIVELTTHTDPYSATAAAAAALYGPLHGGANEAVVRMLAEIGDIKKVPAFIESVKRGDGRLIGFGHRVYKNFDPRATIIKKTAYDVFNVTGNNPLLDIALKMEEVALNDDYFVSRKLYPNVDFYSGLIYQALGFPVEMFTVLFAIPRTVGWLAHMSELLKDKEQKISRPRQWYIGVDEREYTPIANR

SEQ ID NO: 8237 - protein, 533 aa, Magnaporthe grisea 70-15
MALDGESLALGSYNLSIVGDKLLVNDKSSTGKSKSSRSCFGTGNSATKQSQRTIPLYNILWAEVAGDSLVIDYAEDVSKTKIRPTKITIPLPPATTAKDTTTDAPATAEAGADLEAGNAGAQSSPAARASAWASSLLDHSYDPSTTRRKRAFVIINPHAGPGGAMRKFETQVRPIFLAARMELEIVTTTRRGEAEEIVQKLDLDKYDVIAVASGDGLVYETFNGLGRRPDAQKALKSVAVVHIPCGSGNAMACNLYGTHRVSPAALAAVKGVPTALDLVSVTQGNTRTLSFLSQALGVIAESDLGTDNLRWMGSARFTYGYITRAVKRAVYPCDISVKVEIDDKAGIKEHYARHRPDRSSTAPVTKADSVVDGDVGTEVGEGLPPLKYGTINDKVPEGWETFSYDNMGQLYCGNMAYIMPDSNIFSAACINDGMMDLVTVDGDISPFKSLELMTLVESGKFFDDSRVRYRKVSAYRITPRNQASGYISIDGEGVPFAPFQCEIHRGLGLVLSKAGTYEAPGPMNWEKVAVNKS

SEQ ID NO: 8238 - protein, 361 aa, uncultured bacterium
MKHRIAVIAGDGIGQEVMPEGLRVLDAACRQFGLDLEFVSFDWAHCDYYLQHGQMMPDDWFAQLKDFDAIYFGAVGWPATVPDYISLWGSLLKFRREFDQYANVRPVRLMPGIPCPLAGKQVGDIDFYVIRENTEGEYSAVGGRMFEGTERETVIQESIFTRQGTDRILKFAFDLAQRRPKKHLTSATKSNGIAISMPYWDERVEAMAGHYPEVRWDKYHIDILTARFVLSPERFDVVVASNLFGDILSDLGPACTGTIGIAPSANLNPDRTFPSLFEPVHGSAPDIAGQGIANPVAMIWSGAMMLDFLGQGDSRYQAAHDAIMAAIEQVLVGGPRTPDMGGTASTVELGRAIAAALEGRD

SEQ ID NO: 8239 - protein, 555 aa, Oryza sativa (indica cultivar-group)
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAVVMSLLSSLTVTPVSATLKCCHMPEVCGYQGLASSFKEISLSFLKEIEESV

SEQ ID NO: 8240 - protein, 444 aa, Ralstonia eutropha JMP134
MTTGANGRAHRIIVVGGGAGGLELVTRLGDKLGKKGTAQVVLVDRLPTHIWKPLLHEVAAGSMDPNTHQLEYVAQARWHHFEFQQGEMTGIDRERKTISVAACLDPDGGELLPARELPYDTLVLAIGCVTHFFGVPGAAEHAIALDTVAQAERFRRRLIAACVRAQNGRGRVGEDGRPRVDVAIIGAGATGVELSAELRNTAHVLNAYGLHKLDPRRDVRIHVIEAGPRILPALSERVSAETAKLLRKLDVDVFTSERVTEVNTEAVLTASGKRIDADLTVWAAGITAPPVLATLGLPVSRQGQILVRPTLQSEGDPDIFAFGDCASCPWPEKQTAVPPRAQAAHQQATFLFDALRARLAGKPLPEFAFKDFGSLVSLGHFSAVGSLMGGLIGGSMFIEGLMARFMYTSLYRMHVLALHGAVGMGLDTVTHWLRSKTSPRVKLH

SEQ ID NO: 8241 - protein, 416 aa, Rhodococcus sp. RHA1
MVADTPPPPGGRVRPQRRYWVRTLAMAGPAFIAGAWQFGPGNLASAVQAGSEYSYSLIWVIAVSTIFMLVYADMSVRLGIRTPASMISSVKDILGRRVGVSAGVGVFIITLCFSVGNAVGSGLGLSMVFGGSPIVWSAVCTVFVGLILLFRNVYRTVERVLLVIVALLAATFVFSAVIAQPDWFQAVHGLVPSIPPGGQLLVVALVGTNFSLNAAFFTSYGTHERKRTAAEYRQTTIADTIPGIVAPGIMTSLVIIVAAAVLGRQNTEATTLAGLAKIFEPIAGPIGSTIFALGLSGAAFSAMVANATAGGTMLSDALGKGPSPSTPTAKRTSAVILGFGLLITILFTKSPVQLIIFAQALTVLIAPFLGLLLFVMSNNRQLMGNLRNTWWKNIIGALGFLSILSLSGLLIYELLG

SEQ ID NO: 8242 - protein, 95 aa, Zea mays
MYGRGKGGKDLSNGGAKRHRKVLRDNIQSITNPAIQRLVRKGSVISISRLIYHETYGVLKIYIENVIRDAVNYTEHARRKTVTAMDVDYALKHYG

SEQ ID NO: 8243 - protein, 600 aa, Anaplasma marginale str. St. Maries
MHPCNTHHTHLCDTHRYSQPKKDEHPAIGVLCLDAKGYILRPSSRFFMDYSGVYPSSSKVYVRGNLYSDVNVGMRKVAIKNGTSEFLVYDTGGPYTDREAKLDIKSGIRKLRSTWIENRRDTSPVQRSFVPSGSSCTRYQKAAENVLRKIAGGSPVTQLFYAQNGIITPEMEYVAIRENALRMQVGSSETGAAAHQEITPEFVRQEIAAGRAIIPANINHPESEPMVIGRNFLVKINANIGNSAVLSGIEEEVKKMALAVAYGADTVMDLSTGSDIHNIREWIIRNSPVPIGTVPIYQALNKVKGVVENLSFEVFKETIIEQAEQGVDYFTIHAGVLKDYIKHARGRVTGIVSRGGAIMAQWCLAHNKENFLYTHFDEICEIMGSYDVAFSLGDGLRPGSIDDANDEAQFLELKTLGELVKVAWHHGCQVMVEGPGHVPMHLIKENMEKQLHLCSEAPFYTLGPLTTDIAPGYDHITSAIGAAMIGWYGTAMLCYVTPKEHLGLPNIDDVKAGVISYKIAAHAADLAKGNPSAYARDYALSQARFDFRWYDQFNLSLDPLTAKSLHDESLPGKGGKTANFCSMCGPKFCSMKLSKELVDQ

SEQ ID NO: 8244 - protein, 267 aa, Shewanella oneidensis MR-1
MDGLTGKVVIITGASEGIGRALAIAMARIGCQLVLSARNETRLASLALEVANYGPTPFVFAADVSSASQCEDLIHATIAHYGRIDILVNNAGMTMWSRFDELTQLSVLEDIMRVNYLGPAYLTHAALPYLKSSQGQVVIVASVAGLTGVPTRSGYAASKHAVIGFFDSLRIELADDNVAVTVICPDFVVSQIHKRALDGAGKPLGKSPMQEAKILSAEQCANMMLPVIATRGRLLITSLRGRLGRWLKLIAPGLIDKIARKAIASGR

SEQ ID NO: 8245 - protein, 368 aa, marine gamma proteobacterium HTCC2080
MKTRAAVAFEAGKPLEIVDVDLQGPQAGEVMIEIKATGVCHTDAFTLSGDDPEGAFPAILGHEGAGVVVEVGAGVTSVKPGDHVIPLYTPECRECNFCLHPKTNLCQAIRETQGQGVMPDKTSRFSLDGKPLLHYMGCSTFSNFTVLPEIAVAKVREDAPFDKICYIGCGVTTGIGAVAFTMNVEAGSTVAVFGLGGIGLNVIQGARLVGATRIIGVDLNNDRIEMAKRFGMTDFVNPNEVDNVVDHLVQMTGGGVDYSFECIGNVNVMRQALECCHKGWGQSCIIGVAGAGQEIATRPFQLVTGRSWRGTAFGGARGRTDVPKIVDWYMEGKINIDDLITHQMPLSDINKAFDLMHSGESIRSVVVY

SEQ ID NO: 8246 - protein, 122 aa, Zea mays
MSAMETDINAPPPPAPAGEGSSAAGSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 8247 - protein, 247 aa, Acidovorax sp. JS42
MHKLVLIRHGESTWNLENRFTGWTDVDLTPTGIEQAKNAGRLLKAEGYDFDLAYTSVLKRATRTLWHCLDEMDRTWLPVEHSWRLNERHYGALQGLNKADMAKQYGDAQVLVWRRSYDTPPPALEPTDPRCERGDIRYAGLAPEQVPLTECLKDTVARVLPYWNEAIAPTIRSGKRVLIAAHGNSIRALVKYLDGISDQDIVGLNIPNGIPLVYELDAELKPLRSYYLGDAEATAKAAAAVAAQGKA

SEQ ID NO: 8248 - protein, 187 aa, Anaplasma marginale str. St. Maries
MQQSVEHVTKHVGKILKREVAVRSDGVLECRLEAGDLLKCITTLRDDEKSKFKILTDIFAVDYQAREARFDVVYMLLSVAFNARICCKVPLVEGHNVPSVTSVFGSAGWFEREVFDMYGIVFDGHPDLRRILTDYGFTGHPMLKDFPLTGYDEVRYDLQKKQVVYQPVNLQQDFRNFDAISPWKGER

SEQ ID NO: 8249 - protein, 527 aa, Oryza sativa (japonica cultivar-group)
MALSAETGKVVQWRRWAFANLGSVLSNFGSLWLLLAPLLAAYAPRRLFKTYFNLFLRRHARRLLAVVDPYVTVDVSEPGGASAHYSRYGRVTDSGDSTYEEVKAYLSDGCAGEARELRAEGASEGDGVVISMRDGQDVADEFRGAALWWTSVVREDAQGQQRAHTRRCQRLTFHHRDRRLVVDEYLPHVRRKGREILFSNRRRRLYTNNKSGDSFRYDYKAWSYIDFDHPTTFDTLAMDTARKREIIDDLDAFRSDRDFYRRAGKPWKRGYLLHGPPGTGKSTMIAAMANYLDYDIYDVELTVVKDNNDLRRLLIETTSKSIIVIEDIDCSLDLTGDRAATQRRGRQNDRDDGSRRHDRDGSMVTLSGLLNFIDGLWSACGGERIVVFTTNHVDKLDAALIRRGRMDMRIEMSYCGIEAFKTLAKNYLDVDDHRLFGPVGEILGRESITPADVAECLMTAKRAGSDDESSRLEIVIDELKQTAEANAKAKAEAEAKAKAEAEEEAKAAEMDRDNTREEQNGRKSPKI

SEQ ID NO: 8250 - protein, 385 aa, Parvularcula bermudensis HTCC2503
MAQDYYDLLGVERSADGAAIKSAFRKLAMKYHPDRNPGDEAAEKKFKEIGEAYEVLSDDQKRAAYDRFGHAAFQNGGGPGGPGGAGFGGGFASGAFSDVFEDIFGEFMGGGGGRGRGRRQSGRGADLKFEVTVELGEAFAGIEKEISVPSSEACDVCEGSGAEPGTSPTTCSTCGGAGRVRMQQGFFAVERACPTCQGQGETIETPCSNCGGQGRVRKNRTLAVEIPAGVEDGTRIRLTGQGEAGLRGAPFGDLYLFVRVRDHQLFERDGADLYCHVHVPMVTAALGGEIEAPTIDGGRVKIKIPEGSQSGRKFRLRSMGMNQLRRPVRGDMFVELMVETPTNLTSRQKELLREFCEEGGGNDCPQSNNFFDRAKEFWDNIRDAS

SEQ ID NO: 8251 - protein, 111 aa, Shewanella oneidensis MR-1
MTELEIIDLVVGDGKEAVKGALITTQYRGFLQDGTQFDSSYDRGQAFQCVIGTGRVIKGWDQGIMGMKVGGKRKLLVPAHLAYGERQVGAHIKPNSDLTFEIELLEVLTRD

SEQ ID NO: 8252 - protein, 175 aa, Triticum aestivum
MLLFAGRGRDLKSYQDKNIAKMSSSEQTFIAIKPDGVQRGLVGPIISRFENRGFKLAAIKLVTPGKEHLEKHYADLAGKPFFPGLIEYMNSGPICAMVWEGRDAVKTGRAILGATNPLASSPGTIRGDYAIDVGRNVCHGSDSVENAQKEIALWFKEGEVVSWKSAQFNWVYEKA

SEQ ID NO: 8253 - protein, 789 aa, Gibberella zeae PH-1
MSVTNVETKGPHGPDDTLETSVSQVHSSDNADEKNIDTSKNAVLGAEIHDVSSTDHHNDSDTDSKNVIIVTGADASRHLLPMRDDHDNALTFRSLFLASCLACFQAVMYQIYTFKPTQITIQGTFIVLISYFIGNAWSFALPRGDKYEARWRAKGNTGSLPLWLKFIKLINPGPWGLKEHAICAITATSASNAAESVQVFAAQDLFYDMPLSPTTVILSTISIGLFGYGLCGIMRPVAVWHVDAVFWSNLPTVKTLQGLHWQEVKDSKPLRYFWYSFTGMSLYEFFPAYIFPWLNSVSIPCLAAMKATGAKAEHLTNIFGGATNNEGLGLFTLSFDWQYITSFNTSLPLPLQAHMAVGFFVCYIVMLCIYYGNGWGARSLPFMSTRLLMENGTTYPVAQVFEGGILNEERLLEFGLPRLTGTFAYAMFMANAAIGALILHCILFWGKDVIKAFKSAKEGRYDDRHHEHMAKNYKEAPWWWYISILVGSFILGLVVVIKENITLPPWAYVVSLVLGSVIAPVSTLLYSRYGNGIATNNLSKMLAGLMLPGKPVGNMYFAAWSHNVISNAVNLSGDLKMGEYLKIPPRVMFLTQVWGTILGGFINYAVMISIVGSNRELLRDGDGNSSWSGATMQSYNTNATSWALAGYLYKIGGFYEVVPFGLLVGASLVVMHRIFYKFYPKIKNFDVADINFAQFIQFAGYIPYNQSQTCVILSQILSGFFVQFYLRNYRPRIFRDYSYLVTGAFDGASLTVLFILSFAVFGAGGPGHPFPSWWGNNVNGNYDLCPVAE

SEQ ID NO: 8254 - protein, 245 aa, Streptomyces coelicolor A3(2)
MSGIEGKVVAITGASGGIGEASALLLAERGAKVVLGARRPERLADLALRIGRSGGEAAWIRTDVTRREDVAALVALARERFGRLDVLVGNAGVGLISPLDELRVEDWERMIDVNLKGVLYGIAEALPVFREQGSGHFVNIVSTAGLRISPLMSVYAGTKNAVRTVSEGLRQEAGDSLRVTVVSPGFVHTDFADGIPDAGARAQILDTRDRVAIPPQAVARAVAFAVEQPDGVDVGDIVVRPTAQD

SEQ ID NO: 8255 - protein, 174 aa, Yersinia aldovae
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRF

SEQ ID NO: 8256 - protein, 199 aa, Yersinia aldovae
GSSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAF

SEQ ID NO: 8257 - protein, 151 aa, Yersinia bercovieri
LMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAG

SEQ ID NO: 8258 - protein, 199 aa, Yersinia bercovieri
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 8259 - protein, 297 aa, Rhodococcus sp. RHA1
MSKQLSGVLTALTTPFDADELIDTDKLKLVVDRSIKAGVDGVVAAGSTGEVGALSSDERLRLVDTVIEHTDGRVPVIAQTGATTTAEAIQLSRAAEKSGADVLMLITPFYEPLSTEETVAYIKDVASAVELPVMLYNIPAVTGVNLDPSTVRSLAEEVDNIRYIKDSSANWEQALQLIHHHSDVIGTFIGWDSYIYSALVEGAAGVMAGAANVVPDEIVAVNRLIGEGDLHGALAKWKNLYPVIDAMISVPFISAVKAGLALQGEPVGAPRRPTAELPAEQVEKIGQALKRLAEGTA

SEQ ID NO: 8260 - protein, 381 aa, Arabidopsis thaliana
MAISDLPRDLVEEVLSRVPVTSLRTVRSTCKKWNIISKDESFTKKHVGQANAAARESEFQVVIMTEYKVYLMSVNLHGIQNNVDPSIEFKCKLISLDDSDRIGISQVHICHGLFLCITNEKNYKLVVWNPYRGQTKCIEHRISYKRWNSYALGYEMKNNSCLSTQNLENCVDFHPVYETEIYNFHSDSWKNIVDSTPEGDMQYFKQGVSLKGNTYWFARKYVIYEGGQEAWVSFLICFDFTTERFGPRLTLPFDYSTKESVSLLSAREEQLVLLYHPWFTMMMEIWVSNKIELNAVSWIKFLEVNMITFPHYRFSFHHVSFFIDKKNKVVVVLDKDKETRSRNLGYFIGDDGYFKEVELGGSRDRNGYPFVFSYVPSSVQF

SEQ ID NO: 8261 - protein, 193 aa, Oryza sativa (japonica cultivar-group)
MNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 8262 - protein, 503 aa, Rhodococcus sp. RHA1
MPNTTLTGHVAVSRAPGGSLNVRDDLPPTQHYIAGAFDAVDNSGPRTDVVDPSTEQVIAAVPQGTAADVDRAVAAAVAAKNDWARLVPKERSLLLHRIADRIEQNSEVLARLESANTGKPFEVSNDDVAGTVDTFRFMAGALRATTSMAAGDYAENHLSVILREPLGVVGVVTPWNYPLLMAAWKIAPILAAGNTVVIKPSEQTPLTTLKFAELVGDLLPVGVFNVVSGLGPTVGARLTEHPDVDMLALTGSVGSGKAVARGAADTLKRVHLELGGKAPVVIFADADLDDAAVSLRAASYWNSGQECGAACRILVHESVAEEFTRKLVEQVSTFVVGEPGAGDTVEIGPLVSKAHFERVTAYLERAAQQGITAAIGGSALDGPGYFVAPTVLVGVPDGAECAREEIFGPVVTVETFTDEDEATRRANDVPFGLSASVWTENARRSHEVAARIDAGTVWVNSHLVLANEVPWGGFKGSGYGRDLSIYALDDYSRTKHVMHNHGR

SEQ ID NO: 8263 - protein, 1077 aa, Photobacterium profundum SS9
MPKRTDIKSVLIIGAGPIVIGQACEFDYSGAQACKALREEGYRVILVNSNPATIMTDPDMADATYIEPIHWEVVRNIIAKERPDAVLPTMGGQTALNCALELEKRGVLKEFNVEMIGATADAIDKAEDRSRFDKAMKSIGLECPNADTAKTMEEAYKVLDMVGFPCIIRPSFTMGGSGGGIAYNKEEFEEICTRGLDLSPTNELLIDESLIGWKEYEMEVVRDKNDNCIIVCAIENFDAMGVHTGDSITVAPAQTLTDKEYQLMRNASLAVLREIGVETGGSNVQFGINPKDGRMVIIEMNPRVSRSSALASKATGFPIAKIAAKLAIGYTLDELMNDITGGATPASFEPTIDYVVTKLPRFNFEKFAGANDRLTTQMKSVGEVMAIGRNLQESLQKALRGLEVGATGFDEMVDLDEPNAMSKIRHELKEPGAERIWYIADAFRSGMSVDGVHNLTNVDRWFLVQIEDIVKDEQKVKDSGFAGLNAVELRKLKRKGFSDERLAKLLGVAQSEIRKLRDQHDIHPVYKRVDTCAAEFSSDTAYMYSTYDEECEAQPTDKDKIMILGGGPNRIGQGIEFDYCCVHASLALREDGYETIMVNCNPETVSTDYDTSDRLYFEPVTLEDVLAIVRVEKPKGVIVQYGGQTPLKLARELEAAGVPIIGTSPDAIDRAEDRERFQQAVDRLGLLQPENATVTTMELAIEKSRIIGFPLVVRPSYVLGGRAMEIVYDEQDLRRYFNEAVSVSNESPVLLDRFLDDAVEVDVDAICDGEQVVIGGIMEHIEQAGVHSGDSACSLPAYTLSKEIQDVMREQVKKLAFELGVRGLMNTQFAVKDNEVYLIEVNPRAARTVPFVSKATGAPLAKIAARVMVGQSLESQGFTKEIIPPYYSVKEVVLPFDKFPGVDPLLGPEMRSTGEVMGFGDTFAEAFAKADLGCGKEYEDGGRALLSVRNNDKQRVVDLASKLIKLGYQLDATHGTAVILGEAGINPRLVNKVHEGRPHILDRIKNNEYSYIVNTAEGRQAIEDSKVLRRGALAEKVNYTTTLNAAFATCMAHTADDRGHVTSLQELHARIKDNHHY

SEQ ID NO: 8264 - protein, 297 aa, Agrobacterium tumefaciens str. C58
MTDRLEPQDPRSQYPRPPFSTPTQEMPGLVTNMTPFPDHGEKSYKGTGKLAGRKALITGGDSGIGRAVAIAFAREGADVAISYLPEEESDAEEVVALIEAEGRVAVALPGDITDEAWCRELVEKAVSDLNGLDILVINAARQQYREDIEELSTDDFDRTMKTNLYALHWIAQAAVPYLKPGASVITTASIQAYEPSAILLDYATTKAGIVAYTKALAKQLIEKGVRANAVAPGPFWTVLQPSGGQPDEKVKNFGKDSDFGRPGQPVELAPVYVLLASQDASFINGEVYGVTGGRGIA

SEQ ID NO: 8265 - protein, 164 aa, Zea mays
HSVVSLDGIDFVRCEVVGQSFMLHQIRKMVGLAVAVMRNCAPESIYDVAFRKDIRLNVPTAPEVGLHLDECMFTSYNSKWMDTHEAVSIEPYAEEAEEFKIKYIFPHIAAMEHKEGAVALWLHSLNSRNYPDFRYVETAGSEAKVGAEVENMEEAQMPSNNISE

SEQ ID NO: 8266 - protein, 1135 aa, Zea mays
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSIALHKAAAFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFYEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPTELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKQISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREADTSSFIILMEFPVAQLSSKRSKPSTSKF

SEQ ID NO: 8267 - protein, 337 aa, Oryza sativa (japonica cultivar-group)
MGSPPPHRLLLLLAVAAVLHRSAAAAEGVIRLPRGRACAAPTDPAAYDRPVIGIVSHPGDGAGGRVSNGTAASYIAASYVKFVESAGARVVPLIYNEPEERLLEKLSLVNGVLFTGGSVKSGPYFETIKKVFQYVLDKNDAGIPFPLFAQCLGFELVSMIVSKDNNILESFSATNQASTLQFPNYSSLEGSVFERFDPDLIKKLSTSCLVMQNHKYGISPKTLRENVALSSFFKILTTSPDENGEVYVSTVQANKYPITCTQWHPEKAIFEFGKQMIPHSEEAVQVTQNFANYFISQARKSQNRPPADKVLDNLIYNYSPTFIGKKSKSFDVVYIFS

SEQ ID NO: 8268 - protein, 655 aa, Alkaliphilus metalliredigenes QYMF
MSKGTYYLTTPIYYPSAKLHIGHTYTTVAADVLARFKRTRGYDVQFLTGTDEHGEKIQEAAQKNGMNPKAYVDEIVEEIKKVWKSMDISYDIFIRTTDEEHERAVQKIFQTLYEKGDIYKSEYEGWYCTPCESFWTETQLKEDKGCPDCGRPAHLAKEEAYFFKLSKYQDRLIEHFEKYPEICYPESRKNEMLNNFLRPGLEDLCVSRTTFDWGIPVPFDPKHVIYVWFDAVCNYITALGYTSENEEQYKKYWPANVHLVAKEIVRFHTIIWPAILMALEVPLPKMVYGHGWILFGSDKMSKSKGNIVYPEPLIERYGIDALKYFLLREFTFGQDGNYTNRTFVTRLNADLANDLGNLVSRTVAMIEKYNSGIIPEPKVAGEFDEDLRTVATGAAAKVEKAIDQLQFHEALEEIWKVVRRTNKYIDETTPWILAKDEENKERLNTVLYHLADTLRIVSVLIQPFMEATTNKIWEQLGIDANQGTTWEDASLFNQIPSGVKVRKGESLFPRLDVEKEVAELEEINAQYAKSMNSGQEDKKEEEVVLETKEQITIDDFDKVDLKVAKILAVEKHPKADRLLVLQLQVGNEKRQVVSGIAEHYTAEALIGKQVILVANLKPVKLRGIESHGMILAAVTGEKLVLGTIDGEIEAGTTIS

SEQ ID NO: 8269 - protein, 446 aa, Pavlova lutheri
MRSVVAAAAFFGSAGAFNSRGALRGSLLARRSASTLRGGGVQLADGHYEYLVIGAGSGGIASARRAAQYGAKVAVVERARLGGTCVNVGCVPKKLFFTAGVHMEAMHTAKGYGLDVGTPPKFDWEGFKARRDAYIANLNGIYLRNMQNSKVEFVEGYASFVDAKTVEVTGHGRFTADNILIAAGGKPIHPPVPGGELAKTSDDFFDLEHQPRTAVVVGAGYVAVELAFIMHELGTDTTLVCRGEKVLRHGFDPMVQDVLNSEMERQGISMRRKTELGSIKLAEDGTYEVTFKDGSMLTGIDVVLYAAGRRPILTGMCLENAGVELSDRGFITVDEYERTNVPGIHALGDVTTTGYELAPVAIAAGRRLSDRLYGGEPRARLEYDRIPTVVFSHPPIGTVGLTEPDALEQYGEASVKVYKSSFKPMHYAMCEPDLKLPMAMKLVCVG

SEQ ID NO: 8270 - protein, 380 aa, Zea mays
MISPTNLLPARKITPVSNGGAATASPSSPSVAARPRRLPSGLQSVTGRGKVSLAAITLDDYLPMRSTEVKNRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEAPVLDDDDFVLISRY

SEQ ID NO: 8271 - protein, 385 aa, Pseudomonas putida GB-1
MCCEKCIARYQFVTGRSRSAKDVLRWHGAHITAARAIGHLQDNEGVMSNESINWDKLGFDYIKTDKRYLSVWRNGEWDKGTLTEDNVLHISEGSTALHYGQQCFEGLKAYRCKDGSINLFRPDQNAARMQRSCARLLMPHVPTDVFIEACKQVVKANEKFVPPHGKGALYLRPFVIGTGDNIGVRTAPEFIFSVFAIPVGSYFKGGMKPHNFQISSFDRAAPQGTGAAKVGGNYAASLQPGAEAKKANFADAIYLDPLTHTKIEEVGSANFFGITANNEFVTPKSASVLPGITRLSLMELAQSRLGLTVIEGDVEINKLDRFIEAGACGTAAVITPIGGIEYNGKLHVFHDLEKVGPVTQKLYNELTGIQSGDVEAPAGWIVKVA

SEQ ID NO: 8272 - protein, 448 aa, Glycine max
MEGENKKYITSEELKEHNKPGDLWISIQGKVYNVSDWAKDHPGGEVPLLNLAGQDVTDAFVAYHPGSAWKYLDPFFTGYHLRDFKVSEVSKDYRKLVSEFVKMGLFEKKEHVTLYTLSSVAVMFSIVVYGVIGCSSVWAHLGAALLLGLLWMQSTYVGHDSGHYEVMSSPGYNKLAQILCGNCMTGISIAWWKWTHNAHHISCNSLDYDPDLQHIPVFAVSTRFFNSIKSCFYGRKLVFDSLSRFLISYQHFTFYPVLCFARVNLYLQTLLLLFSRRKVPDRAFNIMGILVFWVWFPLLISSLPNWGERVMFVLASFAVCSIQHLQFCLNHFSADVYEGPPNGNDWFEKQTGGTLDISCSSWMDWFFGGLQFQLEHHLFPRLPRAQLRKISPLVIDLCKKHNLPYRSLTFVEANLWTLKTLRTAALQARNLSNPSSQNLLWEAFNTHG

SEQ ID NO: 8273 - protein, 138 aa, Oryza sativa (japonica cultivar-group)
MAIASGAAFSVRPSPAAARPCVAASASAAGAARFRGDGSGGGGGGGGGGKWWAPLLGWSGQPDYIDAQPAAREEARPNPMAAAEQRGGGGKRFGVLTEEKARQLRARMMETESFHDCMYHSAIASRLASAAPADDGKH

SEQ ID NO: 8274 - protein, 252 aa, Rhodococcus sp. RHA1
MYTTETPQDAAKYAVGRAAVERYAHDGAQLGLGSGTTSAWFVRALGEKVADGLDVVGVPTSTATRDLALSVGITLVDLNDLDRPLDVTLDGPDEVDHDGDMIKGGGACLLWERMVAEASSKMVCIADDTKLVEQLGSFPLPIEVIPFGWKATRRSISALLTDLGYTDVKIIQRHRNGQPVVTDSGNFILDAHMVAITDKALLDTNLNWIAGVVENGLFTGIAHEILIASPDGAAKLIELPHRNAARIPEWRK

SEQ ID NO: 8275 - protein, 196 aa, Oryza sativa (japonica cultivar-group)
MAAAAASSSSSSAAATPQGVTERRGIPAASFVEDVETYLRQAGLDVNSGLAFLQERLQQYKIVEMKLLAQQRDLQAKIPDIEKCLDIVATLQAKKALGEALTADFELSEGIYSRAKIEDTDSVCLWLGANVMLEYSCDEANALLKKNLENAKASLEVLVADLQFLRDQQTITQVTIARVFNWDVHQRRSKQAIKET

SEQ ID NO: 8276 - protein, 492 aa, Rhodococcus sp. RHA1
MPAELITPERKAHAMTITTLHNYIDGGWVPSETTFKALNPADEKVIAEVPASTATDVDAAVTAARRAFADWRHVNPTVRARYLHTIGDIVKTRERELAEAITTEMGKTIGEATGEVDKLAKAFHFYAEEATRIHGEVIPNDVDGFASMVVQEPIGVIGAITPWNYPLELVGWKLCAALAAGCTIVIKPSQYASLSPALLFACIDEAGLPAGVANLVLGGGETGPAVAGHPGFDKLAFTGSTATGGKIARGVPAAKPLTMELGGSCPMIVTDRADIDAAVAGAARRGFRNAGQICIAINRIYVHETVYSEFVDRLTAKVSELTVGNGMDPTVDVGPMATRAGLDVVDQHVRDAIARGATVTTGGTRIETLAPGNFYQPTVIAGCNPDMLVMHEETFGPVVGVMPFSDLRNAVDLANGTEAGLAAYVYTGDLAQAHDLGRLLDFGNVAVNNVDAGIMNAPYGGRKGSGFGVEHGKAGLEGYLQYKHLRIQYGTR

SEQ ID NO: 8277 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLHDNLTLWTSDISEDPAEEIREAPKHDLSEGQ

SEQ ID NO: 8278 - protein, 367 aa, Oryza sativa (indica cultivar-group)
MASLLIASTGGAHRLAWKDAAALGPAPRLARPWPAAVAAPAPLLRTSTADITSLRVITAVKTPYLPDGRFDLEAYDSLINMQIDGGAEGVIVGGTTGEGHLMSWDEHIMLIGHTVNCFGAKVKVVGNTGSNSTREAIHATEQGFAVGMHAALHINPYYGKTSIEGLISHFEAVLPMGPTIIYNVPSRTGQDIPPAVIEAVSSFTNLAGVKECVGHERVKCYTDKGITIWSGNDDECHDSRWKYGATGVISVASNLIPGLMHDLMYEGENKTLNEKLFPLMKWLFCQPNPIALNTALAQLGVVRPVFRLPYVPLPLEKRVEFVRIVESIGRENFVGENEARVLDDDDFVLHTVNTIVYRAEFKNLDKI

SEQ ID NO: 8279 - protein, 209 aa, Zea mays
MAECEELVESGGAEEDMPRVVAALAGILERVANRNDAAAAAEVSAVAPASAFRATTKPGISVRAYMARIARFAGCSPACYVVAYVYLDRLLRRGRLLALAVDSYSVHRLLITAVLAAVKFMDDICYNNAYFAKVGGISLVEMNYLEVDFLFGVGFDLNVAPETFGDYCAVLHSELLCAEAAPAPLRLQHCCLSEDDAGAGCSAQQQLAA

SEQ ID NO: 8280 - protein, 740 aa, Vitis vinifera
MNGAVLVAIAAAIGNFLQGWDNATIAGAIVYIKKELDLESTVEGLVVAMSLIGATLVTTCSGAISDWIGRRPMLIVSSMLYFISGLIMLWSPNVYVLLIARLLDGFGIGLAVTLVPIYISETAPADIRGSLNTLPQFTGSGGMFLSYCMVFGMSLLSSPSWRLMLGILSIPSLLYFALTVFYLPESPRWLVSKGRMVEAKKVLQRLRGREDVSAEMALLVEGLGIGGETSIEEYIIGPTGELTEDQDPDAVKDQIKLYGPEAGLSWVAKPVPGGQSTLSLVSRQGSLATQTLPLMDPLVTLFGSVHEKLPETGSMRSMLFPNFGSMFSTADPQIKTEQWDEESLQREGEDYASDGGGDSDHDLQSPLISRQTSSMEKDMVPPPSHSSIMSMRRHSSLMQGTAGEAAGGMGIGGGWQLAWKWSEREGEDGKKEGGFKRIYLHEEGVPGSRRGSLVSLPGGDVPAEGDYIQAAALVSQPALYSKELMDQDPVGPAMVHPAETASRGPMWAALLEPGVKHALFVGAGIQILQQFSGINGVLYYTPQILEEAGVEVLLESLGLGTESASFLISAFTTLLMLPCIVVAMKLMDIVGRRRLLLTTIPVLIVTLLVLVIGDLVTTTTVIHAAISTACVIIYFCCFVTAYGPIPNILCSEIFPTRVRGLCIAICALVYWIGDIIVTYTLPVMLTSIGLTGIFGIYAVVCVISWVFVFLKVPETKGMPLEVIAEFFAVGARQVTAAKND

SEQ ID NO: 8281 - protein, 95 aa, Triticum aestivum
VRTIVQSLRESGVFTSAITAGQPAVNAKLSPKETNAQSQNVTAPGNMTRVVRSTDSKASGRKILQAVDLAFSDTNVTAVPPLSPPSLDEHRHHSE

SEQ ID NO: 8282 - protein, 367 aa, Daucus carota subsp. sativus
MAFIQTNTAHENSLLSKNLLFDHLKNTGKTPSSYCTRHHPMKIQGANAVNSTLVQSVNVQELLTNPRVTPGPEFHFEGYMKTSGKKINKALDEAVPVQKPAIIHEAMRYSLLAGGKRVRPVLCIASCELVGGLESWAMPMACALEMIHTMSLIHDDLPCMDNDDLRRGKPTNHKVYGEETAILAGDALLSLAFEHVADATDMVTPGRVVRAIAELGSAVGSQGLVAGQIMDICNQGKDVDLNDLEYIHVHKTSKLLEASVVCGAILGGGNVIEVERLRKYARCIGLLFQVVDDILDVTKSSAELGKTAGKDLVTDKTTYPKLMGLERAKRFATELVAQAEEELSYFGSSTRVAPLYHLAKYIAYRHN

SEQ ID NO: 8283 - protein, 118 aa, Marinobacter sp. ELB17
MSGKNNIINQIETEQMTKEIPPFAPGDTVVVQVRVTEGTRERLQAFEGVVIGKRNRGMNSSFIVRKISYGVGVERTFQSFSKLIESVTVKRRGVVRQAKLYYLRDLSGKKARIKEKLG

SEQ ID NO: 8284 - protein, 295 aa, Thermobifida fusca YX
MAPRIAVFGSVNMDLVAYVDTPPARGETVQGRQFSQVPGGKGANQAIAAARAGADVVFLGAVGDDVFGPQLRATLVDNGIDVSGLRTVGGASGIAHIVVDREGNNSIIVIPGANGTVTGLRENDTLLLDGAQALLLQLETPLSGVIAAARAGRSLGVTTVLTPAPAQPLPQELLECVDVLLPNQYEAATITGEDTPERALAALLETVPEVIITLGSRGALYGARDREPLWVPVVQVEAVDTTGAGDTFCGAYAVARTEGQDPESALRFAAKAAALSVRIPGASTSMPTRAEIDAF

SEQ ID NO: 8285 - protein, 142 aa, Brassica napus
  misc_feature (5)..(5): Xaa can be any naturally occurring amino acid
  misc_feature (11)..(11): Xaa can be any naturally occurring amino acid
  misc_feature (27)..(27): Xaa can be any naturally occurring amino acid
  misc_feature (30)..(31): Xaa can be any naturally occurring amino acid
  misc_feature (33)..(35): Xaa can be any naturally occurring amino acid
  misc_feature (37)..(37): Xaa can be any naturally occurring amino acid
  misc_feature (51)..(51): Xaa can be any naturally occurring amino acid
  misc_feature (65)..(65): Xaa can be any naturally occurring amino acid
  misc_feature (85)..(86): Xaa can be any naturally occurring amino acid
  misc_feature (94)..(96): Xaa can be any naturally occurring amino acid
  misc_feature (98)..(100): Xaa can be any naturally occurring amino acid
  misc_feature (102)..(102): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(114): Xaa can be any naturally occurring amino acid
  misc_feature (122)..(123): Xaa can be any naturally occurring amino acid
  misc_feature (126)..(128): Xaa can be any naturally occurring amino acid
  misc_feature (130)..(131): Xaa can be any naturally occurring amino acid
  misc_feature (133)..(134): Xaa can be any naturally occurring amino acid
MSLAXPIQCIXILNPSSSSSTTSSSFXFSXXKXXXFXIRCSQAEGPLRRPXAPPTLREPSPPQKXVPPVPSSSPPPSPPLQKTVXXDGKAGDTXXXSXXXGXNELQGXFXEXXXALKPAWPXXPPXXXFXXPXXGSKSFPFP

SEQ ID NO: 8286 - protein, 164 aa, Triticum aestivum
  misc_feature (130)..(130): Xaa can be any naturally occurring amino acid
DGRVICSMGLLPIKTKHRGPAQVVSDPNALDIIDEALDFFKANVFFRNYEVEGCADRVLIYLTLYIHQALNKIIGKDKGGAEKELYQLAIANFSIPGDGAFPLGGFVTNPASRADADTIRQYFTQLRQEXNIRLIARVYAFRKREPSKWWTCFSKRKFLNMSLE

SEQ ID NO: 8287 - protein, 529 aa, Zea mays
GIHQCYANAVLQCLMCTKPLMIYLLLRLHSKDCSSKKWCLMCELEQYASTLRESGGPLSPSRILSNLRNIGCRLGGGTQEDAHEFLRHLVMSMQAACLDGLGGEKHVEPSLQETTLIQQMFGGRLKSKVKCLRCYHESERYENIMDLTLEIHGWVESLQDALTQFTAPEDLDGDNMYKCGSCAAYVKARKQLSVHEVPNILTVVLKRFQSGKYGKINKCVTFPDMLDMVPFVTGSGDNPPLYFLYAVVVHVDTENASFSGHYISYVKDMQGTWLRIDDSEVQVVSVNQVMSEGAYMLFYMRSFPRPPRIYIEKGPTVPSAKRHTSKYSKGSKHEREQTELLLSANDPAYGVYDFRPDGEGYTQDQQAELRSRDFHRADDAFADSVSADFSEATSSEWSLFTSSDESSFTTESTRDSFSVVDYGDNAGLDPISSIFGPSYAPEHHPGPPGSFAACTRLSPSNPQTRYFSESTGFVSDYSSSGIVHRGRDPGRAYTCSAEPLASAAAAHQHQRYALSGRDGLVQTSGFCQM

SEQ ID NO: 8288 - protein, 178 aa, Pyrococcus sp. JT1
  misc_feature (178)..(178): Xaa can be any naturally occurring amino acid
WKREMLTIQYRMNERIMEFPSKEFYGGKIKAHESVKNITLADLGIKIEEENWKEVLDPKTVLVFIDTSKLENKWERQRRGSESRENPLEAKIVAKIVKKLLNAGVKPEWIGVITPYDDQRDLISMSVPEEVEVKTVDGYQGREKEVIILSFVRSNKKGEIGFLKDLRRLNVSLTRAKX

SEQ ID NO: 8289 - protein, 219 aa, Oryza sativa (japonica cultivar-group)
MEWAYYGSGYSSSGTPSPVGGDGDEDSYMTVSSAPPKRRAGRTKFKETRHPVYKGVRSRNPGRWVCEVREPHGKQRIWLGTFETAEMAARAQDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 8290 - protein, 628 aa, Oryza sativa (indica cultivar-group)
MAGRSGGGGGGSSGKSGTGRMVSLQEFVSSMAPLIDLEKAAEISAESATSSKTLERRGCVMANLKCTDAQFGTHDVVALKPNKADAGSAALGQGVVYRLKDSSITVAFDDIPEDGLNSPLRLEKLANEVTYRRMKDALVQLSKGIQTGPSANLIPVLFGENPPMSSKDVAKFSPFNKNLDESQKDAISKALRSRDVFLLHGPPGTGKTTTIIEIILQEVKRGSKILACAASNIAVDNIVERLSRYRTKLVRLGHPARLLPQVLDSALDAQVLRADNSSLAGDIRKEMKVLNSKLLKAKDKNTKRDIRKELRTLAKEERKRQQLAVADVIKNADVVLSTLTGASSKKLDGITFDLVIIDEAAQALEMACWIALLKGPRCVLAGDHLQLPPTIQSAEAEKKGMGKTLFERLTEAYGDQITSMLTIQYRMHELIMNWSSKELYNNKIKAHSSVADHMLYDIEEVKRSSSTEPTIILIDTTGCDMEEVKDEEESTMNEGEAAVSIAHAKLLVESGVRASDIGIITPYAAQVTCLKMMRNKDTKLKDLEISTVDGFQGREKEAIIISMVRSNSKKEVGFLSDHRRMNVAVTRARRQCCLVCDVETVSNDKFLKRLVEYFEENGEYLSASEYQS

SEQ ID NO: 8291 - protein, 178 aa, Pyrococcus sp. MZ4
WKSAMLTIQYRMNERIMEFPSKEFYGGKIKAHESVKNITLADLGIKIEEENWKEVLDPKTVLVFIDTSKLENKWERQRRGSESRENPLEAKIVAKIVKKLLNAGVKPEWIGVITPYDDQRDLISMSVPEEVEVKTVDGYQGREKEVIILSFVRSNKKGEIGFLKDLRRLNVSLTRAKS

SEQ ID NO: 8292 - protein, 272 aa, Brassica napus
RPHASAKHQGVNIITEYAMGIIYPGRPIANVCFKVYGYMSMAQAVSFLNDFKLGHYMKIPPRSMFLVQFIGTILAGTINITVAWWQLNTITNICQEELLPPNSPWTCPGDRVFFDASVIWGLVGPKRIFGSQGNYAAMNWFFLGGAIGPVIVWLCHKAFPKHSWIPLVNLPVLLGATPMMPPATAVNYNSWILVGTIFNLFVFRYRKSWWQRYNYVLSAAMDPGVAFMAVLLSFSVGMEDKSLDWWGPKGDHCDLAKCPPPKGVIVKGCPVV

SEQ ID NO: 8293 - protein, 433 aa, Sulfolobus solfataricus P2
MAIIEEARSGQITDEMKEISKLEGIPVEKVRNRISECKIILIRNAKYPSKKLVPIGKGLTTKVNINIGTSDEVVNLQMELEKVKVANRWGDTLMDLSTGGDLDDIRREIIRASELPVGTVPVYQVFIESFKKKSGGAYFTEDELLSTVEKHLKDGVAFMTIHAGITKELAIRALKSNRIIPIVSRGGDMIAGWMIHNNSENPYRKHWGYLLEMFKEYDAVISLGDALRPGATGDAHDEFQVGELLETARLVKSALKEGVQVMVEGPGHVPLNEIAWDVKLMKKLTGGVPYYVLGPLPIDVGAPYDHIASAIGAAISSAAGADLLCYLTPAEHLGLPTVKQVEEGAIAYRIAAHAGDVVKLGRRVRKWDDEVSYYRGKLEWDNMISRLIDPQRAYQVYTQFGIPKVKACTMCGGYCPMMWAMDQVRKIGSSSSL

SEQ ID NO: 8294 - protein, 187 aa, Oryza sativa
MYAVHRRRSRYKHSSPAIFLPHFPPSTQAFAKQKLRTPRIAATAALATTTAAMRTAAVLLMALALTLAAAGTGTGAELETAAIRRRQSRFLASAKNSPPLSYYDCKRKPPSVCLEPGSPGATCCKGACVDTGSSFAHCGSCNHVCKYGETCCGGHCVDLLSDRKNCGDCFVRCPSKKCSFGLCDYAG

SEQ ID NO: 8295 - protein, 498 aa, Zea mays
MTIARRLLRSNASAQAISLLKHVTGTASLQGHAHSPLDASVRHFSSAPSAQSDTTEENGFKGHGMLAPFTAGWQSNDLHPLIIERSEGSYVYDINGNKYLDSLAGLWCTALGGSEPRLVKAATEQLNNLPFYHSFWNRTTKPSLDLAQEILSMFTAREMGKVFFTNSGSEANDSQVKLVWYYNNALGRPDKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFDKVITAFGRLGTMFGCDYYNIKPDLVSLAKALSNAYVPIGATLVSPEISEVIHSQSNKLGSFAHGFTYSGHPVACAVAIEALKLYRERDIPGHVKQIAPKFQDGIRALADSPIIGEIRGLGMIMGTEFTNNKSPADLFPAEWGVGAIFGEECQKRGMLVRVAGDAIMMSPTLIMTPGEVDELVSIYGEALRATEERVSDLKMKSEKN

SEQ ID NO: 8296 - protein, 345 aa, Triticum aestivum
  misc_feature (42)..(42): Xaa can be any naturally occurring amino acid
MAFTPRGLEYCNQVETWLRCWGQWGAARTFWTSAAGPGRQLXFSVDPWARDFSTSCAAPYSAGATESQLTLGEALQEKQTDNSTVASDEKSPAPEKLKLVSGSCYLPHPAKEATGGEDGHFICVDEQAIGVADGVGGWADHGVDAGLYAKELMSKSMSAIKDEPEGAIDPSRVLEKAFTGTKARGSSTACIITLKEQGLHAVNLGDSGFIVVRDGRTVLKSPSQQHDFNFTYQLESGGGSDLPSSADVFHYSVASGDVIIAGTDGLFDNLYDNEITAVVVEALRSGLGAQGTAQKIAALARERAEDKHRQSPFAAAAQEAGYRYYGGKLDDITVVVSYVTSAAAV

SEQ ID NO: 8297 - protein, 888 aa, Oryza sativa (japonica cultivar-group)
MNYRFHNLLGAPYRGGDAVFAGDSSVLLSAVGNRVASTDLSASSSLTLPFESSSNVTRLAVSPSGDFLLSVDDAGRALYANLGRRAVLHRIAFKSAPSAVRFSPDGNLIAVAVGKLVQIWRSPAFRKEFFPFHLLRTIPGFAAGVTAFDWSPDSSFLLASCKDLTARLLPVKKGLGGKPFLFVGHRAAVVGAFFATDKKTGRVTGAYTITKDGAIFTWNLVEGSDDSPPPSPGTPEQEAVQDGEAELDGDEPELDGGSRKRKSFGESEEPDTTPLHFTRWELQKKDFFMQSPAKLTACDYHRELDMVVVGFSNGVFGLYQMPDFVCLHLLSISREKITTAIFNSLGNWLVFGCAKLGQLLVWEWRSESYILKQQGHYFDVNCIAYSPDSQLLATGADDNKVKVWTVSSGFCFITFSEHTNAVTAVHFMANNHSLLSASLDGTIRAWDLFRYRNFKTFTTALPRQFVSLTADQSGEVICAGTLDSFEIFVWSMKTGRLLDILSGHQGPVHGLMFSPINAILASSSWDKTVRLWDVFESKGAVETFQHSHDVLTLAYRPDGRQIACSTLDGLIHFWDPFDGLLMYTIEGRRDIAGGRLMTDRRSAANTSIGKYFTTLCYSADGTYILAGGNSKYICMYDVGEQVLLRRFQITRNLSLDGVLDFLNSKKMTDAGALDLIDDEDSDVEEGIDQQTRGNLGLGLPGSMANRGRPIARTKCVKFAPTGRSFAAATTDGVLLYSVDDSFIFDPTDLDIDVTPEKVEEALEENQQQRALLLSLRLNEDSLIKKCIFSVDPSNVRAICSSTPLKYLQRLIEAFSDLLESCPHLEFILLWSQELCKIHGNYIQQNSRALLPALKSFQKSITRIHQDLADTCSSNEYMLKYLCSSGTRN

SEQ ID NO: 8298 - protein, 354 aa, Erythrobacter sp. NAP1
MKIAILPGDGIGPEVTREAVKVLEAVNLPGLTLFEGDVGGIAYKRHGHPLPPETLTIAKSCDAVLFGAVGDPDCDRLDRHLRPEQAILGLRKELDLFANLRPAKVYEGLEHLSPLKPEIAGQLDMMIVRELTGDVYFGDKGERVAIDGTREGWDMMSYSETEVSRIARVAFRTARAGDDKYRVTSVDKANVLETSQVWRDTVNAAAGAHPDIELSHMYVDNAAMQIISNPGSFGVILTGNLFGDILSDLASAAVGSIGLLASASMGERRTDHGIFGLYEPIHGSAPDIAGRGIANPMATILSAAMMLRHSFGLDSEAARIEAAVEKALADGFLGGDLGGEHGTEAIGAAVRERL

SEQ ID NO: 8299 - protein, 463 aa, Yersinia pestis CO92
MADNAEKKGLHRGLEARHIELIALGGTIGVGLFMGSASTLKWAGPSVLLAYIIAGLFVFFIMRAMGEMLYLEPVAGSFAVYAHKYLSPYFGYLTAWGYWFMWIAVGISEITAIGVYVQFWFPEIPQWLPAIAGVAIVALANLAAVKLYGELEFWFAMIKVTTIIVMILVGLGVIFFGFGNHGQPIGFDNLTAHGGFFAGGWKGFLFALCIVVASYQGVELVGITAGEARNPQVTLRRAINNILWRILIFYVGAIFVIVTIFPWNGIGTEGSPFVLTFAKIGIVAAAGIINFVILTAALSGCNSGMYSGGRMLYALAKNRQLPAGLTKLSASGVPVYCIAITILCLLVGSSLNYIIPNPQQVFVYVYSASVLPGMVPWFVVLVCQLRFRQVHKAALQQHPFKSILFPYVNYLTIAFLICVLVGMGINPDTRLSLLVGAIFLALVTGCYFVLGMHKPKAMEAERL

SEQ ID NO: 8300 - protein, 360 aa, Triticum aestivum
MALASPVDYAGIITSSQRQLSSVMPRCNGLQCTIGYGNKSRATGHLVVRAMSMDRPKLDFSNPNWKNQFQEDFDRRFSLPHLTDIIDVESRPTTFSLKSRTPLENVDGSLEESWNGYVNDDDRALLKVIKFASPTSAGAECIDPDCSWVEQWVHRAGPRKQIYFEPQCVKAGIVTCGGLCPGLNDVIRQIVLTLEKYGVKNIVGIQHGFRGFFEDHLAEVPLNRHVVQNINLAGGGASISDIVDSIQARRLDMLFVLGGNGTHAGADAIHGECRKRKLKVSIIGVPKTIDNDILLMDKTFGFDTAVEAAQRAINSAYIEAHSAFHGIGLVKLMGRSSGFITMHASLSSGQVDICLIPEVP

SEQ ID NO: 8301 - protein, 108 aa, Marinobacter sp. ELB17
MDMNDTIKSQLEENSVILYMKGSPQAPECGFSAKTVQALMACGEKFAFVNILDNPELREALKVHSSWPTYPQLYISGELVGGCDIIMEMSENGELATAVKAACKKTEA

SEQ ID NO: 8302 - protein, 550 aa, Oryza sativa
MRRGKAALWRPRHGEGETSRRGGDGDGEAADRLSALPDGVLHHVMSFLKAWEVVRTCVLSRRWRNLWASAPCVDLRIRYFRLDSEPPEEPRDFVNRLFRRREASAPVDTLRLQLSDPDNLFDNDDANAWIRTAIKRNARFIHLTGHRKEIGVLKHRALVSTHLKILKLSYVLIRAAGLKQLSSGCKSLEELDLKDCVMTGHQISSASLKTLKMDRCKINVDLSITAPNLVFLNIVTPYIRVPSFKNLESLVTCSIILDDLFLGDDYQHISDEDDIDETTDDDDFGYQKNDKAGYRINYAKKGFVFGGNEDGYGYGSDIESDDNTYEYSEIANECGELQYGNNGDGHNSSKDGEYDNAETFGGQNVIHSLSNVRSLELLAGAGEVVLSRELKSCPIFINLKTLSLGEWCMDAEFDALVFLLQRSPNLERLFLEPQLISLFCKKNFNTRKALESGVKPTGRSFTCKDLQMVKIRCSKDDARVHMLAHLFRANGIPFDKIYVHRSGSSRLRSEKVMRDLAKQELEFWGSDEFWGSDYEYCGPDPEFGDSDLEF

SEQ ID NO: 8303 - protein, 706 aa, Photobacterium profundum SS9
MDNVVPAGEQKSCVTNTNVANRDIFTWIGEASPLGATAKDNGVNFSLYSKDATKVTLHLFHHQHADAPFFSFDLDPILHKRGHYWFMFVGNIGHGQVYAFQVNGPWQPDKGLRFDKDKVLIDPYSHAVCFSQNYSRQRAIDPGSNMDACMKSIVVDHRHFDWQESRTPSHSLTDTVIYEMHVGGFTKHPSSGVTDAKRGTFAGIIEKIPYLKELGITAVELMPVQQFDIHDAPEGRQNYWGYSPITFFSVHAQYSVEQNPIAAIDEFKMLVRELHKADIEVILDVVFNHTAEGDENGPTFCFKGLQSKAYYLTEGDTGKFANYSGCGNTCNANHSVLRRMIIDALHFWVTEMRVDGFRFDLASVLARDGQGHPMKEPPLLWSIDSDPILSGTKIIAEAWDAAGLYQVGSFIGDRWNEWNGKYRDDVRAFWRGDSGSVETFASRILGSPDIYCSHHHSPHRSVNFICAHDGFTLNDLVSYNQKHNYANGEDNRDGDNHNISCNYGVEGPTQIAEIDAIRNRQCKNMLATLFLSLGTPMINMGDEVRRTQQGNNNAYCQDNELSWFDWQLVEQNADLHRFVKQLSLIRRAEPTIDWNMHISLNSVIKSVDINWHGVQPNQPDWSEHSHSLALTVNHPLTNNELYVICNAYWDPLEFTLPNREHSDWHLLINTGQASPFDIYDIDDAPAYNPDSILVLGRSMVVMAAKK

SEQ ID NO: 8304 - protein, 195 aa, Arabidopsis thaliana
AVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 8305 - protein, 112 aa, Pseudomonas fluorescens Pf-5
MDTLFTKIINREIPAKIIYEDDQVLAFHDIAPQAPVHFLVIPKKPIRTLNDLTEDDKTLAGHILFTAQRLAKEQGCEDGFRVVMNCNELGGQTVYHIHMHVLGQRQMNWPPG

SEQ ID NO: 8306 - protein, 259 aa, Pyrococcus abyssi GE5
MEGVYKVRIGKPEKGYVVLVHGLGEHIGRYEKFIQELVKNGFCVVGFDWPGHGKSKGKRGHTSVEEAMKIIDEIISEIGEKPFLFGHSLGGLTVIRYAEERGEKIKGVVASSPALAKSPRTPGFMVAIAKILGRILPSVSFSNGIDPELLSRNPERVKRYVEDPLVHDRVSAKLGMSIFKNMEEAHRKAEKIKVPILILVGSGDVITPPEGAKRFYERLKVEDKKLVEFPGAYHEIFEDPEFGKEFEETIIKWLVEHVP

SEQ ID NO: 8307 - protein, 1397 aa, Oryza sativa (japonica cultivar-group)
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKVTNLRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYALHRYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLLFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEIELYEARAKFMMLYLWDNLVYVTPLRRVLGEIKFEPNVMCEHIDKKATFRASQLEDGDIICFQKSPIPDSDTQMRYPDVPSYLEYVHNRQVVHFRLLEKPKDDDFSLEMSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQKKLTRITAAVSAALGSVIVIADEIFASTYILTILSKKLYLMSRIKFGVTRSIFFSRHYDLNKAPVHLTLQLPTSPMDNPTPSSSSGGGGAAAAANASSDEHRKTSPATAADFFDEEHTFDDILLPVDLFDFTHGLDAGDGCYIENIFHHLNGQEMIPQSIRPQPTNLVRPITVPEDFDRFAALTRYREKKRNIKFIKKADYSARKEVALRMKRSKGKFAPRVQTSENSLAHRKGITFCTNCGESSDATPMMRHAPNGTKSFCNACGLMWANSRKIRKIRNPTSGEQEDQ

SEQ ID NO: 8308 - protein, 568 aa, Burkholderia vietnamiensis G4
MDRALRRAGLPSSTARRRHPPEARHSAAVPAPPCVRLHAARERAPIESRGRRRRRTDQSVPEEEVMQFNDILAALDIDLAQWKGNALTARSPVDGATLATLAVDSPADAERKIDAAHAAFLKWRTVPAPVRGELVRVFGNVLREHKAELGRLVTLEAGKITSEGLGEVQEMIDICDFAVGLSRQLYGLTIASERPGHRMMETWHPIGVCGVISAFNFPVAVWAWNAALAFVCGDPVVWKPSEKTPLTAIACHQLLAKALREFDRTHPGVAPEGLHQLVLGMRDVGEVLTSSKKVPVISATGSVRMGQEVAKVLSQRLARGILELGGNNGMIVAPSADLDLVVRAVTFAAVGTAGQRCTTLRRLIVHRSIVDQLLPRIEKAYASVKVGSPLEEGTLVGPLVDRAAFDAMQKALADAREQGGEVKGGERVDVGHADAYYVRPALVRMPKQSAVVERETFAPILYVLVYDDFEQAIDVHNAVPQGLSSAIFTNDMREAEQFMSAAGSDCGIVNVNIGTSGAEIGGAFGGEKETGGGRESGSDAWKAYMRRATNTINYSRQLPLAQGVKFDV

SEQ ID NO: 8309 - protein, 361 aa, Arabidopsis thaliana
MNQTLAAQFLTRDQVTNFVVHEGNGVKGLSETGIKVLPDQYIQPFEERLINFHVKEDSDESIPVIDISNLDEKSVSKAVCDAAEEWGFFQVINHGVSMEVLENMKTATHRFFGLPVEEKRKFSREKSLSTNVRFGTSFSPHAEKALEWKDYLSLFFVSEAEASQLWPDSCRSETLEYMNETKPLVKKLLRFLGENLNVKELDKTKESFFMGSTRINLNYYPICPNPELTVGVGRHSDVSSLTILLQDEIGGLHVRSLTTGRWVHVPPISGSLVINIGDAMQIMSNGRYKSVEHRVLANGSYNRISVPIFVSPKPESVIGPLLEVIENGEKPVYKDILYTDYVKHFFRKAHDGKKTIDFANI

SEQ ID NO: 8310 - protein, 404 aa, Triticum aestivum
MKEHKKGNIKRALGTDDGTDGLLAQGDDNTGTDLNALLPVPISKKLKKGNHRVNDMTRDEKCGVEIKGELHIRNESTDVPGTKIELPIGTPVTDIAGAELEVDDVGSALQFHEFCRTFAEVLKIRKGQPEKILQVITGGGRIGREVPSVVADLHISLLSVIQEDREENPSDYSRNGDAWIIDTGKYISESTVISKELPLDCLSQGVLGYKKLSPSLKLHVLNFLCDEALSTATLKNWVLKQHESATERRGCCKGKIPVLSRTSLFGNKEKLTIKMAKPRFLRNGAEINSLVSQIKEAYEDKKAVIDEEKLGGLVRKKPVRIDEGVAYWKLDGYCDKTAIMRQEFDATENTDKWFMFTEEEEKVIKGHVAPRPQLKRKNKTHTLAGHNALPISSSMKTQTPVSAV

SEQ ID NO: 8311 - protein, 470 aa, Pisum sativum
ASGSDENDVVIIGGGPGGYVAAIKAAQLGFKTTCIEKRGALGGTCLNVGCIPSKALLHSSHMYHEAKHSFANHGVKVSNVEIDLAAMMGQKDKAVSNLTRGIEGLFKKNKVTYVKGYGKFVSPSEISVDTIEGENTVVKGKHIIIATGSDVKSLPGVTIDEKKIVSSTGALALSEIPKKLVVIGAGYIGLEMGSVWGRIGSEVTVVEFASEIVPTMDAEIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLAGKVGHVDYDKVPGVVYTNPEVASVGKTEEQVKETGVEYRVGKFPFMANSRAKAIDNAEGLVKIIAEKETDKILGVHIMAPNAGELIHEAAIALQYDASSEDIARVCHAHPTMSEAIKEAAMATYDKPIHI

SEQ ID NO: 8312 - protein, 359 aa, Erythrobacter sp. NAP1
MQFETIPHPSPTPDAAREAAIADPGFGKVFTDHMVTIDYDEDKGGWHSARIGPREPIALDPAASVLHYAQEIFEGMKAFRHADGGLAMFRPEQNARRFNESAKRMAMPEIPEDVFLDAVKLAVKTDAKWMPGVEGGSLYIRPFMFASEAFLGVRPAKQYKFVVILVSSGNYFKGGVNPVKIWVSQDYVRAAPGGTGAAKTGGNYAASLVPQAEAIAHGCDQVVFLDAVEKKWIEELGGMNLFFVRSDGSVITPPLTGTILPGITRDSLIAMLREEGLDVREEPYSIAQWREEAESGKLLETLACGTAAVVTPVGTVASPAGEFTIGTGGIGQMAEKMRKKLVGIQNGAVDDKHGWVMRV

SEQ ID NO: 8313 - protein, 273 aa, Parvularcula bermudensis HTCC2503
MVTLRAAVIGHPIQQSLSPRLHRRWIANYGIEATFEAVDGQSPEGFRAWVAGMADHDFVGCSVTIPFKGEALAIADRRSEAAMAIGAANLLVRTPTGLLADNTDGVGFAAAAAALPLGTSRQCARVIGAGGAAPAIVWALKSLGYKRVEITNRSPEKARLIADRFDIEIIDWAARSSLEAVDLLVNSTAAGMKGQPPLDIEVDSLPKTATVIDIVTTPARTPLLRAAEARGLPVANGLSMLVHQAIPAFAAWFGPRPDDAEEALAYLEERTGA

SEQ ID NO: 8314 - protein, 223 aa, Neisseria meningitidis Z2491
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 8315 - protein, 170 aa, Synechococcus sp. WH 8102
MIESASSHAVLQEFLDNSSLAWGLVACGTAQLSKLVIELVVHRRWRPAVLIETGGMPSSHSALVTGTAACIGWTLGFDHPLFALAAMVSFVVMYDASGIRRAAGTTAERVNALPVELWPTAHDKPLKESLGHSRLQVLVGSLIGPAVALPGLVLLGSPWHLAASLRAALG

SEQ ID NO: 8316 - protein, 448 aa, Methanococcus maripaludis
MNMNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 8317 - protein, 462 aa, Thermobifida fusca YX
MTVRSGSGLAANDFQQAAKDHLWMHFTELAAYQDTDVPVITRGEGPYVYDTNGKRYLDGLAGLFVSQVGHGRTEIAEAIAEQSRKLAYFPIWTYAHPTAIELADRLADLAPGDLNRVFFTTSGSEAVESAWKLARQYFKLIGQPTRHKVISRRIAYHGTTMGALSITGLQAIKTPFEPLVPSTIQVPNTNIYRAPVHGDDPEAFGRWAADQVEEAILQNDPESIAAVYVEPVQNSGGCFPPPPGYFQRLREICDRYGVLLVSDEVICAFGRVGAYFGAQRFDYLPDIITFAKGVTSGYVPMGGLIAREHLVEPFREAGNTFLHGSTFAGHPVAAAAALANLDIFEREGLIDHVQANAPAFRATLEKLLDLPIVGDVRGEGYFYGIELVKDKETKETFTDEEAHRLLKGFLSPALFDAGLVCRADDRGEPVVQLSPPLICGPEHFAEMESILREVLTEAWQRI

SEQ ID NO: 8318 - protein, 484 aa, Thermobifida fusca YX
MTSHSDGLRRLRNFINGEYVDSVDGRTAPVVNPATGEAYAEAPVSTAEDVDRAFRAAADAFENGWRDSTPAERQIILNKIADAVEERADELVAAEVENCGKPVKATREEEIWQVTDALRFFAGAARVLEGKAAGEYMADHTSWIRREPIGVVGQITPWNYPMAMAAWKIGPALAAGNTIVLKPSDTTPVSTLLLAEIAAEFLPPGVFNVVTGDRDTGRALVDHPIPRLVSLTGSTRAGYEVAQSASRDLKRLHLELGGKAPVIVFDDADVEKAAEGIAGAGYFNAGQDCTAATRVLAAPGIHDDLAAALAEQAKKTKTAGPDETDAYYGPLNNPNQLDRVSGFFERLPDHAEVLTGGSAVDRPGYFFSPTVVSNLRQGDEMVSEEIFGPVITVQRFDDEDTAVAWANSVKYGLASSVWTKDHARALRVSRRLDFGCVWINTHIPIIAEMPHGGFKHSGYGKDLSLYSLEEYTRIKHVMSYIGRD

SEQ ID NO: 8319 - protein, 486 aa, Desulfotalea psychrophila LSv54
MPINSVLPGGTLSVKTQDDGALITSASNLAKFPDGFCWGLATASYQIEGSPKVDGKGMSIWDTYAHIPGKMKNNDTGDVAIDHYQRYKEDVQIMKEMGATGYRFSIAWSRIFPSGTGLANPKGLDFYNRLVDELLNAGIQPFATLYHWDLPQALQDKGGWQSRETAECFAQYAGYMAEKLSDRVKNFFTLNEFQNIVDMGHRGVDMVVQGKPVHIELAPGLKLDNQALNQVAHHTVLAHGLSVQAIRAMGKKGTKVGPAEVMFCGVPIMDSPEHVKAAELATRRLNARFLDVMLTGKYSDAYLQEAGKDAPKFTEEDLQAIGSPVDFVGINVYIPKMYVMASEDESGYKEVPMSVSHPKMSSPWHTFAPEVLYWAPRLTHSIWKPKAIYITENGCAASDEISADGNIYDTDRVMYLRNAMGQLQRASAEGVPIKGNFVWSAFDNLEWSGGFGTRFGLVHVNFKTQKRTPKLSAKWFKEAAGHNAVL

SEQ ID NO: 8320 - protein, 378 aa, Arabidopsis thaliana
MEKTSMFSIHEGKPIRCKAAVSRKPGEALVIEEIHVDPPQAYEVRIKIICTSLCHTDVSFSKIDRHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 8321 - protein, 567 aa, Oryza sativa
MASSALICDTEQWKGLQAHVGEIQKTHLRHLMHDVERCKAMTAEYEGIYLDYSRQRATGETMEKLFKLAEAAKLKEKIEKMFRGDKINSTENRSVLHVALRAPRDEVINSNGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 8322 - protein, 424 aa, Synechococcus elongatus PCC 7942
MDLKTLIREIPDFPKPGILFRDYTTVLKDPQGWRYSIDRLTELIKPLEPTAIVGIESRGFILGAPLAYQLGLGFVPVRKPGKLPADTHSVEYELEYGSDRLEIHQDALAPGDRVVVVDDLIATGGTASATATLIDRCSATLAGFAFVIELEGLNGRDRPWLEQYGRWLWQVVRYGNFGSSFVYQRPVADLLWERVPNTLLLAICSLITTWAIALPLGIQAAVAQNQRSDRILQLISYLGQGTPSFITALLLLFLAQFLTPLLPIGGMTSLDFEDLTPLQQMADLGRHLILPVLALTLSGFASLQRISRGEMLEVLRQDYIRTARAKGLPEQRVIYVHALRNAINPLITLLGFEFATLLSGAFIAEYFFNWPGLGRLILQAVFAQDLYLVMASLMMGAVMLILGNLLADLLLRWVDPRIRLDDLN

SEQ ID NO: 8323 - protein, 228 aa, Borrelia garinii PBi
MENQKMLVAKYAIDRYIKSNMNLGVGTGTTIYYAIKYLSEKIKSGNLKNLKLYATSSDTKYLLSKEQIPCESNFSKLNKNLDIAIDGADEILLEKKSLIKGMGGAHLMEKVIAYNSETLLIIADETKIVKKLGTKMSIPIEVAQNAVGFIMTRLEEMNLDTTLRVCKEKKGPIITDNNNYILDVKMHVENPEGTEKYFKLFPGILEIGIFNHKNTKIVYYQNKQIKEA

SEQ ID NO: 8324 - protein, 1270 aa, Arabidopsis thaliana
MNPREFISNLPDEILGKILSLLPTKLGVSTSVLSKRWRNLILLVDNFDLEDSSTSGFSAFLEQTVARLNTCPIKRLSLNGRHYRFSSADSWISTAFERGCLELHLQSQYLDTGILSSNTLVKLTLSDQIYLQGLVPHDGTVFFPALKTLSLGAVVADRDVYESLISGCPVLDELSIRDGCDDPPTWKKSVVNKSVKRLTVSFHHPMSAWAYEDNVWFKTQSLVFLDYSAFVSQGYTIVDRMDSLVEARLDLRLWVSTDSYDSDYEDKDFDVYRPYDVFGDVTSLVSGIRKVKTLHLSPDSLEAFFFCCNHMPVFNNLRNLSLESDEEKGWQALPLLLNNSLNLHTLSIKGLVHRVTSRCGDACACISERKTGMCCLSACRIKVLEITGYGGSFIELKQMRHFLGKLQCLETVRIGVERDGNNEHLRANLSSLHRASSECNIHFCGILNLVASVLAMTEVASSVVYEVLGRRAQDVDEPIMDYIINVLADEDFDFGEEGEGAFDAVGELLVAAECVSDFEECRLVSNHSQLVCSKLSDKFGKHGLVKPTPTVRSLAMPVRMNDGMDDGPVKKKKPEPVDGPLLTERDLAKIERRKKKDDRQREVYSNGSFFTGFELRICFLSCVYLLLQYQQHVAEMEAAKAGMPTVSVNHDTGGGSAIRDIHMDNFNVSVGGRDLIVDGSITLSFGRHYGLVGRNGTGKTTFLRYMAMHAIEGIPTNCQILHVEQEVVGDKTTALQCVLNTDIERTKLLEEEIQILAKQRETEEPTAKDGMPTKDTVEGDLMSQRLEEIYKRLDAIDAYTAEARAASILAGLSFTPEMQLKATNTFSGGWRMRIALARALFIEPDLLLLDEPTNHLDLHAVLWLETYLTKWPKTFIVVSHAREFLNTVVTDIIHLQNQKLSTYKGNYDIFERTREEQVKNQQKAFESSERSRSHMQVSFLLLENELINSVSNSSLAFIDKFRYNAKRASLVQSRIKALDRLAHVDQVINDPDYKFEFPTPDDKPGPPIISFSDASFGYPGGPLLFRNLNFGIDLDSRIASKKAPPLSLDYEITQMIHVYKPSSIICGNNKCSIKEHNFNLYIWFSRRFAVVGPNGIGKSTILKLISGDLQPSSGTVFRSAKVRVAVFSQHHVDGLDLSSNPLLYMMRCYPGVPEQKLRSHLGSLGVTGNLALQPMYTLSGGQKSRVAFAKITFKKPHLLLLDEPSNHLDLDAVEALIQGLVLFQGGICMVSHDEHLISGSVDELWVVSDGRIAPFHGTFHDYKKLLQSST

SEQ ID NO: 8325 - protein, 248 aa, Borrelia garinii PBi
MYKLVLVRHGESEWNKENLFTGWTDVKLSDKGINEALEAGLLLKQEGYSFDIAFSSLLSRANDTLNIILRELGQSYISVKKTWRLNERHYGALQGLNKSETAAKYGEGKVLIWRRSYDVPPMSLDESEDRHPIKDPRYKYIPKRELPSTECLKDTVTRVIPYWTDEIAKEVLGGKKVIVAAHGNSLRALVKYLDNLSEEDVLKLNIPTGIPLVYELDKDLNPIKHYYLGDESKIKSAMESVASQGKLK

SEQ ID NO: 8326 - protein, 1117 aa, Oryza sativa (japonica cultivar-group)
MTAAARRRQLQGSVLAGKMVLVRKALDTNLNSGDVVCQLVSSTVGDPGGGDPPVSSILARAFAPQVTFKSPPAFRGGRFPFPAKSSTSLSLSGLITALATPFRADGALDPDGWQRLLHLQLEGGVHGVVVAGSTGEAATLTDAEYDLLLASAVERIGGRIPVMAGTGLSGTAKTIEQTRRAAALGASHALVVTPPYVRPTQAGLIAHYRAVADQGGLPVVLYNVPGRTGCDMQPETVAELASHPNIVGIKEAVGDTGRVQALLALRSPQFAVLSGDDGTAARSIQAGIDGLISVGSNVLPGAYRRMCELAAAHDHEATASWDARLHPFHDFCGVEPNPIPEIHMRQSVSTVRVLSYALLAVAVAAGTTGCFKRGAKGDYALAPEMRPLEVPPDLNLPNATTDNKVPTLASATKPAAPVAAAPAAGSTGFTIAGGKDEAFAKVGTALEGVEGVTIASRAQLLGSYDVAYEGSNFLVRVVAVDAGAYISAVDPRGLPATAEAPVKLIAALKAKLAHRRFSALQQLQLVRLAIPFAGVGGRVLAHGQHRPLLRQLGVEGNEAFLSGRNIVLREDRIDRALRLAEGAVDALIRVDHQEVRAFVEAIHGAHFHAIGVFALDAVFGDDKGHGLGGGSIPEPANSRTGSSMSQTQPSTAPQGGENTAFIVLISCVATLGGFLFGFDSGVINGTVDGLRQAFNSSEAALGFEVASMLLGCAIGAFLAGWLGDRLGRRGVLIVSALMFLVSALGAGAAHASWLFIAARVLGGFAVGAASVMSPAYIAEVASARYRGRLATVQQMAIICGLFAAFLSNYLLARAAGASTAPLWLGHEAWRWMFWMQALPSGLFLLLLLVIPESPRFLVLKGRQGQARAVLARLYGEAAATAKQAEIEASLAQDQHKPRFGDLRNKATGKLRPILWVGIGLAMFQQLVGINVVFYYGAVLWQAVGFSESDALLINVLSGALSIGACLLTVLLIDRIGRRPLLWVGSVGMSVALVLMVVAFASGSLVDGRLQLSDGMGRLALVAANVYVVFFNMSWGPVMWVMLGEMFPNQIRGPALAVAGAAQWTSNFAITVTFPMLLAGIGLAGAYGIYAVAAILSIVFVVRYVRETKGKELEQMEG

SEQ ID NO: 8327 - protein, 5930 aa, Oryza sativa (japonica cultivar-group)
MPLGNPETSTGSANIISPATSPFSLRVIPRDQHTISRKDISPNALRVLYRLRDAGFGAYLVGGAVRDLLVNGQPKDFDVATDATPEQVKQLFRNCRLIGRRFRLAHVVFGREIIEVATFRANSDDGSGDREMENGMLVRDNVYGTIEDDAIRRDFTCNALYYAIEDFSVRDYTGGFEDVQARLMKLIGDPEQRYREDPVRMLRAVRLAAKLGFQIEEGTAAPIPHLAGLLNEAAPARLFEEVLKLFLSGHGVASFEGLERYGLLDVLFPESAKALKSNRTGALRRMLVEGLANTDARVANDEPVSPAFLFALLLWPAFCRAQATLLKQGVAPEEAQRRAADRVTVQQLSTIALPRRFSLPMQEIWLLQSRFSSRQRKRVFRTLTHPRFRAAFDFLSLRQVASSEHAVDVEFWREAQAQSGRELESSLDAMHSEDGDDESGAPRKRRRRRRRPDQPPFVNAVAAVETTLPADELLQAMLALERGFGRVRDPAVHWGPRALDLDLLLYGTQVLDQPGLQGDNDRVISPGYQHMSTHADSKPWTVPALAEAKRNGQKLVMLTAYDAGFARTFDANGVDLILIGDSLGMVVQGHDSTLPVTVADMVYHTRAVARVLQRALLVADLPFGADATPERALDASLQLLQAGAEMVKIEGAGFKVDIIRYLVEREIPVCAHLGLTPQSVLRLGGFKIQGRGDAARQLVEDARAVAAAGASIMVLECVPTPVAAEVTAAVDVPTIGIGAGPQCDGQVLVLHDFLGLDSGHRRPKFVKDFLAEGGSVAGATRAFADATFNELGALRGQIAQWKREGLRVALVPTMGNLHGGHHSLVALARQYADKVVASIFVNPTQFGPNEDFSRYPRTPEADVAGLEQAGCDAVWLPSVEAMYPLGVDKTTRMHAPGVSEVLEGASRPGHFDGVCTVVARLFLQVQPDVAVFGRKDYQQLAVIKQMVAELSFPVQIVGAEIVRDEDGLAKSSRNQYLSAEQRPVATTIHRTLLGMREGYVAGQARERIEAEATAALQAAGFQVDYAVLRTPELAEPTFDGGGRVALIAARLAPSMHLSLLKTKIHRATVTHSELNYEGSIAIDDNLLAATGIREFEQVHIWDVTNGARFSTYAIRAEAGSGVVSLNGGAARHVQVGDIIIIAAFASMTEQEADSFKPKLDLALRVGPLYVNFARQKYDAAALQALLALAADRDVGGAITRLFRGEQVNLTEGRAALHTALRGDVVDAPVAAEAYATARGIRQRMGVLVRALEDSGVTDVVSVGIGGSDLGPRLVADALRPVTGARLRVHFVSNVDGAAMQRTLATLDPAKTAGILISKTFGTQETLLNGQILHDWLGGSERLYAVSANPERAAKAFAIAADRVLPMWDWVGGRYSLWSAVGFPIALAIGFERFEQLLEGAAQMDAHALDAPLERNLPVLHGLTDIWNRNLLGHATHAVMTYDQRLALLPAYLQQLVMESLGKRVQRDGQPVTVDTVPVWWGGAGTDVQHSFFQALHQGTSIVPADFIGCVHNDDPYTINHQALLANLLAQTEALANGQGSEDPHSDYPGGRPSTLILLDALTPQALGALIAMYEHAVYVQSVIWNINAFDQFGVELGKQLASGLLPALQGEDVAAADRRHCIGHFHFAIVGRAVVLLTEGAQDHRHRGRLRQVIIRAQLDRLHCGGDAGIAGHQQDAHVRAQCAQRLDQRQAGIAAQLQVDQRERRRMLAGQCQGTGGILCGLCFQALAGQAALQGTQRQAEADAAAGPLGRAHPHLAVEAFDGGMGQGQADAHALALAAAEQLARQHGGTGVETMAVVAYFADQVVALDAQVQVHARPAGLLAGIGGIVEQDHQQMAYARVEWQPQRRIVVAMQVDGRPHQAPLLQHLLGAGVAATRCIGRSRGGQCQHALAALNQQLAQGLHVLAHFRLFAALGDIVGEQGHGRQRRVQFMCHRGGMGGQGDDALVAGEALTQRRQFQFALPQGQCQAGGEGQHHCGGNQEVGDHAPAIEIGGVTVGGGKPVVVQSMTNTDTSDVASSVKQVAELWRAGSEMVRLTVNTVEAAAAIPRIVDKLAMMGIDVPLIGDFHYNGHQLLTAEPACAEALAKYRINPGNVGFGKKKDLQFAQLIEFAIRYNKPVRIGANWGSLDQALAARLMDENNLREQPWDAGRVLREALIRSALDSAEQAVELGLPRDRIVLSAKVSGVQELIAVYRDLAQRSDFALHLGLTEAGIGSKGIVASSAALSVLLQEGIGDTIRISLTPEPGQSRTQEVIVAQELLQTTGQRAFTPLVTACPGCGRTTSEFFQELAKVVQNHVREKMPLWKIHHPGAENMTLAVMGCIVNGPGESRHANIGISLPGTGETPAAPVFVDGEKKRADLLIRNATVVDVEHASTLAGQSVVIRGEDIVAVGPDAQLRSQWSAARQIDAKGKYLIPGLWDMHVHFGGGPALIEENKALLPLYIAHGITTVRDCSGDLPEQVLQWRGEIAKGTLFGPRLLSSGAKIEGIKPVWKGTIEVGSEADADKAIARLQHDKVDFVKITDSTLKPELFLYSASAARKAGFKASGHIPMALTVEQAVDAGLASIEHLDYAFKAGSKDEAQIAADFEAGRIDRAEANRRLDASFDRDTAMRAYRDFAKRGVFVTPTLNGGRILDFLDQDDHANDPYLAYIGPGLRATYQWRVDRAAKATPAQIEARHAQYHQVAAVLPLLQEAGVTIIAGTDAGFLNSFNFPGIALHQELQLFVKEGLSAPQALSAATRSGPAWFGQMDRYGGVAQGKAADLVLLTANPLQDIAATEKIDSVILRGNVYDRAALDRMLADTKAKVVAEQARADRKGMRVPLRVMQQQSFARGRRHDDARYFGQRQRDHARFVDRAHPHRAVDAFCNEIRTPIFKDPLQAQLRMPGEECEHGRQQLRLAEGMRHHHPQTAAQCFRLAVEFGLQRLPFVDHALRMALAAQAILGQLQAMGGAQQQAQAELPLQCLQASADRWLGGAQLRGCGREAAGIDDAQEGAQQIQAIGASAYYRRWANAGRIRPLLPPDSPMSTPSLSVAAAPATAPSTPLVLAMAAGAGFSVASLYYSQPMLGLIAQDLGAGERAAGLVPTLTQLGYAMGILLLAPLGDRFDRRNLILLKSALLALALGAAAMAGHLPGLLMASLLVGLMATLAQDIVPAAAVLAPDAQRGQIVGRVMTGLLLGILLSRVVSGVVAEAWGWRTQFVLAAVSVAAMGAVMARALPRFAPTSTLRYPALLGSLLALWREQPQLRRAVASQSLLAVGFSAFWSTLALMLHARLGLGSAAAGAFGIAGAAGALAAPFAGRFADRLGCHAVARLAIAVALLGFGLLLAESWLPAVALLPLLVVSALLFDFGFQSALVAHQTLVYGLVPPARSRLNALLFTGMFIGMAAGGALGSLALAQWGWHGVAWLAVGPAPTRWAAVIQAPGGNRQRDFGSQSGAGPQLQFRTEALCAFAHALQAPMTMAGVLVGDADAIVAHVQQEATRAWWRRALNGQAQRIGAMPRVLGVHIGQCRSQVAAGERAVAQCVDAFAALGQIALGQLHRRLQLAAHCFWRLRGLADFMQAQDQALAALQQGVVQIARNAFTFAISLLQAGAEQRGELATSDAHGQYEQRQHGGHAQQLEPHGLDEGGRDAEAAAGRDRAPDAVLIGGFHVEAIASRRQAQAVPQWLLFAAIQHVADANAGCQCVDVRTLGVQPGQALVGRQPQKTVVGQRGGGDRPALQGNAGHAIHRIEQAGRHLLPCLHCSAQQAALKTHQATAAIEPQMPARIGDHAGDAFEDAGHVGAHCNEGPLADACGESGFAGYQQQVLMLQQGGHRPYRKALRCAEGIDGRGAHPAHATIGVAEQQLAMGVQRQGGAGLLGQATRPLPLLVPVMQHTAFARAYPGLRLVRKQQGVQRLPGERRGQRNQRGTAFDSARQIDPIELPDRRRCLPRCGLQLCGAAFQQGPPQVVGLEVFTVAVHPSVSGAHQRAVGITGADRQGVHAARAEAVEAKIGTYPEVAFARAVGGELHAGSDQVGQAPRLTFGPGQQTMCVCQWRGATDAVGQPYLTLRVFHQCCHLRDGDAGINEGRLVGSAHPYLQIRQYPERATAVMQHPLHAVFRQPGGGRRGLPAPAIEPAQPTIDRCPEAALAVLAEVRHHADRYALLPTVVVQLAACELADAGLEVADPHCVIAPDCQGDHVGGREAAARWWRLAFKTAAVEAVQARTSRQPQQSITVLRNVPYIARRTLADPPCRVLVAGQSAAQGGALHGERGQGGHQQQARQQRRRLVVGLVPAGRSDARTWCADTTGGSDGGRGSVHAARALATGAAASGPAGAGAGRLFAGRTAVRSPRDRPPASPIRAPRTMGHPLAATSMATVTPQEFPAASLAPQQVAALQRALRYVDEHLSQPLRVTELAAAACVSRFHLVRLFRTGTGASPLRYVRRRRIERARQLLPGAQLPMACLAQQLGFFDQSHFVRSFRAETGCSPGHPSMSLATATPAPALLSPTDHALVLIDFQSQMAFATHTIDISALRNNVSLISKGAKGFHVPVLLTTVAEASFSGPMFPELPQIFPGQTVFDRTSMNTWEDQPVIDEINRIGKRRLVMAGLWTSVCIVGPALSALAQGFEVYVITDACGDVSEEAHERAITRMVQAGAVPMTSVQYLLELQRDWARGETYDLTTGIARDHAGGYGIGIQLPAAARAGQAVRLVRRSGALWFRHRAARLRAANGCTFATVAGPVAGAVRAGRAAGMADPYRRACGGRFHRLHRPVGPAQRMVLDARWHLAGRAGAALDSTSKERRMSTLVIRNARITTLDPQQPHAQALAVQDGRIVAVGSDEDIMRGWGNEATLIDAQGRRLLPGLNDSHTHLIRGGLNYNLELRWDGLRSLGDALDMLKAQVDRTPAPQWVRVVGGFTAAQFNEKRLPTLQELNDIAPDTPVFLLHLYDRALLNRAALRACGYSKDTPDPPGGQIVRDSLGNPTGLLLAKPNALILYATLAKGPRLPIEYQANSTRHFMRELNRLGITSVIDAGGGFQNYPEDYQVIEQLHRDDQLTVRIAYNLFTQNKGREVDDFRGWSEILQPRQGDDLLRHNGAGEMLVFSAADFELFNEPRPELPPELEPELHNVVKLLVEKRWPFRIHATYDESISRILDVYEQVNREVPFDGLHWFIDHAETITPRNIERIRALGGGIAVQHRMAYQGEAFVERYGVQAARHTPPVKRMLAEGVPVGAGTDATRVASYNPWVALSWLVTGRTVGGLALYGDENLLEREQALRLWTQGSACLALLAVPSLALACEGGHCTGAGGGQLRWDASLRLRGLYYDPTRFGIGGSEDGHGLLRALASATYAEDSWQAKLQLGLHAENGKAGGPGRTDRSALDVQQAYWRWQRGSFHLQLGRQEAGYGSSRLLSVRDGPNIRLAFDGARVGWKGRLGTLDLMALRPVENRPGAFDDRGEHGAHLWGAYATTVRGQGAGQWDLYLLDYRREGARFSAGFGIERRQTVGARWAVELRTSAATLDIRAWTLATDTGWRWTDLPLQPRLGLKADIASGDGNLHDGRLGTFNALFPKSAYFSEASLLAPANLMDVQPTLTLRLHDAVTTELGVQMAWKHRRADAVYTTPAPLVALPGTAGGARRIGQRTLAMAAAAGLGRCGSCAEAGRWPGHAVCLDRWSMAMVNATASQPPAQAAGAWSPLKIRMFRSIWLAILASNIGTWVNDVAAAWVMAERTGSPLMVALIAAQTAVPAWVRARALALYIMVFSAGMAAGGLSWGALAQRTSPELALLVAAAGAVIGGLLVWRVRIAGTEDLNLRPAGHWPAPELSVPVSNDRGPVLVTIEYRIDDADRAAFQAQMRALGTIRRRDGAVVWGVVEDVASPGIHLEYFVTPSWLEHLRQHERITADDKAIQEVLRELHRGERAPVVRHFVGGHDPLPKTGVPHHHSDI

SEQ ID NO: 8328 - protein, 423 aa, Zea mays
MGDKENAPPLGARGAAAPRLTRAAAKRAAAAAAAAEGPGDAKRRRVALGELPALANNAGLRAPSCPVKPSKPASRPGRHARNVAPEARGPSSAHEAERCASSPPRTADADAESNSVSNPAPRATAYADSCASSSPPRAAAAGAPADPQLCGSYASDIYTYLRSLEVEPQRRSRPDYIEAVQADVTAHMRGILVDWLVEVAEEYKLVADTLYLAISYVDRFLSVNALGRDKLQLLGVASMLIAAKYEEISPPHPEDFCYITDNTYTKEELLKMESDILKLLKFELGNPTIKTFLRRFTRSAHEDKKRSILLMEFLGSYLAELSLLDYGCLRFLPSVVAASVMFVARLTIDPNANPWNMKLQKTTGYKVSELKDCIVAIRDLQLNRKFPSLTAIRDKYKQHKFKCVSTLLPPVVVPTSYFEDLAE

SEQ ID NO: 8329 - protein, 709 aa, Oryza sativa (japonica cultivar-group)
MPAPLVPYREEELRNLRGDDNPGPYKDHDRVYRYDVYNDLGEPDSGNPRPVLGGSDEHPYPRRCRTGRRRTNTDPDSESRNVGFPLTNHFYVPRDEVFNDRKKAYFDTNNLKLYIMQKYATFLLHADQQTPFEFDSFADVLSLYDEGSINLPGWLNTFLQPLLGIIPFKLLQQVLTPDSEFILKFPMPAVIREDKTAWQTDEEFAREMLAGTNPVVIRRLGETEFPPKSKLDTSKYHNQNSRITAAHVEKCLEVEGLTVEQVLADGRLFILDHHDHFMPYLLDANHQPDTFVYATRTLLFHRNDGTLQPAAIELSLPRFEAGSTLISSVGEVYTPASDGVEGHIWQLAKAYVTVNDYSWHQLVSHWLNTHAVMEPFAIATHRQLSVAHPIHKLLHPHYRDNLFINALGRQSLINAGGSSENTVFLGKYGLSMTSEVYRNWNFTEQALPEDFIKRGVAKRRSNGELELLIKDYPYAVDGLAIWSAIETWVRDYCAIYYADDAAVQGDAELQSWWKDVREEGHGDLKDHKWWPEMKTVAELVQSCATIIWIASALHAAVNFGQYMYAGYVPNRPSVSRRPMPKPGTDLYRELELHPEKEFLLTITKQDLSIAGIALVELLSSHSDDEVYLGQRDSPNWTSDLDAMNAFDRFRERLLEVEKNIVAKNDKGSGFKNRTGPVNIPYNLLFPYASGDAEANTGVTGKGIPNSASI

SEQ ID NO: 8330 - protein, 424 aa, Oryza sativa
MAFHYHDHALAMDAAAAAAETGGHHHPEIVGAGGVVGGGGRGSFANVPPTALVKITHSIFHINCPVNGGSPAHDQKQQVSSKIASFQQFIAHDFDASDHGTSSFPVAAVHRIGILDIRIFNTDRHAGNVLVRKLDGGTGRFGCQTELFPIDHGLCLPENLEDPYFEWIHWAQSSIPFSEEELEYIKNLDPMRDVAMLRRELPIIREACLRVLVLCTIFLKEAAASGLCLAEIGEMMTREFRGLEEEPSKLEVVCMEARRKLAEWEPYSPVIEQGEDMDFQFSLDMLGEYNDVIRSPRFNGLGAKGNGFRNPLSKLVESIDEDNDDDDGRSESSKRSSERVHSGGLKFPSADKSSGSNGSVHALNRSADEQLPSSVYFVRLSDMNAEEWNIFLEKFQELLKEALQERAAAAGQRMKQRLGTSCKF

SEQ ID NO: 8331 - protein, 451 aa, Arabidopsis thaliana
MDEDREKHVRAKGSDEVDWISKLPDCLLCEVLLNLPTKDVVKTSVLSRRWRNLWKHVPGLDLDNTDFQEFNTFLSFVDSFLDFNSESFLQKFILKYDCDDEYDPDIFLIGRWINTIVTRKVQHIDVLDDSYGSWEVQLPSSIYTCESLVSLKLCGLTLASPEFVSLPSLKVMDLIITKFADDMGLETLITKCPVLESLTIERSFCDEIEVLRVRSQSLLRFTHVADSDEGVVEDLVVSIDAPKLEYLRLSDHRVASFILNKPGKLVKADIDIVFNLSSVNKFNPDDLPKRTMIRNFLLGISTIKDMIIFSSTLEVIYDFSRCERLPLFRNLSVLCVEFYGYMWEMLPIFLESCPNLKTLVVKSASYQEKGENIILPGPRRFLSSLEYVKIERPLKGEAMEMKLVSYLLENSTILKKLTLCLDDSVKKEDSVILKELLAIPRLSTSSKVVVL

SEQ ID NO: 8332 - protein, 220 aa, Thiomicrospira crunogena XCL-2
MTQDELKQQVAIAAIEYVVPDTFIGVGTGSTANFFIDELAKIKGKIKGAVASSEATAERLKDHGIPVMELNSVDELSVYIDGADEADPKLNLIKGGGGALTREKIVLAVAKQFVCIADDSKKVAVLGKFPLPIEVIPMARSYVAREVVKRFGGEPVLREGFTTDNGNVILDIHGLEITDPVAMETELNGIVGVVTNGLFAARNADIFLCGTANGVETIKA

SEQ ID NO: 8333 - protein, 239 aa, Magnetospirillum magnetotacticum MS-1
MPDLDTIVRDIAEEMRARPDRGEVARYIPELAGVDPQAFGLVVIDGDGRAAVGGDADIPFSIQSISKVFTLTLALGMVGDRLWRRVGREPSGSPFNSIVQLERENGIPRNPFINAGAIAVTDVILSGHQPREALGEILRFMQFLAQDNGIAIDEKVAASEKRTGFRNAALANYMRSFGVIENPVDYTLGVYFHHCAIAMSCRQLATAGLYLAYSGLHPLADTRDLGRAARGQLNHGQVP

SEQ ID NO: 8334 - protein, 555 aa, Oryza sativa (japonica cultivar-group)
MAMATATASSCVDATWWAYALPALLGADTLCAHPALLAGAVLLAFATAAVLAWAASPGGPAWAHGRGRLGATPIEGPRGLPVFGSIFALSRGLPHRALDAMSRDAAAPRARELMAFSVGETPAVVSSCPATAREVLAHPSFADRPLKRSARELLFARAIGFAPSGEYWRLLRRIASTHLFSPRRVAAHEPGRQADATAMLSAMAAEQSATGAVVLRPHLQAAALNNIMGSVFGRRYDVSSSSGAAADEAEQLKSMVREGFELLGAFNWSDHLPWLAHLYDPNHVARRCAALVPRVQAFVRGVIRDHRLRRDSSSTAADNADFVDVLLSLEAHENLAEDDMVAVLWEMIFRGTDTTALVTEWCMAEVVRNPAVQARLRAEVDAAVGGDGCPSDGDVARMPYLQAVVKETLRAHPPGPLLSWARLATADVGLANGMVVPAGTTAMVNMWAITHDGEVWADPEAFAPERFIPSEGGADVDVRDGDLRLAPFGAGRRVCPGKNLGLATVSLWVARLVHAFDWFLPDGSPPVSLDEVLKLSLEMKTPLAAAATPRRRRAA

SEQ ID NO: 8335 - protein, 114 aa, Brassica napus
TPPPPQQLPPATHSSQAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGR

SEQ ID NO: 8336 - protein, 585 aa, Raphanus sativus
MCGILAVLGCSDDSQAKRVRVLELSRRLRHRGPDWSGIYQNGGNYLAHQRLAIIDPASGDQPLFNEDKSIVVTVNGEIYNHEELRKGLKNHKFHTGSDCDVIAHLYEEHGENFVDMLDGIFSFVLLDTRDNSFMVARDAVGVTSLYIGWGLDGSLWVSSEMKGLHEDCEHFEAFPPGHLYSSKSGGGFKQWYNPPWFNESVPSTPYEPLAIRRAFEDAVIKRLMTDVPFGVLLSGGLDSSLVASITARHLAGTKAAKRWGPQLHSFCVGLEGSPDLKAGKEVAEYLGTVHHEFHFTVQDGIDAIEDVIYHVETYDVTTIRASTPMFLMSRKIKSLGVKMVLSGEGSDEIFGGYLYFHKAPNKQEFHQETCRKIKALHKYDCLRANKATSAFGLEARVPFLDKEFINTAMSLDPESKMIKPEEGRIEKWVLRRAFDDEERPYLPKHILYRQKEQFSDGVGYSWIDGLKAHAAENVNDKMMSNAAYIFPHNTPLTKEAYYYRMIFERFFPQNSARLTVPGGATVACSTAKAVEWDASWSNNMDPSGRAAIGVHLSAYDGSKVALPLPPHKAIDDMPMMMGQEVVIQT

SEQ ID NO: 8337 - protein, 126 aa, Triticum aestivum
  misc_feature (53)..(53): Xaa can be any naturally occurring amino acid
MAFWQARDFLFCGVCGTLLDFNSHRYASCPLCGFKRKAKEIEGKETRYAVTAXEDIRRELKINRCGVLKSAPNMDIVVQRSLTERACPECNHHELEYYTKQLRSADEGQTIFYECPECGYAFNENT

SEQ ID NO: 8338 - protein, 426 aa, Thiomicrospira crunogena XCL-2
MSNSHTLFEAAQAHIPGGVNSPVRAFKGVGGDPVFFESAKGAYLTDADGKQYIDYVASWGPAILGHTHPDVIKAVQTQAEKGLSFGAPTEIETTMADMVCDLIPSMDMVRMVSSGTEATMTAIRLARGYTGRDKIVKFEGCYHGHSDSLLVKAGSGALTLGVPSSPGVPACLAQETLTLTHNDSEEVKKVFSEIGDQIACIIVEPVAGNMNCIPPEDGFLETLREVCDESGAVLIFDEVMCGFRVGLTGAQGRYNITPDLTTFGKVIGGGMPVGAFGGKKEVMQHIAPLGPVYQAGTLSGNPIAMTAGLKTLELISKPGFFEELEAKTTKLVNGLQKAADEAGIAFTTNQVGAMFGFFFSEEKDIRRFSQVAKGNMEQFKAFYHGMLDEGIYLAPSAFEAGFVSSAHTDQDIDDTIAAAKKVMATL

SEQ ID NO: 8339 - protein, 420 aa, Zea mays
  misc_feature (16)..(16): Xaa can be any naturally occurring amino acid
  misc_feature (18)..(18): Xaa can be any naturally occurring amino acid
MPATDLQGSSPFSSFXRXLLSLRRDAPASASTAAAMPPPGVDPELEEFHAHVAAHLADLSGPGAAGEEEFMSIAWIRRLLEAFLLCQEEFRVAVAEARRRRAGATPPAAERLVAEFGDRAVKVLDVCNAARDGVDQARRWERLAGIAASALLAPADGQIHEGQLRRARKALSDLSVLLIDDAAAAAATGPAGGLASILASHRNRSFGRARASPSRASSSSSSSSSPSAHFRSLSWSVSRTWSAARQLQAIGAGLAAPRATEASCGFAAPAYAMGCLLHLAAWALVAAVPCPDRAAALQAHHLPAAPPRAAFPWAPPLLALQERLAEEGRRKDRRSSCGLLREIHALDKCAQRLAEAIDAAPVPLTGEREAELREAAAELAAACSAIKDGLDPLERQVRELFHRIVRSRMAGLDPPMANAD

SEQ ID NO: 8340 - protein, 684 aa, Oryza sativa
  misc_feature (624)..(624): Xaa can be any naturally occurring amino acid
MPSLALLRAVAMALLLLLARSMEGVDGAGGGGNATCPLDLSYVTTFPWDADLCAGGAGNMTRCCNTLLSVLAIGLAEQVRATGHFRIPSVGESAACLKDYGAKLSAAPLSLPGASLVQTCFPSPEQFVSSPSFCAGVTTAAEYRAVVGNDSVAALDSACGDLSSTPHCLRCLDAGIAATSRLKAAANISANATTDGAATTRNCFYLTVTYAAGISNVAGPTNPPTAACTLGLALSNPPAAPPKSHDTVIYATAIPVAFLLLASLLAFLVWRRHDKKKKKKKIHEISKEGSAKRRSHPRPNTGSILYDIAELSKATDAFADRNLVGRGGFGAVYCGVLADGSVVAVKKMLDPDVEGGDEEFTNEVEIISHLRHRNLVPLRGCCIVDDDAEEGKQKFLVYDFMPNGALEDFIFRDGKRPALTWAQRRSIIMDVAKGLEYLHYGVKPAIYHRDIKATNILLDGDMRARVADFGLARRSREGQSHLTTRVAGTHGYLAPEYALYGQLTEKSDVYSFGVLVLEVLSARRVLDMSAPSGPVLITDWAWAHVKAGQAREVLDGALSTADSPRGGAMERFVLVGILCAHVMVALRPTITEAVKMLEGDMDIPELPDRPLPYGHSAMFSEAGXSNFSASPAFSGPFIDNGDTAPGACRQEVHLSLGAIQESSQPHYITTTADMDVVLLQILVN

SEQ ID NO: 8341 - protein, 138 aa, Catharanthus roseus
MASKSTSALALFLALNLIFFTLVSACGDCPKPKPKPKPKPKPSCPPPPYVPKATCPRDALKLGVCADLLGGLISAVIGAPPKTPCCSLIEGLADLEAAVCLCTAIKANVLGINLNVPVSLSLLLNVCSKKVPEGFICA

SEQ ID NO: 8342 - protein, 356 aa, Magnaporthe grisea 70-15
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 8343 - protein, 684 aa, Fulvimarina pelagi HTCC2506
MIKITAEYGCPERLGATPTGDGTHFAVVSENADAIELSLFDEFGTREVARLTLPGAEGIVRYGFVRGLNAGTRYGFRAHGPYAPHEGHRFDPSKLLVDPYAVQLDRPFQFHPVLKAPPAHRYDTAPLMPKAIVTDLFRDGEPMAFRAPGFTYEILVRAFSQLHPEIPDQFRGTVSALAEKPLLDHLERIGIETVELMPLAAWIDEEHLVRLGLTNAWGYNPITHMALDPRIVPGGFPELRRVVDALHRRGIRVILDVVLNHSGEGDENGPTLSYRGLDNKLYYAHETDDPGKLVNHTGCGNMFAVWRDPVMKLSIDTLRTFVEAAGIDGFRYDLAPVLGRLPTGFDVNAPFLQEVAIDPVLKDRIHVAESWDIGPGGYQVGQFPSHWFEWQDRFRDGVRRFWRGDAGAVADLATRLAGSADIFNQFGRRPSSSVNFVAAHDGYALADLTAYKLKHNQANGEHNRDGHGDNFSWNSGVEGETEDEAILSARRRDLRALLTTLFVSRGTPMIVAGDEFGRTQRGNNNAYCQDNEITWLDWSKADKNLIALTGQLAQLRREHPALCVDSFLTGENAGGQMEDVIWLREDGQRMYDQDWSDPSRRFLGMSVYEPKAADGHESERAIVYLNASTDDVETTLPSPRPGHLLRLALQSDWPDLEPRILKAGEGLVVKARSVFVLVEEVAAP

SEQ ID NO: 8344 - protein, 702 aa, Leuconostoc mesenteroides subsp. mesenteroides ATCC 8293
MSEPNNILFNTGNHTDSAVIYDKFSKAEQQFSVKKDKTFYITTPIYYPSGKLQLGNTYTTVLADAAARYHRLLGEDVYFLTGTDEHGLKIQQKAEAAGISEIDFLDGMAKQIKDLWKLMDISYDDFIRTTEDRHEKAVAKIFTQLLENGDIYKGEYEGWYSVSDEEYFTESQLAEVYRDDAGKVIGGKAPSGHEVELVKEEAYFFKMSKYADWLLDYYKTHPEFIQPEARMNEMINNFIAPGLEDLAVTRTSFDWGISVPGDEKHVIYVWIDALANYITALGYNSDDTTLFDKFWPANVQLVGKEIVRFHTIYWPIMLHALGLELPKSVVGHGWLVMKDGKMSKSKGNVIYPEVLEERYGLDAVRYYLLRSMPFGNDGVFTPEDFVARVNYDLANDLGNLLNRTVAMINKYVDGVIPELLTGKTSFDEDLVRTVEDAIVEYNKNFKELRTADALESVWKIIRRANKYIDETQPWVLAKDENEKEVLSSVMAHLAGALRVTAVLLQPVLTQAPKKIFDQLGLDYSDKGVAIAGLTFSKLPTGGHVVKKGEPIFPRQDVEEEVAFISGLVSKDTKGKGRAVKEAAKEAAQVAPSKDLITYDDFDKVEILAAKITAGEIVAKSEKLLKFTLDDGSGKPRQILSGIRKWYSDPAALVGKTVAIVANMKPRKMAGELSEGMILSAEKNDIVTVTILPDSIEPGSGIE

SEQ ID NO: 8345 - protein, 541 aa, Desulfotalea psychrophila LSv54
MTVTQLSPLENYKVISGPIVMVVMDGLGLGEDGEQNGVYAAHTPTLDGLFQEKLFTSLKAHGTAVGLPSDADMGNSEVGHNALGAGRIFVQGAKLIDEALSRGDVFSGAAWQKIVECGESAGTVHFIGLVSDGNVHSNISQLFQLLDACAEAGIERVRVHALLDGRDVAQKSALDYIRPLEERLRALSVSGRDYRIASGGGRMVTTMDRYKADWSVVERGWRAHVLGEGRFFSSASEAVETFYREDSTMTDQYMAAFVVVEGETPVGTIEDGDAVVCFNFRGDRAIEISRAFDEEVFQEFDRVRRPDVFYAGIMEYDGDAHIPRNYLVEPPLIDATLGDYLCASGVTSYAISETQKFGHMTYFWNGNKSGYIDEGLELYEEVLSDRVTFDQRPWMKAAEITDKVIEQIEAGERKFIRLNYPNADMVGHTGVPLAVEIAVEAVDLCLARLLPAVEKAGGIVVISADHGNADCMWTEKGGKRLPMVAHTLNPVPCIIKDFSGQNDFVLTDLAERGLANVAATLCLLLGFNPPTDYEPSLLKLK

SEQ ID NO: 8346 - protein, 468 aa, Salmonella typhimurium
SAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 8347 - protein, 455 aa, Zea mays
MASLQSFLAVKPAAGWAAPSRRARVAAFLAPPPPTTAAAVGAARRELSAASLAVVDGEARYLVGTYKRSRVVFEHGRGCKLYDTDGREYLDMAAGIAVTALGHADPDVCATIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLAKPLANGIPIGVVLVKEKVAAAINYGDHGTTFGGGPLACQTAITVFDKITRPGFLAEVSRKGESFKQLLRAKLSGNPHVREVRGVGLLVGVELDVPAGPLVDACLDAGVVVLTAGKGNVVRLVPPLIVSEKELEHAADVIRDCLPALDVVAAA

SEQ ID NO: 8348 - protein, 171 aa, Triticum aestivum
  misc_feature (70)..(70): Xaa can be any naturally occurring amino acid
  misc_feature (83)..(83): Xaa can be any naturally occurring amino acid
  misc_feature (103)..(103): Xaa can be any naturally occurring amino acid
  misc_feature (129)..(129): Xaa can be any naturally occurring amino acid
  misc_feature (139)..(139): Xaa can be any naturally occurring amino acid
  misc_feature (152)..(152): Xaa can be any naturally occurring amino acid
  misc_feature (154)..(154): Xaa can be any naturally occurring amino acid
  misc_feature (168)..(168): Xaa can be any naturally occurring amino acid
MHHLYNTLFSVVPFLFFLFFLSDPTMFIFASAQSLNTLEISRSEISDCVVEDVAQILSKVTFLDVSSCTXIGASALDAFGNKXEIPRQTWRVMHPIDVLAKVXQNDEAHSIGSNMPKLRHLEIGYLLIXTKVVISIASXCLDLKLLFPHCCXDXEDKLLQEKYPWLKXPAP

SEQ ID NO: 8349 - protein, 523 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 8350 - protein, 542 aa, Fulvimarina pelagi HTCC2506
MIERIATKPYDDQKPGTSGLRKKVPHFKQENYVQNFLQAIFDTVGKGERETLVIGGDGRFFNRDVVAIAIRMAAANGYGRVIVGQGGILSTPAASNLIRKRGAAGGIVLSASHNPGGPKGDFGIKYNIENGGPAPERITSAIYKKTKAIGEYRIYSAPAPEFLTVGERSLGDMTVEVIDPVADYADLMEELFDFGKIRDLIASGFKVRFDAMHAVTGPYATEILENRLGAAEGSVVNGEPKEDFGGGHPDPNAVYAADLIEELMRDDGPDFGAASDGDGDRNLIVGRGIVVTPSDSLAVLAANAHLAPAYKKGIAGVARSMPTSQAVDRVAKKLGIGAYETPTGWKYFGNLLDAGKVTICGEESAGTGSDHVREKDGVWAVLLWLNILAERHESVKAIIESHWSEFGRTFYQRHDFEEIDTDKAEGLMESLRDRLASMAGQRFGSLVVSEADDFSYKDPVDGSVATGQGVRIVFSGGARIVYRLSGTGTAGATLRVYIERYESDPAKHTQDPGEALAELISIADSVGEIKKRTGRSEPDVIT

SEQ ID NO: 8351 - protein, 556 aa, Neisseria meningitidis Z2491
MEKIWLDSYEKGVSAEIDITQYNSVSDVFRQSVEKFADQPAFQNMGKTLTYAETGKLATDFASYLQNVLKLPRGERVAIMLPNVLQYPVALFGILQAGLVAVNTNPLYTPRELEHQLKDSGATAIIVLENFANTLELVLPRTQIKHVIVASVGEMFGLLKGSLINFVIRKIKKMVPEYRIRETVSFQTALKEGAKHVFQPVALNREDTALLQYTGGTTGVAKGAVLSHGNICANMLQAKEWIKNQLREGKETVIAALPLYHIFALTVNLMIFANAGSKIILITNPRDMKGFIGELKKQRVNVFIGVNTLFNAMVNRPDFAEVDFSELRLTLGGGMATQKAVAEKWKKITGTPIVEAYGLTEASPGVCCNPLNIESYSGSIGLPVSSTEVELRDANGKEVPVGQPGELWVRGPQVMKGYWNRPEETAKAIDARGFLETGDIAVMDEKGWLKLVDRKKDLVVVSGFNVYPNEIEEVIAHHGKVMEVACIGVPDEKTGEALKVFVVKKDPSLTKEELIAFCRTELTAYKVPKNIEFRDELPKSNVGKILRRELRQSTGK

SEQ ID NO: 8352 - protein, 411 aa, Fulvimarina pelagi HTCC2506
MAYVLAGGRGSRLKELTDTRAKPAVYFGGKTRIIDFALSNAINSGIRRIGVATQYKAHSLIRHLQNGWNFFRPGRNESFDILPASQRVSEDQWYAGTADAVYQNIEIIEDHAPKHMVILAGDHIYKMDYEIMLQSHVDSGADVTVGCLEVPRMEATGFGVMHVDESFKITDFVEKPKDPPAMPGRPDTALASMGIYVFETKFLIDALREDAKDPSSSRDFGKDIVPKIVKNGGAYAHRFNRSVIRSDNEPTHEAYWRDVGTIDAYWQANIDLTDVVPPLDIYDRNWPIWTYAEIVPPAKFVHDVDGRRGVATSSLVSGDCIISGGSLNRSLLFTGVRQRSYSQLDHAVVLPKCRIGRHARIKNAILDRGVEIPDGLVIGEDPLLDAKRFRRTDQGICLVTRPMIDKLRLEQ

SEQ ID NO: 8353 - protein, 357 aa, Cochliobolus carbonum
MAIPLPAFYKWDVYDSKLNNVHGHVECRYTAQTGYWSDPCFVQSPFLSVHGLAPGLNYGQQVYEGIQARRTARNEILIFRPGASADRMAKSATAVSMPPVPYELFVRSVHMAVALNADYVPPHDFHGSMYIRPCQFGSSCQIGLQPPDEFIFCVFVQPHIALHGHGSLRALIAEDFDRAATRGTGHVKIGGNYAPVIRWTQSAKKEENGGWDVLLHVDSKTQTRIDEFSTSAFIGTKYAEEQNEPPQIILPESAAAIQSITSDSVAWLAKSFGWNIVKQPVTIDELASLSEVMAVGTAAGLVPVSCIRHNSTNRTFEFPSAGPMYRQLKETLDNIQRGRSSDSFGWCEKLRYAEFVQ

SEQ ID NO: 8354 - protein, 540 aa, Fulvimarina pelagi HTCC2506
MYPDAIATAAARAEKIGIQSLFKADPKRFEAMSFRQDDLLLDLSKTAIDPEALSALIDFARERKVEAKRDAMFAGAKINETEGRSVLHVALRAKPGDGFKADGEPVGDAVQAVRWEMTLFADAIRSGAAHGATGKAFTDVVNIGIGGSDLGPAMATLALAPYHNGPNVHYVSNVDGAHIADTITGLDPETTLFIVASKTFTTVETMTNARTARDWIVAKLGEDAVETHFSAVSTALDQVEAFGISEDRTFGFWDWVGGRYSIWSAIGLPLMIAIGPEKFREFLAGGHEMDEHFRSAPLGENLPILLGLVGWWHRVAMDCPTRAIIPYDQRLSRFPAYLQQLDMESNGKRVGLDGEPVAVSGPVAWGEPGTNGQHAFFQLIHQGTDVVPVEFLAAANAHESEKMTVHQDLLLANCIAQSEALMIGRTLEEARRQLLDGGATPDEAQRIAPHRVFPGERPSVTMLYAQLDPRTLGRLIALYEHRVFVEAQLFGINAFDQWGVELGKELAKNLVPVVTGEQDAGSRDGSTRGLVAAIQTMRRT

SEQ ID NO: 8355 - protein, 203 aa, Oryza sativa (japonica cultivar-group)
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVSSETAKAFADEMGIPFMETSAKNATNVEQAFMAMAASIKDRMASQPAASNARPPTVQIRGQPVNQKTSCCSS

SEQ ID NO: 8356 - protein, 411 aa, Arabidopsis thaliana
MSATALSRLNPVSQFGFQRIVAGKSKSFFSNSGQRRLFSDSSRFRQAMAASGSLPVFGDACLDDLVTTCSNGLDFTKKRSSGGSFTINCPVASMRLGKRGGMMKNRLVCHYSVVDPLEKSRALFGTLSKSVHTSPMACFSVGPAHELSSLNGGSQESPPTTTTSLKLVSGSCYLPHPEKEATGGEDAHFICDEEQAIGVADGVGGWAEVGVNAGLFSRELMSYSVSAIQEQHKGSSIDPLVVLEKAHSQTKAKGSSTACIIVLKDKGLHAINLGDSGFTVVREGTTVFQSPVQQHGFNFTYQLESGNSADVPSSGQVFTIDVQSGDVIVAGTDGVYDNLYNEEITGVVVSSVRAGLDPKGTAQKIAELARQRAVDKKRQSPFATAAQEAGYRYYGGKLDDITAVVSYVTSS

SEQ ID NO: 8357 - protein, 393 aa, Zea mays
MSLSLKRKDLMIVNMGPQHPSMHGVLRLIVTLDGEDVIDCEPILGYLHRGMEKIAENRSIIQYLPYVTRWDYLATMFTEAITVNAPEFLENIQIPKRASYIRVIMLELSRIASHLLWLGPFMADLGAQTPFFYIFRERELIYDLFEAVTGMRMMHNYFRIGGVAADLPYGWMDKCLDFCDYFLQGVVEYQELITQNPIFLERVEGVGFISGEEAVNWGLSGPMLRASGIQWDLRKIDPYESYNQFDWKVQWQKEGDSLARYLVRVGEMRESIKIIQQAVEKIPGGPYENLEARRFKKAKNPEWNDFEYRFLGKKPSPNFELSKQELYVRVEAPKGELGIYLVGDDSLFPWRWKIRPPGFINLQILPQLVKKMKLADIMTILGSIDIIMGEVDR

SEQ ID NO: 8358 - protein, 459 aa, Zea mays
  misc_feature (311)..(311): Xaa can be any naturally occurring amino acid
MDRFKLIKEVGDGTFGSVWRAMNKQNGEVVAVKKMKKKYYSFEECMSLREVKSLRRMNHPNIVKLKEVIRENDILYFIMEYMECNLYQLMKERVKPFSESEVRNWCFQIFQALAYMHQRGYFHRDLKPENLLVSKGVIKLADFGLAREVSSLPPYTEYVSTRWYRAPEVLLQSSAYDSAVDMWAMGAIMAELLTLHPLFPGTSEPDEIHKICNVIGSPDEQSWPQGLSLAEAMKYQFPQTKGSQLSEVMTTASSEAIDLISSLCSWDPSKRPKATEVLQHTFFQGCTCVPLPVRRKASSLPKTPPCVGSKXISENSVARRFSTGTLSTMKSHSNAPAKSNGLSRTGVQRKLHLDRQPPQKSTKPTETSNKLATNRVPARNSPGNPVLRHSRSLPETGRRAVQKVSSITEKLSQMSVTSRTRSAVKPAAPTMKAGHGKSDFLGKSDDIPPAKRLTRKLVS

SEQ ID NO: 8359 - protein, 651 aa, Arabidopsis thaliana
MANSILLFSFVLVLPFVCSVQFNISRFGSDVSEIAYQGDARANGAVELTNIDYTCRAGWATYGKQVPLWNPGTSKPSDFSTRFSFRIDTRNVGYGNYGHGFAFFLAPARIQLPPNSAGGFLGLFNGTNNQSSAFPLVYVEFDTFTNPEWDPLDVKSHVGINNNSLVSSNYTSWNATSHNQDIGRVLIFYDSARRNLSVSWTYDLTSDPLENSSLSYIIDLSKVLPSEVTIGFSATSGGVTEGNRLLSWEFSSSLELIDIKKSQNDKKGMIIGISVSGFVLLTFFITSLIVFLKRKQQKKKAEETENLTSINEDLERGAGPRKFTYKDLASAANNFADDRKLGEGGFGAVYRGYLNSLDMMVAIKKFAGGSKQGKREFVTEVKIISSLRHRNLVQLIGWCHEKDEFLMIYEFMPNGSLDAHLFGKKPHLAWHVRCKITLGLASALLYLHEEWEQCVVHRDIKASNVMLDSNFNAKLGDFGLARLMDHELGPQTTGLAGTFGYMAPEYISTGRASKESDVYSFGVVTLEIVTGRKSVDRRQGRVEPVTNLVEKMWDLYGKGEVITAIDEKLRIGGFDEKQAECLMIVGLWCAHPDVNTRPSIKQAIQVLNLEAPVPHLPTKMPVATYHVSSSNTTSVSSGGATVTFSSAQHGR

SEQ ID NO: 8360 - protein, 630 aa, Magnetococcus sp. MC-1
MCGLSAILDLTGQRLPEAEQLTAMTRALAHRGPDGEGMHREPGVGLGHRRLSIIDLAGGAQPLWNEDRSVAVVFNGEIYNFPDLMQRLQGLGHQFHSRSDTEVIVHAWEQWGEQCVEALQGMFAFALWDRCQGVLFVARDRLGIKPLYYGFSEDGWLLVGSELKALTAHPGLSRSLDPKGVMDYFAYGYIPDPHSIYRQVKKLEPGYCARFTLGSGDWRLRCYWDLSFAAQPLTEAAALQQLQELLGQTVQSHTLADVPLGAFLSGGVDSSLITALLAKQSQTPLQALTVAFTGSREDEAPHARAVAQHLGVQQQLLTVDPLDFERLERLPGLYDEPFADSSAWPTFLLCEAAASRMKVVLSGDGGDELCAGYSRYRLFMAEQQVRQRVPSWLRRGLFGPMGMLYPKLDNAPRWLRAKSTLQALGEGPLEGLFRGASMMDPAMGQGLLAPDLMLLDYHPIEHFYRLNARLPEQVAFHDRMLYLDFKTFLAGRVLTKVDRASMAVGLEVRVPLLDHRLVEWAGRLPWCLKMQGGQGKYLLKKLAAQQVPATAVYRSKQGFIPPLAAWLRGPLQERLQDRLSSRVITESGLFHPRWIHWMLEQHRKKKQDLSMPLWSLLMFEGMLRKAQNKG

SEQ ID NO: 8361 - protein, 239 aa, Oryza sativa
  misc_feature (109)..(109): Xaa can be any naturally occurring amino acid
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRXGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 8362 - protein, 115 aa, Tropheryma whipplei str. Twist
MHALDALDALSIKADIPDFSPGDTVRVYVNITEGDRSRVQVFQGVVIARRGFGVRQTFTVRKISFQVGVERIFPLHSPSINRIEVVTKGSVRRAKLYYIRKLRGKKAKVKQKREL

SEQ ID NO: 8363 - protein, 252 aa, Triticum aestivum
APGTLHGTEGVGKKHHRSRCSTLFTSFRIRWTSPTLPPSPGQHEQGHRTVSWDPPKRPAGRTKFHETRHPLYRGVRRRGRVGQWVCEVRVRGTNETRLWLGTFHTAEMAARAHDSASLALSGSAACLNFADSAWRMLPVLAAGSFGFGSAREIKLAVAVAVVAFQQQQIILPVACPTVEAAASPSNSLFYMSSVDLLELDEEQWFGGMDAGSYYESLAQGMLVAPPDDRARREDAEQTGVETPTPLWSYLFD

SEQ ID NO: 8364 - protein, 174 aa, Physcomitrella patens
GMSHEVRERTDALDAAGNTTAAIGKGFAIGSAALVSLALFGAYVSRAGIASVDVIQPKEFVGLIVGAMLPYWFSAMTMKSVGKAALAMVEEVRRQFRTIPGLMEGTTKPDYKRCVKISTDASLKEMIPPGALVMLTPLIVGTLFGVETLAGLLAGALVSGVQIAISASNTGGAW

SEQ ID NO: 8365 - protein, 546 aa, Desulfotalea psychrophila LSv54
MNLLNNAVINTPKPINEPIYDYAPGSPERRALKAALEEMSQLVLDIPLIINGEEIRTGNIGQVVMPHDHRHVMAHYHRAGEKAVRLAIDAALAAQSRWQSMRWEERCAIFLKAAELIAGKYRYKINAGAMLAGGKTAYQAEIDAACELIDFLRFNVSYAEQIYKNQPVSSPGVWNFVQYRPLEGFVFAVTPFNFTAIAGNLPTAPALMGNTVVWKPASSLVYTPYLLMEIFAEAGLPPGVINFVPGAGASVGDICLADPNLAGIHFTGSTAVFQFMWKTVGNNIASYKSYPRIVGETGGKDFIFAHSSADPQQIVTAIVRGAFEYQGQKCSAASRAYIPRTLWLVIEEGLKREIAKIKVGATTDFSNFISAVIDKGAFSSITSYIDFAKENEGGDVIIGGGYDDSLGYFIEPTVILATDPCFETMVEEIFGPVISIYVYEDEDYMETLALCDSTSVYALTGAIFSRDREATSTALTKLEHAAGNFYINDKPTGPVVGQQPFGGGRASGTNDKAGAASNLMRWVSPRTVKETFVAATEFSYPFMDEN

SEQ ID NO: 8366 - protein, 353 aa, Triticum aestivum
  misc_feature (148)..(148): Xaa can be any naturally occurring amino acid
MASDHERLRALTAFDDTKAGVKGLVDAGVTAVPSIFHHPPECLPAADAELHHFTIPVIDLASDSRVALVAQVKAAAQAVGFFQVVNHDVPDDLLAEMLVSVRRFHESPVETKRAYYSRDHRRTVQSNSNFYLFQSPAASWRDTMFLQXASLAPSEEIPEACRAVAPEYARQVQRLGRALFELLSEALGLDLSYLEEETMCLDRVNISGHYYPACPEPHLTLGTSRHSDASLLTVLLQDTVGGLQVLLDDGKWADVPAVPGALVVNVGDYLQLMSNNRFKSVEHRVVANSVESRVSVACFIVPNQSSARVLAPIVTGDGSVARYRSTTVEDMFRYYRNRTKALNGTSALQHFTI

SEQ ID NO: 8367 - protein, 422 aa, Oryza sativa (indica cultivar-group)
MSEFSICSSTISFHFGAGMRPWCHYLGDREVDTIDEDLSFGYACGNLGGILGNAHLLELYAGSVQFMDINQPAIEIPWPFVFKPVILPDLGRSTCWPERLYKEFICCCKARKLKDLMLKSDNRICADCGAPDPKWASANIGVFLCLKCGDVHRALGPDVSKVLSVTLDDWSDSDIDSMLEIGGNSYANSIYESFLPKDHPKPKMDSTMEYRTKFIRAKYETQDFLKPSLRITSKGSFDATNAVKSVTSSISSASGKHVADDTREFVGELNITVVRGIQLAVRDMLTSDPYVVLTLGEQKAQTTVKPSDLNPVWNEVLKISIPRNYGPLKLEVYDHDTFSADDIMGEAEIDLQPMITAVMAFGDPSRVGDMQIGRWFMTKDNALVKDSTVNVVSGKVKQEVHLKLQNVESGEMELELEWVPIP

SEQ ID NO: 8368 - protein, 405 aa, Zea mays
MQRNGVVECSVCRSRVVVPSPRSVSRAYDKHRSKMSSKFRALNVFLVVGDCILVGLQPILVFMSKVDGKFQFSPISVNFLTEVMKVIFAIVMLIIQSRKQKVGEKPLLARSTFIQAARNNVLLAVPALLYAINNYLKFIMQLYFNPATVKMLSNLKVLVIAVLLKFIMRRRFSVIQWEALALLLIGISINQLRTVPAGNTAFGLPVTAIAYIYTLIFVTVPSMASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKVKDDKPADLIELEDTQNHRSSESSFVNMTAGAAVDASHRIGTDERQPLLPT

SEQ ID NO: 8369 - protein, 960 aa, Agrobacterium tumefaciens str. C58
MALVTEFDYGTPKSNATDMVTLTIDGRQVTVPTGTSIMRASREAGIDVPKLCATDMVDAFGSCRLCLIEVEGRNGTPASCTTPVAAGLVVHTQTERLKQIRKGVMELYISDHPLDCLTCAANGDCELQDMAGAVGLRDVRYGYEGDNHVKSRTGGGDINARWMPKDESNPYFTYDPSKCIVCSRCVRACEEVQGTFALTIEGRGFESRVSPGAHEAFLDSDCVSCGACVQACPTATLTEKSVIEIGQPEHSMVTTCAYCGVGCSFKAEMRGEELVRMVPWKDGQANRGHSCVKGRFAYGYATHRDRILNPMIRENIGDPWREVSWDAAFAYVASEFRRIQGKYGRESIGGITSSRCTNEETFLVQKLVRAGFGNNNVDTCARVCHSPTGYGLGQAFGTSAGTQNFDSVEQSDVVLVIGANPTDGHPVFGSRLKKRLRQGAKLIVIDPRRIDLVRTPHVEAAFHLPLLPGTNVAVLTALAHVIVTEGLFNEAFIRERCDWSEFEDWAAFVAEPQHSPEETERFTGVPAEDLRGAARLYATGGNGAIYYGLGVTEHSQGSTTVMAIANLAMVTGNIGRPGVGVNPLRGQNNVQGSCDMGSFPHELPGYRHISDDATRDVFEKLWGVKLNNEPGLRIPNMLDAAVDGSFKGIYIQGEDILQSDPDTKHVSAGLAAMECVVVHDLFLNETANYAHVFLPGSTFLEKDGTFTNAERRINRVRKVMSPKNGYADWEVTQKLAQAMGLTWNYTHPSEIMDEIAATTPSFASVSYAYLEEKGSVQWPCNEKFPEGSPIMHVDGFVRGKGKFIRTEYVATDERTGPRFPLLLTTGRILSQYNVGAQTRRTENVVWHEEDRLEIHPHDAEQRGVKDGDWIKLVSRSGDTTLRALITDRVAPGVVYTTFHHPGTQANVITTDFSDWATNCPEYKVTAVQVSPSNGPTEWQEEYDALARQSRRIAGKLEAAE

SEQ ID NO: 8370 - protein, 121 aa, Borrelia garinii PBi
MDLIRKIEAQNKKSEAFVFNVGDTVRVIYKIIEGSNERLQSFEGIIISFQNKGIGKTFLVRKISSGIGVEKIFPVYSPIIEKVEVLRRGKVRRAKLYYMRNRIGKAAMKIKERLNIKKVKH

SEQ ID NO: 8371 - protein, 327 aa, Synechococcus sp. CC9605
MAGTLLFNALREAIDEEMGRDPHVCVMGEDVGHYGGSYKVTKDLAEKYGDLRVLDTPIAENGFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPEGDYTCALDQADLVKEGTDVTILTYSRMRHHCLKAVEQLEAEGVSVELIDLISLKPFDMETISRSIRKTNKVIVVEECMKTGGIGAELIALITEQCFDDLDARPVRLSSQDIPTPYNGSLENLTIIQPHQIVEAAQALVNKGI

SEQ ID NO: 8372 - protein, 567 aa, Oryza sativa (japonica cultivar-group)
MASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 8373 - protein, 230 aa, Glycine max
  misc_feature (74)..(75): Xaa can be any naturally occurring amino acid
  misc_feature (106)..(106): Xaa can be any naturally occurring amino acid
YPWEFVSKQNVIKLLILMRFRCDMEEKKDEEDSTFNEGEAEVTVTHAKRLVQSGVLPSDIGIITPYAARVVLLXXLKNKEDRLKDVEISTVDGFQGREKEAIIISXMVRSNSFFVVGFLSDRRRMNGAVTRSTSQCCLVCDTETASGDGFLKRLIESFEEHGESLSASECQSEWARFTRLRFLLLHPGINLVVLLGLLFLKSFLFSDWKKLFIPFFQKNFRSLLMVLHRR

SEQ ID NO: 8374 - protein, 410 aa, Rickettsia peacockii
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCNSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNPLLQIAIELEAIALKDEYFIERKLYPNVDFYSGIIYKAMGIPSQMFTVLFAIARTVGWMAQWKEMHEDPEQKISRP

SEQ ID NO: 8375 - protein, 433 aa, Aspergillus oryzae
MESKREFDLILLGPTGYTGRLCAEHIVKNFPTGLKWALAGRSLQKVGDVAKELKNLNPDRVEPANIVDLLLEILAVQLNREELHSLAQKCRVLLNCVGPYHLYSTPVVEACASNGTHYLDVQALDAMANLCSTGETPWIKSIIEKYHETAKSNGAIIIPSVGVESAPADMLSWALVKRIREELSCDTKEVTCAIDELKSSGASGGTLATIMTMFDTLSLFDILKAADPFALAASSPPKSIPSEPLAEKVLGVRSVRDMGTLTTAPTAIADITIVHRSSTLMPEFYGRRFHFRQFLRVRNVLIGVALHFAFVTGLLLLLLPPVRWLLKKYIYAPGSGPRMEDSVNDRLVYRAVATADQDTPHPKRALGKLKYDGTMYVFTGLLLAEAAMTILENEEKVKKVSRCGLVTPATLGQEFIDRLEKVGCQIETEVFNY

SEQ ID NO: 8376 - protein, 434 aa, Glycine max
MHTASRSNGGGGGVLASRTSSRSVTETVNGSHKFVIKGYSLAKGIGVGKHIASETFTVGGYQWAIYFYPDGKNPEDNSAYVSVFIALASEGTDVRALFELTLLDQSGNGKHKVHSHFDRSLESGPYTLKYRGSMWGYKRFFKRAQLEASTFLKDDCLKINCTVGVVVSSIDCSKLNTIQVPESDIGAHFGMLLENEEGSDVTFSVGGERFHAHKLVLAARSTAFETEFFNGMEEDDHDVVVTDMEPKVFKALLHFIYRDTLIDDEELFMSRSSFLPSVSESFAAKLLAAAEKYGLPRLKLMCESVLCKDISIDSVAYILALADRYRATELKSVCLQFSAENLVAVMQSDGFEYLKENCPLLQSELLKTVAGCEEEFSGEGKCRSVWAQFSDGGDTNDRSVRQQTWENGVERSQSLWVHLSDGVNNNDRSPGQET

SEQ ID NO: 8377 - protein, 379 aa, Oryza sativa (indica cultivar-group)
MQRVPFAAGGAEPAERVQGPILVFMSKVDGKFQFSPISVNFLTEVTKVVFAIVMLIIQSRKQKVGEKPLLARSTFIQAARNNALLAVPALLYAINNYLKFIMQLYFNPSTVKMLSNLKVLVIAVLLKFIMKRRFSVIQNCHVLSFNVDDHNLQSGLLVTHYVTEWEALALLLIGISINQLRTVPAGNTAFGLPVTAIAYIYTLIFVTVPSLASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKAKDDKPAELLELEDTQNHRSSESSFVNMTAGAAEDVV

SEQ ID NO: 8378 - protein, 373 aa, Debaryomyces hansenii CBS767
MSFQQIPVIDLQLAFNSDTKPEFLQILRHALIEVGFLHLINYETEGPSRKELEEIREQAERFFELPDEVKLGCEMINSPHFLGYTRLANEVTALHTDWREQIDLGTELPSPGPEEPIYRNIEGPNLWPDAKYAPDFKPVVLNYIAKMTRLGTVFRKLVCEAIGLEAASLDGFFKPGQQCKMKIIAYPDSDQLSNESSNALDDMPSTGQGCGPHRDSDLLTYIYQPTSHSESLQVQNFQGKWVTVDNIPNALVVNAGQTLEAITQGVCKATIHRVLIPKAGTGTRISIPFFQTIDLDSHKTVAKGIPKEVLHLKDERDEKILNWAVDVGFQFSPEVGKYPVGHAVFKNRIKSHQDVSAKWYPNVLKDVLAEYNT

SEQ ID NO: 8379 - protein, 434 aa, Desulfotalea psychrophila LSv54
MTRNLEKKMSIREDAQQGKVTPLFEQCAAVESMSVERLMAGVSDGTIAITKNKNHAFSKVIAIGAGTSTKVNANLGSSKDINSLEEELKKLAVAIKAGADTIMDLSMGGDLQKIRQEILKNCSVPLGTVPIYQVAAEVVAAGKEIVDMTVERMFEVIEQQAKDGVDFMTIHCGINRHLQERLKNQPRTMGVVSRGGSFTLDWMNHHKRENPMYEYFDDLLAILKEHEVTLSLGDGIRPGCLADATDRNQIQELITLGELTERAWAAGVQVIVEGPGHMPLNQIKANVLLQKQMCKGAPFYVLGPLVTDIAPGYDHITGAIGGAIAASAGADYLCYVTPAEHLKLPNCSDVHEGVIASKIAAHAADIVKGLPGAIEKDNAMAKCRKELDWKGQIELSIDPAKSAQYRHEGGGDATDACSMCGEFCALKVFERSQK

SEQ ID NO: 8380 - protein, 885 aa, Glycine max
SMGASRKLQGEIDRVLKKVQEGVEVFDSIWNKVYDTDNANQKEKFEADLKKEIKKLQRYRDQIKTWIQSSEIKDKKVSASYEQALVDARKIIEREMERFKICEKETKTKAFSKEGLGQQPKTDPKEKAKSETRDWLNNVVGELESQIDNFEAELEGLSVKKGKSRPPRLTHLETSITRHKAHIKKCEFILRLLDNDELSPEEVNDVKDFLDDYVERNQDDFDEFDDVDELYSSLPLDKVETLEDLVTIPPGLSKVAPSLSLKNTLTVSASQSASASQTSDTSVQEQADDTTSQDSNSDIVAKTPPCKSGGISSATSTPVDHATPVSVNVSGHNLSSAPVAVLPGSNSVRNVLENTNVINSSSVNQSTSTNEEEINSFPSRRPSPSLSDATLLKGRSSLSNQATASIPLGSGNMVSSNGALGSVSSASEIAKRNILGADDRLGSSGMVQPLVSPLSNRLILPQAAKANDGTVLVDSSTVNEAASGRVFSPSGVPGMQWRPGSPFQNQNDAGQLRGRTEIAPDQREKFLQKYQQVQQGNSTLLNMNSTLLNMPSLVGGNHKQFSAQQQNPLLQQSGIGLGVQSTSLVGISSASLQQPPNPVHSPSSQQPLMPGVSIDADVGNSKIEEQQQHQNFPDDSTTESTASTGIGKNLINEDDSKSAFALDSPAGVSASLPESAQTSRDIDLSPGQPLQPNQPTGNLGVIGRRNGAEHGAIGDNFSGSSVSSGGVRDQLYNLQMLEAAHFKIPLPKDSERPRTYTPKHPTITPPSYPQVQAPIVNNPAFWERVGLEPFGTDTLFFAFYYQQNTYQQYLAAKELKKQSWRYHRKYNTWFQRHEEPKIATDEYEQGTYVYFDFHIANDDMQHGWCQRIKTEFTFEYNYLEDDLLV

SEQ ID NO: 8381 - protein, 178 aa, Solanum tuberosum
MGDVEYRCFVGGLAWATTDNTLSEAFSQYGEVVESKIINDRETGRSRGFGFVTFKDEQAMRDAIEGMNGQDLDGRNITVNEAQSRGGGGGGGGRGGGGYGGGRREGGGGGYGGGGGYGGGRREGGGGGGYSGGGGGYGGGRREGGYGGGGGGYGGGDRYSDRSSRGGGGGSSDGNWRN

SEQ ID NO: 8382 - protein, 443 aa, Solanum tuberosum
  misc_feature (353)..(353): Xaa can be any naturally occurring amino acid
MATIKSIKARQIFDSRGNPTVEVDVHVSNGVFARAAVPSGASTGIYEALELRDGGSDYLGKGVSKAVNNVNSIIGPALIGKDPTDQTGLDNFMVHELDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKSVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTTEIGEQVQIVGDDLLVTNPKRVAKAIAEKTCNALLLKXYQIGSVTESIEAVKMSKKAGWGVMTSHRSGETKDTFHCLIFAVGLSTGQIKDWELPCRVRASRKVQPALEDRRGTRIRGCLCRSKLPQAC

SEQ ID NO: 8383 - protein, 207 aa, Oryza sativa
MKKLYQGKGRRVHPAPAQQAQADAAAAAAVVLPAAVLALASALTAEEQEVLAYLLSGGGAAGGRRRRRGAHPPEMGCGCFGCYKSFWARWDASPNRHVIHRIIDAAEEASGGGGDCEEDASATKEADASVEHHHHACGFDGEEDGDYEGDGDDEEEEEEGDSMDGDADDETTLSEGDCSSSSSSNAEKSTVGRLVRFIGEKVWGAWN

SEQ ID NO: 8384 - protein, 356 aa, Aspergillus oryzae
MSTENKMRAVVFHSPYKVAVEERPIPKIQDSGDIVVKVTYTALCGSDLHTFRGIEPAGTGFVMGHEVTGEVVEVGSGVKSIQKGDMVVSAFTTSCGECFYCKQGFSSRCEKSVLFGCDHLDGAQAEYVRIPNADGTVMKAPEGVEEKYLVLMADIFPTGYFAASNAFKGYTPEQISEQTVVLIGCGPVGLCALINALEFKPKHLLAVDSIPSRLELARSLGAEPWNFQQDREGLDKRVKELTNGRGADAVIEVVGLSPALRTGFDLLRPWGTISSVGVHNGEIPWAGNDAYDKNLRIQMGRCPVRSVSPQALDVLKKNQHKLGFMADKIMPLSQAVEGYELFNAMKVQKVIFKAGE

SEQ ID NO: 8385 - protein, 517 aa, Triticum aestivum
HYRTSLYKKAGWYRSGIPGISSTHASAEFPVKSTLDPSVYGDQSSTITEDQIQQNLEEGLTVKQAMEKNRLFILDHHDNFMPFLDRINKLEGNYIYASRTLLFLKADGTLKPLAIELSLPHPDGIQHGAKSTVYLPADIDSGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYPNDGVLRADKELEEWWKEVREVGHGDLKDADWWPKMVTVQELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDAGGEKGLGLTAMGIPNSVSI

SEQ ID NO: 8386 - protein, 440 aa, Desulfotalea psychrophila LSv54
MARILKNKQEDIFMKLESLALHHGYEADKATRAATVPIYQTSSYTFENSQHGADLFDLKTPGNIYTRIMNPTTDVLEKRIAAMEGGLAALALASGMAAITCAIHNICLLGDNIVSTSQLYGGTYNLFKYLLPARGIEVRMAECDDYQAIAEAIDIKTRAIYCESIANPAGNVADIKKLAEIAHEHGIPLIVDNTVATPYLCRPIELGADVVVHSLTKYIGGHGTSLGGIIVDSGKFGWAKEAGKFPTLTEPDPSYHGLVYTEALGATAYIGRCRVALLRDTGAAISPMNSFQILQGLETLGLRMERHCENAEKLALYLGEHKEVAWVRYAALSASPYYESCQKITGGRASGILSFGLVGGFAAGIAFVDALKMILRLVNIGDAKSLACHPASTTHRQLSDSDMKASGVSSDLIRISVGIENIEDIILDVSQALDVACATT

SEQ ID NO: 8387 - protein, 541 aa, Oryza sativa (japonica cultivar-group)
MGRNGSVKRTSSSGAAAAFTANPRDYQLMEEVGYGAHAVVYRALFVPRNDVVAVKCLDLDQLNNNIDEIQREAQIMSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDAAQLALKKMPSSEQEALSMSEYQRGVSAWNFDVEDLKAQASLIRDDEPPEIKEDDDTARTIEVEKDSFSRNHLGKSSSTIENFFSGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSG

SEQ ID NO: 8388 - protein, 203 aa, Brassica napus
MSTMIPQMMKTGTVYFLSKTGHVVVATNNLQRSPSKQYSSVITVKDDAETVYFLSSHGTIIACDLTNRCFTELPKLLPPFLEYSIDLVECNGTMFVVLLSEFYESASLRIWKLENQSWVHVGMLPPAMSHELYGREGDINCVGGAGNKILVCFNTNLPEVYCRYFVYDLVAEQWSELPKCFKDGEAVEFVSALSFQPRIEATV

SEQ ID NO: 8389 - protein, 560 aa, Arabidopsis lyrata subsp. petraea
MASSTALISDTEAWKDLKGHVEDIKKTHLRDLMTDANRCQSMMMEFDGLLLDYSRQRAPVETMDKLLNLAKAAQLTEKISRMFNGEHINSTENRSVLHVALRAPKDAVIKADGKNVVQEVWNVLDKIKEFSEKIRSGSWVGATGKPLKDVIAIGIGGSFLGPLFVHTALQTDPEALESAKGRQLRFLANIDPVDVARNIIGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTALEGFNYSTTTLLKRYLETSSEPQM

SEQ ID NO: 8390 - protein, 360 aa, Arabidopsis thaliana
MSLTTDEIEVRDFVVNQKNGVKGLVDFLTLTTLPSPYIQPPQERFTSDKILLGSPVPVIDVSNWNEPHVAREICHAASKLGLFQIVNHGIAPAEFKGVIAAARGFFELPAEERRRYWRGSSVSETAWLTTSFNPCIESVLEWRDFLKFEYLPQRHDFAATWPSVCKEQVIDHFKRIKPITERILNILINNLNTIIDESNKETLMGTMRMNFNYYPKCPEPSLAIGTGRHSDINTLTLLLQEDGVLSSLYARATEDGDKWIHVPPIPGAIVVNIGDVLQILSNDRYRSVEHCVVVNKYCSRVSIPVFCGPVHDSVIEPLPEVLDKNNEMARYRKIVYSDYLKFFFGRPHDGKKTIESIKLP

SEQ ID NO: 8391 - protein, 560 aa, Arabidopsis halleri subsp. gemmifera
MASSTALFCDTEAWKDLKGHVEDIKKTHLRDLMSDANRCQSMMMEFDGLLLDYSRQRAPVETMDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNIKGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPFETGEVDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTALEGFNYSTTTLLKRYLETSSEPQM

SEQ ID NO: 8392 - protein, 359 aa, Pirellula sp.
MNSSIVLLPGDGIGPEIVEQARLVLVKVAERFGHTFDFSSHQIGGIAIDETGDPLPQPTIDACRNAAAILLGAVGGPKWDDPSAKTRPEAGLLKIRKELGLFANLRPIKLFDELADASPLRADIVKGTDILFFRELTGGIYFGESGTSGSGEEETAFQSMTYSVGEVKRIVRMAAQAARGRSNRLTSVDKANVLEPSRLWRRVAAEVMANEFPDVQYDVVLVDSMAMHLINRPSEFDVVVTGNMFGDILTDEASMLPGSLGMLPSASLGDGGPGLYEPIHGSAPDIAGKSVANPLATILAAAMMLRHSLGLTDEAEAIEKAVAGVITDGLRTPDLARGDQSKSVSTEEMGAAVVAKLAS

SEQ ID NO: 8393 - protein, 867 aa, Yarrowia lipolytica CLIB122
MESTPRAPMSWNKRDDRDTRDPPDDRDRSHWRPRSEQSNRGAGSSRNDKSIRGGRGGRGGGSRNNSSRGGGFRDDHFGGSRDAPPPPPPREHGDTYRDDGPDLFSDGAWSGGRSTWQDPPLRKDSYSGDKPWDRLSSRYDNRPDDTPPRQQRSTGGRRPGADNKDWPDRSRGDRSWQNSSSNAPWQQNKGRDDRRDGSSYRPDSDRYDRDRDIRDRDNRGRDSGDGRGNRENRDRETTPLYRDRRVSGPPPSLPSTPSRASSTGPVPPSSAPRPGQRRPLPDQVTFASQSDSGPTSSAKRKRKKAGASTTALTDSNIHNPNNPNYIGYTKKEARERERKKQETEELDPSRSGSVGDISLDSSSLGNGGGASSEASVASRDGSRDGRKRLNPTFSDSSESRSRSDFQNKRPKREASTGPQFDDDVPCYGDDEPGEPVVATTPVDTTKPRVTQHTLTSSIFERVTQVGEGTYGKVYKAVNQVSGTTSALKRLRLETEREGFPVTALREIKLLQSLRHDNIISLKEMMVEENGVFMIFGYMSHDLSGILAQPNVRLEEGHIKFLFHQILSGLTYIHQRGILHRDIKGSNILVDGDGNLKLADFGLSRTIDPSNKRARYSNRVITLWYRPPELLFGATLYDGAVDNWGAGCLLVELYSRLAVFRGADEINQLDCIFDIMGTPTNEYWPDLESLPWFEMLKFNYKKPSKFLQMYDQVCSKPALKLASKLLEMNPAYRMTSQEAMNSDYFNVEPKAERPLVLRELVGEWHEFDAKKLRRAKRKEEDLRRGKERRERKEAEARAKAEGRPEEKPEGLATGGGLAVGTSGQEKVTAENTTEANAEPPSAPGSSREPTCTTAPPSVHPSTTDTDTA

SEQ ID NO: 8394 - protein, 473 aa, Synechococcus sp. CC9605
MSKSPQDVLRQIKDEGIELIDLKFTDLHGKWQHLTVCTDLLEEESFTEGLAFDGSSIRGWKGIQASDMAMVPDANTAWVDPFYKHKTLSMICSIQEPRTGQPYERCPRALAQRALNHLASTGLADMAFFGPEPEFFLFDDVRYNSAEGGSFYSVDTIEAGWNTGRIEEGGNLAYKIQVKEGYFPVAPNDTAQDIRSEMLLLMSQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSDDFIDNWIDLKYEEVQQLRQRPHPHEFTMYYDA

SEQ ID NO: 8395 - protein, 981 aa, Thermoplasma volcanium GSS1
MEVGEVIEFYAGSKSLKGEKNQTILQALLLNGIDIPHICYHPSLGPINTCDTCLVDMNGKIVRSCSTYLEQGAKIDYNSNRVLELQREAVQRMLHNHDLYCTVCDNNNGDCPLHNAVHDLEIDNQKYPYEPKPYPVDDSNPFYVYDPNQCILCGRCVEACQDVQVNETLSIDWSRERPRVVWDNDVPINESSCVSCGHCVTVCPVNALMEKTMLGKAGFLTGLEKNTKQKMIDVVKSIEPEITMSPIMAISNIESKMRSSRIKKTKTVCTYCGVGCSFEMWTMGREILKVQPQPESPANGISTCIKGKFGWDFVNSKERLTSPLIRDGERFRRATWEEALDLVAKKLREIKDKYGGDAIEFIASSKGTNEEAYLMQKLARQVFGTNNVDNSSRFCQAPATTGLWRTVGYGGDSGSIQDIYMADLVIAIGTNTAESHPVLATRVKRAHKLNGQKLIVSDLRMHEMARRADLFLHPKPGTDIVWLSAVTKYILDKGWEDKSFIRERVSGFEDYVKSLEPFTMEFAEEATGISKETLMKVANMIHEAKNMVILWAMGVTQHQAGSDTSTAISNLLLITGNYGRHGTGAYPLRGHNNVQGASDFGAMNAYLPGYQPVSDPTVRKKFEDAWHCTIPEKPGLDNNTCLEGIMNGKIRAMYVVGEELVETGSDSNFIRDQLEKLDFLVVEDLFLSETAKYADVVLPASASLEKEGTFVNTERRIQRIYEVMAPLPGTRPDWQIIQDIANRLGARWNYGHPSEIMEEAASLSPIFAGVRYELLEGFKSLQWPVRSDGKDSPLLYEKEFNFPDGKARLYPLKYNPPLSSGLEFDLHLNNGRLLEHFHEGNETYKSPGIRSKVPGTFVEVSPDLAKERGLETGDLVRITSEYGSIKVSVLVSDRVSGKELYMPMNASGDSAVNLLTGRLMDPTAHTPAYKEVSVRLEKITGKRGPPPLPSTNPRNAIPHPQIGVQVEKKWARKDYVKLTTE

SEQ ID NO: 8396 - protein, 136 aa, Tropheryma whipplei str. Twist
MEQTLVIIKPDGIRRGLIGQVLSRIEAKGYQIVDIRMLVPDRQSVEEHYLEHRDRHFYLPLVDFMTSGPIVLVRAEGHGVVDALRTLVGVSDPTLALPGTIRGDFGRNWGLGVIQNIVHASDSVKSAKRELDIWFP

SEQ ID NO: 8397 - protein, 526 aa, Thiomicrospira crunogena XCL-2
MSQNNIHEHRILILDFGSQYTQLIARRIREIGVYCEVEPWDIDVEDIVKFGARGIILSGGPETVTGDNAPVAPVEVFELGVPVLGICYGMQTMAEQLGGKVINATEHEYGYAQVRAHGHTKLLNDIEDHVTPEGYGMLDVWMSHGDRVDKMPEGFKLMASTGNCPIAGMANEEKDFYGIQFHPEVTHTTQGQRMIERFVVDLCGCEKLWTTENIIDDSIARIRQQVGSDEVLLGLSGGVDSSVVAALLHKAIGDQLTCVFVDHGLLRHQEGDQVMSMFAENMGIKVIRVDAEDYFMNALAGEADPEKKRKIIGHAFIEMFDQESAKLTGVKWLAQGTIYPDVIESAGSKTGKAKVIKSHHNVGGLPEDMKLELLEPLRELFKDEVRRLGVALGLPSDMVYRHPFPGPGLGVRILGEVKKEYADILRLADHIFIEELRAADLYDKTSQAFTVFLPVKSVGVVGDARRYDYVVSLRAVETIDFMTARWAHLPYDFLEKVSNRIINEIPRITRVTYDISSKPPATIEWE

SEQ ID NO: 8398 - protein, 170 aa, Saccharomyces cerevisiae
MRGSHHHHHHGMASMVVNNPNNWHWVDKNCIGWAKEYFKQKIVGVEAGSVKDKKYAKIKSVSSIEGDCEVNQRKGKVISLFDLKITVLIEGHVDSKDGSALPFEGSINVPEVAFDSEASSYQFDISIFKETSELSEAKPLIRSELLPKLRQIFQQFGKDLLATHGNDIQV

SEQ ID NO: 8399 - protein, 386 aa, Candidatus Protochlamydia amoebophila UWE25
MADYYEILEVARGATPEEIKKAYRKKAVQYHPDKNPGDADAEKRFKEISEAYEVLSDEKKRQVYDRYGKEALQGAAGGGQGFSSMDEALRTFMGAFGMGGGGESIFDFFGGGNGAEFGGREGGRGARQGASKRVNINVSFEEAVKGVDKELVISNYANCNVCNGKGSSSSQGIKTCSECKGRGQVFEQRGFFSMTMACPKCHGEGKVITDPCKNCKGQGAVKEKQHIKVHIPAGVDSGMRLKMSGYGDVGQHGGPAGDLYVFINVEPHEIFEREGNDILLDLPISFAEAALGCKKEVPSLTNRACRITIPEGTQNGKIFRVKGEGFPNVHGHGKGDLLVRIFVETPTRLSERQKELLQEFSELEGPNNLPKRKGFLDKIKEFFSPN

SEQ ID NO: 8400 - protein, 170 aa, Saccharomyces cerevisiae
MRGSHHHHHHGMASMVVNNPNNWHWVDKNCIGWAKEYFKQKLVGVEAGSVKDKKYAKIKSVSSIEGDCEVNQRKGKVISLFDLKITVLIEGHVDSKDGSALPFEGSINVPEVAFDSEASSYQFDISIFKETSELSEAKPLIRSELLPKLRQIFQQFGKDLLATHGNDIQV

SEQ ID NO: 8401 - protein, 231 aa, Prochlorococcus marinus str. MIT 9515
MKQIVADAAVKEVKDGMIVGLGSGSTAALMIKSLAEQIRLGKLKNIKGVPTSFQSEVLSLELKIPLIDLASVSQIDLAIDGADEVDPDFQLIKGGGACHVREKLVASKANKLLIVVDETKLVQQLNLVFPLPVEVLPSAWKQVKDIISEMNGVSDLRMATKKAGPVVTDQGNLILDVLFNTGIKDPKDLEMRINNIPGVLENGLFVNLTDKVLVGKIENNVPVLFSPSKGS

SEQ ID NO: 8402 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 8403 - protein, 464 aa, Leuconostoc mesenteroides subsp. mesenteroides ATCC 8293
MQDSTSVNPKHHLVQKTEDDLSLSDVNGSIEVPENGSFWRKLLAFSGPGALVAVGYMDPGNWVTSVAGGAQYRYTLLSVVLISSLIAMMLQYMAGKLGIVKQEDLAQATRDRTNKVGGFVLWIMTELALIATDIAEVIGGAIALHLLFGWSMIASVLTTAFDVILLLLLMKFGFRKIEAIVMTLIITILVIFAYLVILSTPQLSALFGGYLPQLQTLSSHTPIGGGDSQLTLTLGIIGATVMPHNLYLHSSISQTRKVDRSNKSELKEAVRFMTWDSNIQLSLAFVINSLLLILGAALFFGHADKVGTFGSMYNALKDNSIAGAIASPILSTLFAVALLASGQNSTITGTLTGEIVMEGFLHLRIPMWLRRVVTRGLALIPVVAFTLIYGGSEGKLDDLMVQSQVFLSIALPFTMAPLIYFTSSKKIMGEEFANPKWIATLGWIAFAVLTYLNVQLVVQQLMGS

SEQ ID NO: 8404 - protein, 178 aa, Triticum aestivum
  misc_feature (136)..(136): Xaa can be any naturally occurring amino acid
MAVRVWLSAILLAFLLAASPFAQVARAQSEEDAAMQEVVDGADLGYVGDDTPVSSEEPLSPAPGVETVCVFPKNAGKIVPAGEETELLVGLQNEGESTLNVVAVHSTLHLPYDHKMYGQNLTVQSFYNASVPVSVXATFPYTFAVSKFLGGAGTNSPIVSDASLRVTTRTGNLGTTNA

SEQ ID NO: 8405 - protein, 650 aa, Schizosaccharomyces pombe 972h-
MKKYLWGTPTTNTVFTGKQPKYTKEVRKCISIDEVYNVVRKVGDGTFGSVYLATTKTPSKEVVAIKSMKKKLAKVSDATRLREVHSLLRLSENENIVNIFDLYIDQFRCLHIVMEFLDCNLYQLISTRKNDPLTLEQVQDIMRQIFKGLNHIHTNGFFHRDMKPENILISSNSDSSSFNVKIADFGLAREINSRPPYTEYVSTRWYRAPELLLRDSYYSFPVDIYAAGCMAFEIATLQPIFPGNDDFDQLYKMCEILGSPDEQSQNTGDKGGGIWDRAELLANKLGISLPKMAPLDFGDLFSPPWNLAFASMLSQLLKWDPAKRPTAEMCLDLEFCRVSAPADAVASKEEVNKNTDFRVSISYFPSSSSIPDECNTEEESRINPSTSKFLKQLNKGFNGFTKPFRKSRKQSKNRKNKSSVATQFSEESEDIADSITSSTFFPVLPQIRPSTPLNLKLRNFIISSSEDSTSPKAKEFDRPLPSTEFLVAINKSQEALLNNSPNSKSGSTQLSASTCLSDLISPQLSILSHEDKRENQSVNSESSKYSPRSSNHSPTLHSKDLHRDMATVNNYAKSPPSFHATQDLLRKTLAYTNSSGTSTVLSNDSSAISSTFLDRDFPDFGITSLAGSLTLPDSKIIDRSKTHVSTQLLP

SEQ ID NO: 8406 - protein, 337 aa, Monascus purpureus
MVVPKVGINGFGRIGRIVFRNAIEHEGVDIVAVNDPFIEVHYAAYMLKYDSTHGRFNGTVEFDGNTLIVNGKKIKFYAERDPAQIPWSETGAEYVVESTGVFTKQEKASLHLKGGAKKVIISAPSSDSPMFVMGVNNDQYTKDITVLSNASCTTNCLAPLAKVINDKFGIVEGLMTTVHSYTATQKVVDGPSNKDWRGGRTAAQNIIPSSTGAAKAVGKVIPSLNGKLTGMSMRVPTSNVSVVDLTARLEKAATYDEIKQAVKEASEGPLKGVLGYTEDDVVSSDLNGDPHSSIFDAKAGIALNSNFVKLVSWYDNEWGYSRRVIDLIAYIAQVDAQ

SEQ ID NO: 8407 - protein, 503 aa, Arabidopsis thaliana
MAITVPRRQLFIGGQWTEPVLRKTLPVVNPATEDIIGYIPAATSEDVELAVEAARKAFTRNNGKDWARATGAVRAKYLRAIAAKVIERKSELANLEAIDCGKPLDEAAWDMDDVAGCFEYYADLAEGLDAKQKTPLSLPMDTFKGYILKEPIGVVGMITPWNYPLLMAVWKVAPSLAAGCTAILKPSELASLTCLELADICREVGLPPGVLNILTGLGTEAGAPLASHPHVDKIVFTGSTTTGSSIMTSAAKLVKPVSLELGGKSPIIVFDDVDIDKAVEWTMFGCFWTNGQICSATSRLLVHERIADEFLDKLVKWTKNIKISDPFEEGCRLGPVVSKGQYERVLKFVSNARNEGATVLCGGVRPEHLKKGYFVEPAIVSNVTTSMEIWREEVFGPALCVKTFSTEDEAIQLANDSQYGLAGAVLSNDLERCDRVSKAFQAGIVWVNCSQPCFCQAPWGGTKRSGFGRELGEWGLENYLSVKQVTQYISDEPWGWYKPPSKL

SEQ ID NO: 8408 - protein, 255 aa, Thermotoga maritima
ITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 8409 - protein, 364 aa, Arabidopsis thaliana
MGKGGMSQGEGSKVEEENMAAWLVGINTLKIQPFLLPSVGPHDVRVRMKAVGICGSDVHYLKTMICADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 8410 - protein, 418 aa, Arabidopsis thaliana
MILPMLGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNECRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 8411 - protein, 447 aa, Borrelia garinii PBi
MYRIKNENLDFKIDSLGECKQNNPLIDFYAGEGSSHFVNEKNKIKFSVYRNEDEGDKYEDILLEKAGPREKIYFVPRHVKAAITTCGGLCPGFNDVIRSIVRTLWKIYGVRNIYGVKFGYQGLLPESNSPFINLNPDVGDDINKFGGTILGSSRGGIKPVEIVDTLERMNINMIFNIGGDGTQKGSLLIAEEIEKRNLKIAVVGIPKTVDNDFMFVQKSFGFETAVEQAVAAVAGAHFEANSAYNGIGLVKVMGRDSGFIAAHTALSSNDVNFCLIPELDFDIEGPNGFLVHLERRLLEKESLEEIPHAVILIAEGAGQKYFNQFPRKKDDSGNLLYEDIGLYIKDKITEYFKAKNIQFTLKYIDPSYIIRSSPANASDSLYCARLGSNAVHAAMSGKTKMLISLWSTKFVHIPIKMAVIDRNKVNPNGSFWRDVLSSTGQPISMKN

SEQ ID NO: 8412 - protein, 3487 aa, Microcystis aeruginosa
MVESIDYKKLMATTLSKMEVMQARINELETRQSESIAVVGMACRFPGGINSPEKYWSFCQAGLDAIVEVPKSRWDISKLYSQEPTLGKMNTAYGGFLQENITEFDARFFSISAKEAASMDPQQRLLLEVAWEALENANLPLKNLADNKVGVFVGITSIDHALKVYGTNYDQIDSFFGSGNALSAAAGRLSYFLNLHGPCLSIDAACASSLAAVHQGIRSLRNRECELALVGGVNLILEPAITISLSQSGMMSPDGRCKTFDASANGYVRGEGCGVLILKTLSEAQKNGDHILALLRGSAVNHNGAAAGLTVPSGPAQQELLRQALVDARIVPEDVSYIEAHGTGTSLGDPIELNAIASVYGKRSDPLYVASVKTNIGHLEAAAGMAGIIKTILILQQGEIPSHLHFQTPNPLINWEDHPIKIPTQNIPWPNNNKVPIAGVSSFGFSGTNAHVIVQQAPVSKISEIQQQLPSHLLTLSAHNKTALKELAKRFHTLLESRPEIGDICYSAAVGRIDLPERLAIVGDTCPELQQRLAAFAEEKPLDDLTFYQRFTSEKSPKIVFLFTGQGACYPGMGHQLYQTQPTFRQYIDQCAEILSKYLDHPLTEILFGEQTDLLNQTAYAQPAIFALEYSLTMLWKSWGITPSLLIGHSVGEYVAACIAGVFSLEAGLALVVKRGQLMQTTTSGKMASIFADEETVSSLIKNYTQTVSIAAINHPQQIVIAGESASIEEVISTCKKQKIPAQYLPVTQAFHSPLMEPILKEFEKEARQIYYQRPQILLLSGLDGELLENAPDAAYWSKQCREPVRFLSSLITAFNKGYNLFLEVGPRPILAEQGRRYKDEVIWLSSLNRGLDNWHTILSALAQLYLNGAPFNPEQFNRNYGYKKVRLPNYPFQRKPFQFQPNPRTENQSIDKIFLDAQTSNLTDTETTVFNMQKHQQEIRNQLKSILALLLKEDENDLPEDETLLNLGADSIILTDFSRKVEEKFQVKVKIDQLFTDLQTLADIAEYLCQFVNEKPLENASEITTKVINDETELSNYLQVIEQLQPIATAYIIRALESLGKKLNQGEQWTIETLRQTLPVARKYHILLNRYLQDLEQANVLHNQGNIWTVKNLPESFSLPQALQKLEKTCPSAKPELEMLQRCGENLAEVLKGNIDPLTLIFPEGSVAHAESIYGNSPVSRLMNQRVAQAINQILTNFSNSDRPYQILEIGGGTGATSEAILHHLNLDHVTYSFSEVSPFLLHQARQKFQKKYNLNFHQLDIEKSPISQGIPARNYHIVVAANVLHATRNITETLTHIRELLRPGGYLVLLETVENNSWLNLTFGLTPGWWRFQDQQLRSDTPLLRGENWCSVLKSCGFATANSFSKQNNIPINNGQELILACVPDEPLSIPAIPKFTVSGESSGKEALMMAQLQSLKDLKDLHEKTIIKQLEVLQTAPVFPSIAPEILTNQTQIIPTQSSKTETYLPVSQEKPKSPEKPSSPNLNPLALKLTENKSLTEQQQAFIQNLQSIYNQKTAKSKAYSQNSRKTMVDVKPTIDFRMALKEFQYPIVSESAQGAYFKDIDGNNYIDLAMGFGVNFFGHSPDFVIKAVQEQMNRGIGLGMQSNLAAETAALISEMGRVERVAFSNTGTEAIMAAVRIARSRTKRQKIVMFAGSYHGTFDGILARVGEDKTTAQPLSLGTPLGMVEDIIVLSYGVEESLDIIATHADDLAAVLVEPVQSRKPDLQPQEFLQKLRQITHKKGITLIFDEIITGFRIAPGGAQEWFNVEADIVIYGKAIGGGLPISMICGKADFLDTVDGGFWQYGDDSHPQTELTAFGGTFCRHPLALAACRAVLLHLRENSPTIQEKVNQLTHRLATEVNQFFQEIGIPIRVVNFGSLFRFEPFGAYSIFLQPIELPLFYYLLNLKGIYTWEKRVCFLSTCHTNKDIDKVIVAVKEAITELQQAGFFANAKRPQVKKEEKKPLSEDEDGRGHLPSLNQSFPTSEAQRQLWLLAELDRNASASYNVTTSLELLGSLDVYILEKTINQVINRHEALRTKIIEQGELQEVVNEVNIKLNLIDFKDEDNPEATALALRSQFSQKPFDLSIAPLFAVILMRLKPDHYLLSLKTHHIVADGWSLGLILQEIGQLYSSQNNTTKEVLTPPMQFRQYLTLRAQETQSPQMLEHRDFWLKTYQEDLPTFELPTDFPRPAVKTYTGGQESQVIPSEVGQNLQKVGRKNKATLFMTMFAAYTAFLRRISGHRDLVIGIPISGRQIEGSDNLVGFCSQFLPLRIQVDATTSFIEHLQHTKQTLIDAFRHQSYTLEDLLAALQLPRDFSRSPLISVSFNMDPSLTLPEFKDLKVSLPPSPIGYTPFDLGFNLIELNDNLIIYCNYNTELFKKETIKQFIESFEILLRGIIDDANHLLYQLPLLTPVQQEKLLRQLTGKTRKLPEKATIIDDFVAQVKLTPNAPALIAGKINLSYQELNEKVNRLTHYLQQEYQLGVGKVIGVMLQRDHNLIIGILATFKTGATYVPIDSQYPHSRIEFILKDSGCHVCLTESNFISKLPEKMQKICLDKIDPIVEKYDKDEPKIFRNSSQTAYIFYTSGSTGNPKGVMGCHISILNVIQSLRLTFDLDKHPEWRYIFTAAVTHDPSIRNIFLPLTIGASLYMYEIKYIGHLVSFLQENQINALHTTPSIYREILGLLEPGETISSLKYISVGGEKLDRETALALRKRFPAEIVSNVYGSTETCVGVSQYEIKENLDSEIPLGQVFHNNRLGVLDEFNNPVPLHVIGEICVEGAALASGYHNQPEMTQEKFKPSFLDETKTLFRTGDLGKQTAPGIIEFMGRKDNQVKVNGYRIDPGEIEYQLTRYAPIERAIVLPVQVNNQTQLSAYCQTDKTLEIAEIRELLAKFLPVYMIPSYFIFLKQFPLTRHGKLDLHSLRELRETGKSLVNSNYVAPRNHLESNLVSIWEKILSKHPIGIFDNFFEIGGHSLLLSRVVTRVHKELNVSVKLADFFKVPTIAGLATLISQTQYNYQEPISAIPPQKSYPMSHGQRRLWALEFLDQNHNAYGMPSAYQFKGNLNIDAFENAFQQLIQRHEILRTTFTLINNQPRQVVHNQMNFVIKQIDLTAYVSTEQENLIEESISHNAKTTFDLEVGPLLKVNLLKLSQENYIVLFNMHHIIFDGWSAGVLIKDFLTHYHAYGQENSQLMPPLRIHYKDYTSWQESQLETLKLQGQRDYWLAKLTPVPVRLNLPVDYPRPPVKSFQGNTITWQPEPELIDTFEKLVKAQEASLFMGLVSLVKSFLFRYTEQNEITIGSAIAGRNHPDLEDQIGFYVNTLVLRDQITDHDSFTDVLSKVKTTTLEAYDHQDYPFDQIVSDLNLQRDPSRNALFDVAIVLQNNQNVDLALDGITVNSIDPKMITAKFDLEFIFVEEEELYLKLIYNTDIFIHERILLIIDLFKNWLEQVLKFAHEPLINLSLASSENLTQEGQELFTEDFNF

SEQ ID NO: 8413 - protein, 592 aa, Candidatus Protochlamydia amoebophila UWE25
MQLKAEEIILKGSPICRGIAIGQTYFLDRDEFTVCEKQIDSSDSEKEVERYRHALFRSRQDIKRLQTQLESESAQEAILILEAQLEILQDPLLTTEMELNIRQANQNAEFVFQQSLVKLQTRFESLKDPFFAERFKDLQDVSQRVFSYLYESGSLSLKDVPYNSIVCGVELTASDTAEAKVYHVGAFLTESGGATSHAAIVAKAKGIPFISNINLHLIRENDNQTIIVDGRTGQVILNPTDETLHRYETLKRKMHTQITAFENDVHWPAETCDGYTVRLYGNLDDSHQVDLLKQLGGQGIGLFRSEYIFLPQKEIPGEEEQFNIYSQIVKKMDGLPVVIRTFDLGGDKATFHVPSTTQKNPFLGSRATRYFLREQKLLKSQLRAIVRASIYGQVRILFPMIATVAELREAKKILQEVCQELHFDQHIPMGCMIEVPSAAMVVDHFVKECDFLSIGTNDLVQYALAIDRKDHLLNDFYEPTDPSIIRLIKLVISEGNKAHVPVSVCGEIASDPRFIPLLLGLGVQELSVAPRYLPVIKNVIRSTYIVDAVQLADLALHLTTAQEVLNLLIQEYQKSVPHDLFYNVSYPPQTYI

SEQ ID NO: 8414 - protein, 390 aa, Oryza sativa (indica cultivar-group)
MDSIMEPYVADLLADDITASMVELLSGDGGAAQMDVGVLDAYLRAIGALPAHPAAPGADLAAAAEVESMASNDDTNGNWDTKVDAKVPSAFLPPPPGFPPLPVPALANEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDAREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQHISSCVLTVLNTQ

SEQ ID NO: 8415 - protein, 562 aa, Arabidopsis thaliana
MEDLRRRFPTKKNGEEISNVAVDPPLRKASDALPLPLYLTNTFFLSLFFATVYFLLSRWREKIRNSTPLHVVDLSEICALIGFVASFIYLLGFCGIDLIFRSSSDDDVWVNDGMIPCNQSLDCREVLPIKPNSVDPPRESELDSVEDEEIVKLVIDGTIPSYSLETKLGDCKRAAAIRREAVQRITGKSLTGLPLEGFDYNSILGQCCEMPVGYVQIPVGIAGPLLLDGVEYSVPMATTEGCLVASTNRGFKAIHLSGGAFSVLVKDAMTRAPVVRFPSARRAALVMFYLQDPSNFERLSLIFNKSSRFARLQSITCTIAGRNLYPRFACSTGDAMGMNMVSKGVQNVLDFVKSEFPDMDVIGISGNYCSDKKASAVNWIEGRGKHVVCEAFIKAEIVEKVLKTSVEALVELNTLKNLVGSAMAGSLGGFNAHSSNIVSAVFIATGQDPAQNVESSHCMTMILPDGDDLHISVSMPCIEVGTVGGGTQLASQAACLNLLGVKGSNNEKPGSNAQQLARIVAGSVLAGELSLMSAIAAGQLVKSHMKYNRSSRDIGPSSQVNR

SEQ ID NO: 8416 - protein, 579 aa, Gibberella zeae PH-1
MCGIFACHRHPDVEKFKPTALKLAKQIRHRGPDWSGSVISNHTILCHERLSIVGVESGAQPLTNADDSIILAVNGEIYNHRHIRKHLKERYHFKTTSDCEVIIPLYTEFDTDAPNHLDGMFSFVLYDKKQDRTIAARDPIGITTFYQGWSSTEPGTIYFASELKCLHSVCDKIVAFPPGHVYDSKTGETTRYFNPSWWDPKKVPSTPVDYKVLRQALEKSVRKRLMAEVPFGVLLSGGLDSSLTASIAQREVTRLRKQALEANGNVLPVEDPDTGEGLVGVDDDDHLDTLTYLPQLNSFSIGLPGSPDNKAALEVAKFLGTKHHVMTFTIEDGLNALSDVIFHLETYDVTTIRASTPMYLLSRKIKAMGIKMVLSGEGSDEIFGGYLYFHAAPDKDSFHEETVRRVKNLHLSDCLRANKSTSAWGLEARVPFLDKEFLEYSMNIDPQDKMITKEKLEKYILRKAFDTSDEPGEQPYLPDNILWRQKEQFSDGVGYGWIDALKDTAEKQVTDEMMKNPKPEWGNDIPDTKEAYWYRCMFDEHFPPHCASTVMRWTPTWSKQTDPSGRAIATHNAKYDSAA

SEQ ID NO: 8417 - protein, 248 aa, Arabidopsis thaliana
  misc_feature (108)..(108): Xaa can be any naturally occurring amino acid
  misc_feature (131)..(131): Xaa can be any naturally occurring amino acid
  misc_feature (151)..(151): Xaa can be any naturally occurring amino acid
  misc_feature (170)..(170): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYXRSTGNSPGYYDGRYWTMWKLPLXFGCTDSAQVLKEVEECKKEXPQCLIRIIGFNTTRQVQCXISFIAYRPPTFTGNFPFAFGETLKLYPPSLILSPGFSGFFLLPGGLISGLNVCFRFGRTYPFGFSLSDGNKMECSQKK

SEQ ID NO: 8418 - protein, 443 aa, Borrelia garinii PBi
MKIIIIGGTSAGTSAAAKAKRLNKKLDITIYEKTNIVSFGTCGLPYFIGGFFDNPNKMISRTPEEFEKTGISVKTNHEVIKVNVKNNTIVIKNQITGSIFNNTYDKLMIATGAKPIIPAINNINLKNFYTLRNLEDGQKIKNLMDKEEIKNIVIIGAGYIGIEMIEAVKNKRKNVRLIQLDKHILIDSFDEEIVKIMEEELIQKGVDLHTSEFVKSLIGGKKVEGVVTNKNTYQADVVILATGIKPATEFLENQLKTSTNGAIIVNEYGETSIKNIFSAGDCATIYNIVSKKNEYIPLATTANKLGRIVGENLAGNHVSFKGTLGSASIKILSLEAARTGLTEKDAKKLQIKYKTIFIKDKNHTNYYPGQEDLYVKLIYEENTKIILGAQAIGKNGAVIRIHALSIAIYSKLTTKELGMMDFSYSPPFSRTWDILNIAGNAAK

SEQ ID NO: 8419 - protein, 373 aa, Zea mays
  misc_feature (210)..(211): Xaa can be any naturally occurring amino acid
MLGVARRRLGSGCVLAQLAQALRPAAVPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENEXXYGESFPVSAEVLDSSFCLPIGKAKIERQGEDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 8420 - protein, 530 aa, Borrelia garinii PBi
MINYKNLNELENFKILEGIAPEVLKTALTGKRIKEYDITIEGDSVHYNYASKQINENHLKIFQNLSDEANLIEKYKEVLNGEKINISENRKVLHHLTRGQIGKDVIEDNKENMREFFQSELEKIYNFAKQVHSGNIKSVNGKKFKNVVQIGIGGSSLGPKALYSSIKNYAKKHNLALMNGYFISNIDPDESEEVLNSINLDETLFIIVSKSGNTLETTANMQFLINKLKSNGIKEYKKQMTIITLKNSMLALEETGCLEYFFMHDSIGGRFSPTSAVGLALLTLCFTEKIVKEIIKGANKTDKKSLNKKVKDNAPLLAALISIYERNVLNYSSNCIIAYSKAMENFYLHLQQLEMESNGKSVNRFNETINYKTVRIIWGGVGTDVQHSFFQMLHQGTDIVPMDFIGFNATQLKEDVISDNSSSNDKLKANLIAQIIAFSKGKENSNKNKNFKGERPSALIYSKELTPYAIGAILSHYENKVMFEGFLLNINSFDQEGVQLGKILANQILKNNAFEDEVIESYSKKILKQD

SEQ ID NO: 8421 - protein, 300 aa, Synechococcus sp. PCC 7002
MTHYSNVLDPIPSTPPQPNPRPRNYSRLTRLSYATGPVWIILCHLGMAIAFFTGLSWGAVLWIVFWYWLRMLGTTAIYHRLLTHKAYQASPWVKWIGSFITASAGQMGPSWWKAHHEDHHRFSDHPGDPHSSKEGFWWAHYRWLISPNTFPKKLPADIERDPILKLIDRFHFVPLIALGALSYGVGGLEYLAAFFISTTLLFHGVAFVNSVCHKWGDRPFQTTDHSRNNSWVAVLALGEGWHNLHHAFGWSVRHGITIQKGKVKYLPDFTYSFIRLLERMGLASKLKQPTVTDLQNAANP

SEQ ID NO: 8422 - protein, 792 aa, Streptococcus pyogenes MGAS8232
MKTKKVIILVGLLLSSQLTLIACQSRGNGTYPIKTKQSRKGMTSNKIKPIKKSKKINKTHKGVAGVDFPTDDGFILTKDSKILSKTDQGIVVDHDGHSHFIFYADLKGSPFEYLIPKGASLAKPAVAQQAASQGTSKVADPHHHYEFNPADIVAEDALGYTVRHDDHFHYILKSSLSGQTQAQAKQVATRLPQTSSPVSTVTANGIPGLHFPTSDGFQFNGQGIVGVTKASILVNHDGHLHPISFADLRQGGWAHVADQYDPAKKAEKPAETHHTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDAPTPFPSNEKDLNKMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRPLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLNVTGNQLTSLEGVNNFTALDILSVSKNQLTNVNLSKPNKTVTNIDISHNNIPLADLKLNEQHIPEAIAKNFPAVYEGSMVGNGTAEEKAAMATKAKESAQEASESHDYNHNHTYEDEEGHAHEHRDKDDHDHEHEDENEAKDEQNHAD

SEQ ID NO: 8423 - protein, 488 aa, Pisum sativum
MILEMGSMWVVLMAIGGALLVLRSILKNVNWWLYESKLGVKQYSLPPGDMGWPFIGNMWSFLRAFKSKDPDSFISSIVSRYGSSGIYKALMFGNPSVIVTTPEGCKRVLTDDEKFTTGWPQSTIELIGKNSFIAMTYEEHKRLRRLTSSSINGMEALSLYLKYIEENVIISLEKWSNMGQIEFLTEIRKLTFKIIMHIFLSSESEPVMEALEKEYTILNHGVRAMQINVPGFAYYKALKARKNLVGIFQSIVDDRRNIRKVYSQKKAKDMMDSLIDVEDDNGRKLNDEDIIDIMLMYLNAGHESSGHITMWATYFLQKHPEYLKKAKEEQEEIIKRRPSTQKGLTLKEIRGMDFLYKVIDETMRVITFSLVVFREAKSDVTINGYTIPKGWKVLTWFRSVHLDPEIYPNPKEFNPNRWNKEHKAGEFLPFGAGTRLCPGNDLAKMEIAVFLHHFTLNYRLEQLNPKCPIRYLPHTRPMDNCLGRVKKC

SEQ ID NO: 8424 - protein, 580 aa, Synechococcus sp. CC9605
MAVAETGTQSLSKSEQRKLDSDHLRDPLLSELSNDDVRFTEDAVQLLKFHGSYQQHHRELRKTDKIRSWQMMLRLRSPGGRIPARLFLALDDLSNRLGDGTLRATTRQAFQMHGIAKADLKEVIGTIVRNMGSTLAACGDINRNVMAPPAPFEKGGYPVARRLADEIADLLSPEAAEGAYLDLWVDGDLSYRFKPSRAVQKARKRQSEGGLFSGSTEEPLYGDTYLPRKFKVAVTVPGDNSVDLLTQDIGLVAFTDPSGDLRGCNVYVGGGMGRTHNKEETFARTADPLGYVDAADVLDVVQAILALQRDHGDREVRKHARMKYLLHDKGIQWFRDTMCATYFKGDLKGLRNEPKAKLLDYLGWHRQKAGMWFVGLPLLCGRLNGDLKAGLRQLVETYQLEIRLTANQDLLLCNIGTSQRASIRTQLEALGFEVPEAPAPLARHAIACPALPTCGLAITESERILPDVLDRLDAQLRRLEIEKSLLVRMTGCPNGCARPYMAELGLVGNGVNQYQLWLGGTPNLQRLARPYMEKLPLDDLEKTLEPLLISWKAAGGRRSFGDHIEKLGDQEVSALLTASA

SEQ ID NO: 8425 - protein, 490 aa, Pisum sativum
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 8426 - protein, 381 aa, Arabidopsis thaliana
MSFFRSKTSKTETQQPSSYGQQQDAMYSSYGTVSDEVLLQIHGCRAHLINGSEAVELAAGDFELVQVLDSNVALAMVVRIGNDLQWPVIKDEPVVKLDSRDYLFTLPVKDGEPLSYGITFFPIDENDIVFVNSIELLDDFLRENSCFSSSPSSSSSSSSSSSSSVNNGIDWKEFAPKIEDYNNVVAKAIAGGTGHIIRGMFKCSNAYTNQVHKGGEIMITKAEKKNGASSKRNATTNKNQINKNLQRVRKLSRATEKLSKTMLNGVGVVSGSVMGPVVKSKPGKAFFSMVPGEVLLASLDALNKLLDAAEAAERQTLSATSKATTRMVSERLGESAGEATKDVLGTVGHAAGTAWNVFNIRKAFSPSSSVTSGILKNASRK

SEQ ID NO: 8427 - protein, 350 aa, Zea mays
MQAKARIHADPVHEFDQFDCLHDSLVLLILNKLEDVRSLGRCSAVSKRFSGLVLLVHDVRVKIDHVVTVDGGADDALNLSSPKPHNIISHLFKMMLFAIAKPFHDMRSPISAGRLLFPQLSQHSPVQVLKNFSHVRNLQVELPSGDVAVEEGVLLKWRAEYGSTLQSCVILGGTLVDRKAAGSGHEPSPDDKGSMPESFYTNGGLKLRVVWTISCLIAASTRHYLLRSIINDHPTLRSLVLADAEGQGALSMGAEQLNDFREHQLSASPCSNRTQVPACNMKLKYAQYLELPGGLALQGATLLVTKPASDGHGNRKEVEAFVSSAFDGPLRFAAKALMKRRTYLLEMNGF

SEQ ID NO: 8428 - protein, 357 aa, Oryza sativa (indica cultivar-group)
MRLLFAACQGDVAGVEELLRDGVDVDSIDLDGRTAMHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIETSFREIAWLPSRFPPFLHM

SEQ ID NO: 8429 - protein, 162 aa, Triticum aestivum
LAPGARIHADPALDFELDLFDCLPDSLVLLILNKVEDVRSLGRCSAASKRFNGLVPHVHDVCVKIDRVVAVDGDGEDALNLISPKPRNILSHFLKLMLFTIIKPFHSARGPNGAGRPLFPQLAHHSPAQVLRSFTHVRNLHIELPSGDVGTEDGVLLKWRAE

SEQ ID NO: 8430 - protein, 579 aa, Gibberella zeae PH-1
MFSAVLLGQLLRGKPLQSITSRNFASGKGSRGSNGRKSGPRRPLLYASAGVGTIGATALALGDDIKNSYEAAERIWRKGYRTDGLHSYRTTLNAREATEDHDEQENMLKACHKRCAERTLVVLEKNGGIFIKLGQHLSAMNYLLPSEWTNTFIPLQDKCPVSSLESIEDMFRQDTGEELWDYFSDFASEPIGAASLAQVHLATIKGSDQKVAVKVQHPELQGWAPLDLALTRYTFSTLKRFFPEYDLEWLSSEMDVSLPKELDFQEEADNARRMKEHFAKIPQLPLIIPEVIWAKQRIIVMACEAGSRLDDLEYMDKNGIDRDEVSATLSRIFNEMIFGDGAPLHCDPHGGNIAIRKNTSRRGLGRGPNFDVILYDHGLYRDIELPMRRSYAKMWLAVIDGDMDRMKKYAHEVAGIEDKDFPLFASAITGRDYSIVSKSGSILENRTADEQKTMSGALQEGLIVDLVQLLSRVPRIILLILKTNDLTRSLDENLQTRQGPIRSFMILARYCTKTVFHEKLEEISQNGSLLWPLNAVRLIAAWVGFMRVEIKLEAFELWLFTKRMLGMGNGEFSGAAFQK

SEQ ID NO: 8431 - protein, 515 aa, Bacillus halodurans C-125
MLTPYKHEPFTDFSVEENRSAFEAALKNVEGELGKDYPLVINGERVTTDDKIVSVNPAMKEQVIGVVSKASREIVDDAFKSAETAFHTWKNVNPEERANILIRAAAIIRRRKHEFSAWLVKEAGKPWKEADADTAEAIDFLEYYARQMITLKDGKPVNSREGEHNRYFYTPIGVCVTISPWNFALAIMAGTTVAPIVTGNTVLLKPASTTPVVAAKFVEVLEEAGLPKGVVNFVPGSGTDIGDYLIDHPKTSLITFTGSRDVGVRLYERAAVVHPGQQHLKRVIVEMGGKDTVVVDKDADLDLAAQSIVTSAFGFSGQKCSAGSRAVIHQDVYDVVLEKAVALTKQLSVGEPTAPDVYMGPVVDQGAFSKIMSYIEVGKEEGRLMVGGEGDDSKGFFIQPTIFADVDPHARIMQEEIFGPVVAFSKARDFDHALEIANNTEYGLTGAVITTNRHHIEKAKRDFHVGNLYFNRNCTGAIVGYHPFGGFKMSGTDSKAGGPDYLALHMQAKTVSEMY

SEQ ID NO: 8432 - protein, 420 aa, Bacillus halodurans C-125
MGAIAEKGKESSILSSTQDVIQQALGKLGYEEGMFELLKEPVRMLTVRIPVRMDDGTVKVFTGYRAQHNDAVGPTKGGVRFHPEVTADEVKALSLWMTLKCGIVNIPYGGGKGGIVCDPRTMSFPEIERLSRGYVRAISQIVGPSKDIPAPDVFTNSQIMAWMVDEYSRIREFDSPGFITGKPIVLGGSHGRETATAMGVTICIEEAAKLKQLDLREATVIIQGFGNAGGYLAKILSDRGAKIIGISDAYGALYDETGLDIEYLLDRRDSFGTVTTLFKNTITNEELLEKKCDILVPAAIANQITEANAREIKASIIVEAANGPTTTEATNILTERGVLIVPDVLASSGGVTVSYFEWVQNNLGYYWSEEEVSEKLRSKIVEAFHQVVETATRYNVDPRLAAYMVGVRKTAEASRFRGWI

SEQ ID NO: 8433 - protein, 278 aa, Glycine max
MYAETGLFFPYLHNVSHGLHQLEEYCKTQKSNASMDDLVQSSAMSEYDLAAEGDLFKAPEPIIEEPIMDMSAAISMMSCGEDVSSQGLKSTDIDILQNDQFLSEVFYECEKDLLEKAAIESPFSEILEIKVPFLNIDENTIQENKPFTDMQLAKSVSSGSLSSMDWMRGAAMKPAFIDISAIDFNADYGMRRSFSEGDIKTLGNGNMNIVQSPLERPLLISNCTSEERFQKLSRYRNKKTKRNFGRKIKYACRKALADSQPRIRGRFARTEESDVKRE

SEQ ID NO: 8434 - protein, 268 aa, Glycine max
MAIARTGVYVDDYLEYASTLPAELQRLLNTVRELDDRSQSMITQTRQQTKYTMGFSSHGSKKGNHSYNNNYGNEDDDAAIEKMRKEIEVNQDSALSLCTEKVLLARQAYDLIDSHIKRLDEDLNNFAEDLKQEGKIAPDEPAILPPLPIVPKPEKRKPIYVTPQSKRIDYRDRDWDRERDRDFELMPPPGSHKKEYATPMDVDQPIDPNEPTYCVCHQVSFGDMIACDNENCQGGEWFHYSCVGLTQETRFKGKWYCPTCILLPQCQR

SEQ ID NO: 8435 - protein, 131 aa, Rhodobacter sphaeroides 2.4.1
MGRPMAYDYDPQNIFARILRGEIPSDTVLETDHTLAFRDIRPQTPHHVLVIPKGAYVCFDHFAAEASAEEIVDFHRTAAKVCADLGIGPGEGGNGYRTVSNAGLDAVQEVPHYHMHILAGRPLGPMLSQRD

SEQ ID NO: 8436 - protein, 335 aa, Xylella fastidiosa Temecula1
MTQTITVIRGDGIGPEIMDATLSVLNALQANLNYEFADAGLSALEKHGDLLPESTLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 8437 - protein, 329 aa, Prochlorococcus marinus str. NATL2A
MKGTLLFNALREAIDEEMGRDPLVCVMGEDVGQYGGSYKVTKDLYEKYGEFRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLTEELPEGDYVCALDQADLVKQGSDITILTYSRMRHHCLKAVELLEAKGIDVELIDLISLKPFDMNTISKSIKKTHRVIIVEECMKTGGIAAELMSLITENCFDDLDSPPVRLSSQDIPTPYNGNLENLTIIQPHQIVDAAEKIINNGGLD

SEQ ID NO: 8438 - protein, 475 aa, Streptococcus pyogenes MGAS8232
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAVKISNESEYGLQASIFTTNFPKAFGIAEQLEVGTVHLNNKTQRGTDNFPFLGAKKSGAGVQGVKYSIEAMTTVKSVVFDIQ

SEQ ID NO: 8439 - protein, 524 aa, Bradyrhizobium japonicum USDA 110
MISAITHTARLMRAAFVFAREGVFGSVDPSLVPPPGQLALKLARIVERRGPKHGPRLSRALTRMGPAYLKLGQFLATRPDVVGVIMARDLESLQDRLPPFSQAEAEAAIAASLERPLKDVFASLGPPVAAASIAQVHRGEVVRDGIRKAVAVKVLRPNVASRFRRDLSDFFYVAHKAETYSAEARRLRLIEVINTMSRSVAMEMDLRLEAAAMSEMAENTGDDLDFRVPTVDWDRTTHNVLTMEWIDGIALNDHKRLAEAQVDLPDLGRKVIQSFLRHALRDGFFHADMHPGNLFLDDTGRLVAVDFGIMGRLGMKERRFLAEILLGFITRDYRRVAEVHFEAGYVPAHHSVENFAQAIRAIGEPIHNRTAEEISMARLLTLLLEVTGLFDMTTRPELILLQKTMVVVEGVARGFDPRLDIWKTADPVVREWIERNLGPIGRVQGALTGGGDLARVLMRLPDIAQRSVAVLEQLETMTREGLRLSPESIAAMGRSEGRKNRWRTVALWIIAATFIGILIAVRNL

SEQ ID NO: 8440 - protein, 461 aa, Tropheryma whipplei str. Twist
MSEDFILPALGESVSECVITRWLKEAGDRVEVDEPLVEVSTDKVDTELPSTLTGILEEILVQRDETAKPGQILARIAVDKDETKSNFDHGVKQSDVITGDSTGNLLGNTRPIEDTGWPVTLHTAESKPDLSAKADHIGDEGDKQGNLPTAHNAEIPYATPIVRQLARKLNIDLTNIVGSGVGNRILREDVLLASNRTTNTSTECAQNIPSSPEHDKSAASFDSEVSELRGTRIKMSRLRNIIAERAVHSMQNTAQLSTVIEVDLTRIVDYRNSIKEKFKEAEGVNLTVLPFIINATVQALRKYPVINSHIVDDQIVFPDYENISLAVDTERGLLTPVIKNAGDMTVAQFAKSVFDLARRARNNKLSPDELTGGTFTVTNTGSRGALFDTPVVFLPQLAILGIGAIARRPVIVLDAQGNECISIRSVAFFALSYDHRVIDGADAARFLGYIKSLLETGNCTV

SEQ ID NO: 8441 - protein, 312 aa, Triticum aestivum
AYLGDTTEQVCTKKQAGTGPEFPGYRRPTRPHDTYTKAEKRSGRPRRTTTCSSRRLPARFPNSRVNDSTYRAMGLGLRLPFFLLLLLLVSLGAAQGRSTVFLDIKEARDPDQILMDQITSSKTPVRVERGSPLCPACEKFTDEALSYLSQKQSQDKMMEVLHEACSQTFSLEKKCVELVDSYATLLFAKIAEIKPEEFCKRNGLCRDNALLSGVRSESTCVFCHHLMDEVLSKLKDPDAEFEIIQILLKECKKIEGHEQQCKRLVLQYIPLILVNGEKFLEKNDICTIVQACDAGKKTVVGSFSEEGLLRDA

SEQ ID NO: 8442 - protein, 444 aa, Pseudomonas syringae pv. syringae B728a
MLPPETQRLIEQHGIKYVLAQFVDIHGSAKTKSVPVTGLEMVAEDGAGFAGFAICGMGMEPHGPDFMARGDLSSLTPVPWQPGYGRVVCIGHVDGKPWPYDSRYVLQQQVERLSQRGWSLNTGLEPEFSLFKRDVTGSLQMVDASDNLDKPCYDYKGLSRSREFLERLTEALQPVGFDIYQIDHEDANGQFEINYTYSEAMESADRFTFFRMAAGEIANDMGMICSFMPKPDPKRAGNGMHFHLSIASASNKNLFHDASDPSGMGLSTLAYHFAAGLLAHGPALCAFAAPTVNSYKRLVVGNSLSGATWAPAFIAFGANNRSAMVRVPYGRLEFRLPDAGCNPYLVSAAIIAAGLDGIDRQLEIDHVCNENLYKLSLEEIAARGIKTLPQSLNEACDALQADPLFGEVLGSEIVDEFIRLKRMEWVEYSRHVSDWEVKRYIEFF

SEQ ID NO: 8443 - protein, 227 aa, Neisseria meningitidis Z2491
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEQYGDEQVRIWRRSYDTLPPLLDKDDEFSAHKDRRYAHLPADVIPDGENLQVTLERVLPFWEDQIAPAILSGKRVLVAAHGNSLRALAKHIEGISDEDIMGLEIPTGQPLVYKLDDNLKVIEKFYL

SEQ ID NO: 8444 - protein, 343 aa, Vibrio parahaemolyticus RIMD 2210633
MKIKALSKLKPEQGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 8445 - protein, 200 aa, Schizosaccharomyces pombe 972h-
MTTELRRKLVIVGDGACGKTCLLIVFSKGTFPEVYVPTVFENYVADVEVDGRHIELALWDTAGQEDYDRLRPLSYPDSHVVLICFSVDAPESLDNVQEKWISEVLHFCSNLPILLVGCKVDLRNDPKTIEELSKTSQKPITFEEGQVVAQKIGAYKYLECSAKLNEGVNEVFETAARASMLKFKPASVPKTKKKKHCILL

SEQ ID NO: 8446 - protein, 411 aa, Pseudomonas putida
MIKAIVIIGAGLAGATAARSLRAQGYLGQIHMVGEEACVAYDRPSLSKDVLAGNLVEPPLIMDPFWYVSADIDLHLGVRVTGIDVVSRQVLFESGETLAYDRLLLATGVRARRMAIMGCELAGIHTLRDSADSFALRQVLEPGKSLVIVGGGLIGCEVATTARKAGTKVTILEAGDELLLRVLGHKIGAWCRTELELMGIRVELNAQASHFEGQGHVRAVVCADGRRIAADVVLISIGAEPADELARAAGIACERGVLVDATGASSCPEVFAVGDVAAWPLRTGGQRSLETYINSQMQAETAAAAMLGTPVPAPQVPTSWTEIAGHRMQMIGDFGGPGEIVLRGDVQNGQPLVLFRLLDGRIEAATAINAAKEFSIATRLVIGRFPVSAKQLQDTSLNLRELLKAKAQLCT

SEQ ID NO: 8447 - protein, 389 aa, Neisseria meningitidis Z2491
MSKKLHPQTLAIRGGKEQTEYREHNQALFLTSSFMWDNAQHAADLFSKKIKGFTYTRTANPTTAAFEKRIAALEGAERAVATSTGMSAIQAAFFTFLQAGDHVISSRSLFGTTVGFINNIVTKFGIEVSHVSPTDINEWKAAVKANTKLLFLETPSNPLGEVADLEALAELAHGIGALLVVDNSLLSPVGSQPLKHGADISVSSATKAIDGHGRVMGGVLAGSEELMAQVAVYCNSCGLAMSPFNAWQLLSGVETLSLRMEKQFDNALKIAQWLQAQPQVQAVYYTGLPDHPQAELIRKQQNGGGIVIGFEVADQAAAWKVVDGVELFSRTANLGDVRSTITHPWTTTHGRMQPEEKLAANIRPGLVRLSVGLEYVGDLIDDLKQALAR

SEQ ID NO: 8448 - protein, 507 aa, delta proteobacterium MLMS-1
MAGLATTFGSGAMTNSVNEIEAADVILLSGSNTTEAHPQVARRIISAQDRGARLIVIDPRRTEMAARADVHLGLKPGSDIPLLNAIQRIILDENLADELFIEMRTENFATLRDQLFRLELSATIASCGLEPAAVRQAALLYGRARKAVICYCLGVTQHVCGTANVEALANLAMLTGNVEKQECGVDPLRGQNNVQGACDMGGLPAMLPGYQPVADEECRRRFEQAWGVEIPTRPGKTLLEMTHGRLPPDHRRPAAGRQQPATPLRGLFIMGENPLLSNPDLTRVRKNLAGLELLAVSDIFLTETAARAHVVLPAACFAEKDGTFTNTERRVQLIRQAVAPPGQARPDGEIIAALARRLGYEMAGSPAHEIMEEIALLTPIYGGIYHDRLASGTGLQWPCWDRRHPGTPYLHKYYFTRGKGRFVVAAQEEPAEAPDADYPLLLNSGRLYHHYHTGAMTRKSPLLEREARVARLQVNPADAESRGIRDGERVRLRSRRGQVELAAELTT

SEQ ID NO: 8449 - protein, 298 aa, Zea mays
  misc_feature (163)..(163): Xaa can be any naturally occurring amino acid
MAAAPSSLASSHLSPIAAVSTPAVPHQLRIGCSRRRAGRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQXVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 8450 - protein, 394 aa, marine gamma proteobacterium HTCC2143
MDTIKETEMVREFDILIYGATGFTGKLVAEYVVEQYGKNIKWGMAGRSKNKLEAVRDAIGAPADTPLVVCDSDNDAEVAAMVAQTKVLITTVGPYQLYGDKVIVACANAGTDYVDLCGEPNWIANQVIGLDDAAKKSGARIVFSCGFDSIPTDLGVFYLQEQAKARLGHVLPRIRGRVRDMQGSASGGTVASGAATTAAVQKDPSIMGLLISPFAQTPGFEGPAQPDGNTPYYDEAVGSWVGPFMMAMINTKAVHRSNYLMQHPWGEDLQYDEMIMLSGDPATADAAAVDPFAMDASLKPGDGPSLEERNAGYYDIIFAGSNDAGEKLQACVKGDMDPGYGSTSKMLAESAICLALDISKDRTGGGCWTTASSMGPELISRLEAHAGLSFSIED

SEQ ID NO: 8451 - protein, 124 aa, Rhodobacter sphaeroides 2.4.1
MNLIAQLEAEQIAALGKTIPDFKAGDTVRVGYKVTEGTRSRVQNYEGVVIGRKGGNTISASFTVRKISFGEGVERVFPLYSTNIDSIEVVRRGRVRRAKLYYLRSRRGKSARIAEVTNYKEKSE

SEQ ID NO: 8452 - protein, 267 aa, Magnaporthe grisea 70-15
MADEGELRQRKPAPDAKWTKIDPSTTKIRTKKEIEDEEDVYYPWWDLLRLAVGLTIAYCGLSYLATGGETYSIGYQVPMKYLHLDSISNPFRKPLWITPEELAAFDGSDENKPVYIAINGTIYDVSANRRTYGPGGSYQFFAGVDASRAYVTGCFAEDRTADMRGVEEMFLPLEDPEVNKQFSAAELEEMRKREREEAERKLHDALKHWVQFFRNHKKYRNVGRVKRRLDWLEKEPKKKLCKQAQEGRPKRKIPGDKNKTNAGTGGQ

SEQ ID NO: 8453 - protein, 249 aa, Oryza sativa (japonica cultivar-group)
MERFQFLGMGSTLCVGEPENNIRLPEPVKLRCSLKMQQNRAAKLRICADGGANRIFDEMFQMTNDPDYESTRKRYIPEIIEGDMDSIRPEVKQFYSSQGSKISDKSHNQETTDLHKCISRIHRCTPDHEKTNLCVLVTGALGGRFDHEAANINILYLFSDMRIVLLSDDCLIRLLPKTHKHEIYIESSVEGPHCGLFPVGAPSGSTTTTGLKWNLSTFLSQVAYSCSFHVKLYASVLSNRRILKILKHI

SEQ ID NO: 8454 - protein, 306 aa, Oryza sativa (japonica cultivar-group)
MESTEPLQDIMCEFRAGKMSLDGTRVIPDTRKGLVRIGRGEEGLVHFQWLDRGQNLVEVDQIVFPEEAVFEKVTQSSGRVYILKFRHDSRKFFFWMQEPSADDDSQICRQVNAYINRPLDGEAVSIEAEMSHEDTADDDISSRAGNLVDQSMTADLAGEVTSAAGPVRLEDLQRILSAIQPSDAVADPDAGLGLGDILKPDLVLPLMETLPIEQLASYLPEGPWTAGDILELLQSPPLRQQVEAFTHVLRTGQIDLAQFGVDPSKYKFTVASFLEALEDSVAKASGAGDKDSESQRGGGNDPMDES

SEQ ID NO: 8455 - protein, 505 aa, Oryza sativa (japonica cultivar-group)
MASRDAIPNESPHTDGRFMMRLKLPNGVTTSEQTRYLASVIEAYGKEGCADVTTRQNWQIRGVTLPDVPAILDGLNAVGLTSLQSGMDNVRNPVGNPLAGIDPDEIVDTRSYTNLLSSYITSNFQGNPTITNLPRKWNVCVIGSHDLYEHPHINDLAYMPAVKGGKFGFNLLVGGFISPKRWEEALPLDAWVPGDDIIPVCKAVLEAYRDLGTRGNRQKTRMMWLIDELVNHFFLHSSTPLTELRMSQCSYQLIAVLALQGMEAFRSEVEKRMPNGVLERAAPEDLIDKKWQRRDYLGVHPQKQEGMSYVGLHVPVGRVQAADMFELARLADEYGSGELRLTVEQNIVIPNVKNEKVEALLSEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGAYKKSVPCDELAPIVADILVERFGAVRREREEDEE

SEQ ID NO: 8456 - protein, 145 aa, Synechococcus sp. CC9605
MLRIGGFCLALPLLAIFWPLVSAQAQQMADAGVITIESDLQSADNGTGVITASGNVRLVHAGRGLVATSRQAQYFTEEDRIVLSGDVDVIQANGNQLRADRFTYLLEEGRAIASPVPGQQVFSQWSLTPGQPVLDVQTETTTVTR

SEQ ID NO: 8457 - protein, 219 aa, Vibrio cholerae O1 biovar eltor str. N16961
MGTMNFQAAIFDMDGLLLDTERVCMRVFQEACTACGLPFRQEVYLSVIGCNAKTINGILSQAYGEDLPRLHNEWRQRYNAVVMHEAIPHKDGVIALLEWLKARSIPVAVATSTQKEVALIKLQLAGLDHYFANITTGCEVTQGKPHPEIYLLAAERLGVEPQQCLAFEDSNNGIKAAMAAQMHAFQIPDLVKPSPEVIALGHPICTSLNEVIDLLSPNH

SEQ ID NO: 8458 - protein, 404 aa, Tropheryma whipplei TW08/27
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRIAGRMIHSSFELAELVLSETLVATVPGEAFGTKGHLRLSYALDETSLLEGTGRLVEFFDTANSDMTKVF

SEQ ID NO: 8459 - protein, 418 aa, Gibberella zeae PH-1
MTNLPQSGHGPVQTSAVVVLGAASCPAMPPPSPPTPSSSPPGDAFCEPIDPLALDRELREEFQTKDQRLQDGLHVLNTEAVALRNLSRLYETDPVARDGFSQTVQAITRQQSTNGKLVVIGVGKSGHIGQKLVATFKSLAIHAVFLHPTEALHGDLGIVGSNDTLMFITYSGKTQELLLMLPHLDESLPTVLLTSHTTPDTCDFFKHRPNTILLPAPIPEPEKTSFGVSAPTTSTTVALAIGDAIAITAAKEMNANIASLFAKNHPGGAIGAAARQPQTIREIAVSWCDIPTAAETVEFSLGFDLLRAGLDSSTGWVRVQDHVASPSTIRGIGRHDLNKSLKDIPSSLVSKSSMVSLSSDTTIRQAQNILNSMQLSLDDEDLVCRRETVVAVLERGNLVGVLEAGSILGFKTEAPLLR

SEQ ID NO: 8460 - protein, 274 aa, Arabidopsis thaliana
MSLFLKDDSIQIREVWNDNLQEEMDLIRDVVDDFPYVAMDTEFPGIVVRPVGTFKSNADYHYETLKTNVNILKMIQLGLTFSNEQGNLPTCGTDKYCIWQFNFREFDLDSDIFALDSIELLKQSGIDLAKNTLDGIDSKRFAELLMSSGIVLNENVHWVTFHSGYDFGYLLKLLTCQNLPDSQTDFFKLINVYFPTVYDIKHLMKFCNSLHGGLNKLAELLEVERVGICHQAGSDSLLTSCTFRKLKENFFVGPLHKYSGVLYGLGVENGQVAI

SEQ ID NO: 8461 - protein, 635 aa, Aspergillus oryzae
MTQLFASSPSNVSNEKRGSFPSLSLPSKKHTNESSHLPTKIKNFFRINSSSSNSSHHSHSHSGDRDREGSPHTGAKTESKSAFRQSRFLPTIGRNRSTTVASEGNPLDEGVSPTATANPYFVHQGQPSLQHRNDGSEPSSPPDTPELQVDGVSAAEQATTANKTELARKLRRVASAPNAQGLFARGDNDGRPQTAETGNQPPVEETDSQITIAEDTVGSLAVPKLGADGKIPSPGEIRNQVAFRRTYSSNSIKIRNVEVGPSSFDKIKLIGKGDVGKVYLVREKKTSRLYAMKVLSKKEMIKRNKIKRALAEQEILATSNHPFIVTLYHSFQSEDYLYLCMEYCSGGEFFRALQTRPGKCISEDAARFYAAEVTAALEYLHLMGFIYRDLKPENILLHQSGHIMLSDFDLSKQSGPGGAPTMIPGRSGNSTTSLPTIDTKSCIADFRTNSFVGTEEYIAPEVIKGCGHTSAVDWWTLGILIYEMLYGTTPFKGKNRNATFGNILRDDVPFPEHGGAQQISNMCKSLIRKLLIKDETKRLGARAGASDVKTHPFFRQTQWALIRHMKPPMIPHQSRGTDTLNFRNVKESASVDIGGSNPTKMKGVPMDSGLATPNGEVNDPFEEFNSVTLHHDGDM

SEQ ID NO: 8462 - protein, 433 aa, Crocosphaera watsonii WH 8501
MVTTTSLKTTKSEEIFAAAQKLMPGGVSSPVRAFKSVGGQPIVFDHVKGAYIWDVDGNQYIDYVGTWGPAICGHAHPDVIAALHNSLDKGTSFGAPCSLENTLAEMVIDAVPSIEMVRFVNSGTEACMSVLRLMRAFTGRDKIIKFEGCYHGHADMFLVKAGSGVATLGLPDSPGVPKNTTANTLTAPYNDLEAVKALFAENPDQIAGVILEPVVGNSGFVVPDGGFLAGLRELTQENGALLVFDEVMTGFRISYGGAQAKFGVTPDLTTLGKVIGGGLPVGAYGGRQDIMSMVAPAGPMYQAGTLSGNPLAMTAGIKTLELLQKPGTYQQLEQITQQLSEGLIKIGKDAGHSVCGGYVGAMFGLFFTEGPVKSYDDAKKSDTAKFGRFHRGMLEKGIYLAPSQFEAGFTSLAHTSEDIDKTLAAAKEVFADL

SEQ ID NO: 8463 - protein, 375 aa, Methanococcus maripaludis S2
MIAERCLGTEQSEIRKIFNMATENSINLGIGEPDFDTPKNIVEAAKLALDAGKTHYVPNAGILELTSAISEKLKKDNNLDISQKNIVTTCGASEALMLSLFTLVNRGEEVLVPDPGFVSYKGLTELCEGKMVPIDLDDKFRIDLESVKNSITDKTKCIVLNSPSNPTGSVMTKEELKGICEIADEKNICVISDEIYEKIIYGKKHYSAMEFTDNCILINGFSKAYSMTGWRVGYLAVNENFDNKYQILENMMKIHQYGFACATSFAQFGAVEALKGDQNCVSEMVSEFERRRDLIYSGMKDIFSVQKPEGAFYIFPDVSEYGNGMDVATKLIQNRILCVPGSAFGKNGENSVRFSYATKYEDIKRALEIMKNVLL

SEQ ID NO: 8464 - protein, 1396 aa, Cryptococcus neoformans var. neoformans B-3501A
MEECLGENDQQRRSSEPLPDRESVQPSSNCNIVEDLELVPIQHTDIPPVTPSQINNPSTLVKLEEQERLHRENEDWRKNALLNLPPPLPYDLVVEKLTIGVPNRKALRWVPSLFKVFAKRKEKDEEEPGKPKKKWILQDVNCECQNGEVLAILGGSGSGKTTLLNAIANRVSGLPTANGEVAYFSVEPHAGVRRGIKLEKGQMKKRIGFVRQQDFLVECLTVRETLTYAAKLRLPNHLSDEAISFIVEQTIDELGLRDAADTVVGGPLRKGISGGEKRRLSIGCALVTLPSVLILDEPTSGLDAFTSYLLLLTLSQLARRGRTIILSIHAPRSDAFEIFDRIALLSKGEIVYSGLRKDCLAWFYSLGHEVERGVNPLDFLIDVSSVDNRTPENEEASIARVRSLVQAWNNRSPAHWADNLEKASMRSSTSFISIDNLSPQGNNSDEVSSNGVGGDDASRDIGARDEQRPGLWKQTRVLTARAHRNVYRNVPQLVGFAIQAVLLGVIIGVTYYQLPETPTGIQSLKNLSFQLIPGVFYLQQVFWIYKFCTDLVIFDREREDRLYDVIPYVLSDFISYLVPSILSPTIYVVLVYFISKLRTDELAANLFISIASTILVQFTTQGLALLSVLFGGIHAGKLTEFISNYELRVYIVGRVPTFHRWRFAQLDFSRTNVPVYVAWIRWISPYFYSFLLGIIATTQFKDRVFDCPAESNANLNQCRGNNVLNGLNFDYTINIGVWFGGLIGLAIIEYALACVVLWGLPAGGVKHASEIDSHHRGKETDVRESHITRDKIDVSVRNLSLMWKRRGRGPLKDREKIILNDLSLDFPAGEVSAILGPSGAGKSTLLQLIAGRQLNPGPLSHYTISGTLLFANKPVSRTTQSNVAFVEQDDDWHLPSLTVRETLTYAAILRLPVKMPKKQKVARAETVLRMLGLKDCADLPIGGALLKGISGGEKRRLSLAVQMINDPAVLVVDEPTSGLDASIALGVMHVLRDIAATGRTVIATIHQPRSDIWKLTDNVTLLAKGGTIAYTGKRSDAVQYFASINHAMPSEFFNPADHLLDLVSIDPRVSYHHQSLTRVNGLTSQWRIRSVGQENGDEQDKNGADSAIIKHGEGTTPMKIALPVVLERHWKNLWRRKDVFFNRLAQTPLLGALFILFFQRLTYGPAGAQDRIGVTIESTSAIAFVGLLNAMSIFPADRNLYLHEAKSSARYSPATFMITYSLVEVGFELLGGFGYGAIMNVAIGMQTSARIYFEYSISIWAMVNMGESFAMIFGSWIQTEGLTVTVVSTFLSLIGQVSGVISLSVPAWLAAIAWGTCVKAATRIQIINEAVGLEFHCTNEEISSGACVAQSGEQLLALFNWHDLDTGKFVGVMIAVCIAWRIMAWASLAARVGGIR

SEQ ID NO: 8465 - protein, 404 aa, Oryza sativa (japonica cultivar-group)
MNLTESKMRRSKSNQAAGESTALDPDAASVVGADGAPDSTVVACGALRASALGAGFPTMYPPGGFLNYLQSNKISPFTQTHPFVNYHNASQLPENFHFVGAPMSYSTMSPTTPCSKAIPSPTGRCAAAQIGSQDKETIDIEDDDTIEPARSDARSEKRLNWSNEEDIRLASAWLHNSIDPINGNDKKSYQYWLDVTATYNSTTKSNRMRNRNQLKQRWERIKKPVSEFNGCYARITKIHQSGMSEDQKMDQAFQLYASEHNDKPFTMVHVWRILRHEKKWSTYLKKINKEKYKSITSNPTHVVNVEDAPKLRPIRHKKAKDERSGKRLASEAISVIDQKLDKFIEASSKAEKIGEVQQSLANKKLEVANLNHKAAQEQTKSKMIDLYKDLLLAPTSDLRESSIL

SEQ ID NO: 8466 - protein, 887 aa, marine gamma proteobacterium HTCC2143
MSQDCTVKTTCPYCGVGCGVDVIVDDNQIIAVSGDQQHPANFGKLCVKGSALHETMGQHGRLLQPQINGMTVDWPTAIETVAEKLLSIREQYGPNSIAFYLSGQLLTEDYYVANKLAKGFIGTSHVDTNSRLCMSSAVASYKRAFGADAVPCNYEDLEQCDLLVLVGSNAAWTHPVLYRRMAVAKENNPQLKIVVIDPRRTATCDLADLHLDLEPGADSFIFTGLLHYLADNKYTDTDYIADHTEGFADAVDSAEVATLAFVAAKANLEVEDLTTFYQWFASTEKAMTFYSQGINQSSTGTDKCNAIINCHLATGKLGKVGAGPFSITGQPNAMGGREVGGLANMLAAHMDYTPDNIATVSEFWNSTAVSQQVGLKAVDLFDAVADGQIKAVWIIGTNPVVSMPNADRVKAALENCDTVIVSDCIAETDTTATANILLPATGWGEKSGTVTNSERRISRQRSLLTAAGEAKHDWWILSQVGQAMGYGQAFSYSSPRDIFVEHAALSGYENSHEHKRLFNISALSHLSEPDYDQLQPIQWPVTAAKPEGTPRLFSDGLFATPSGKAQFITSVSKLPKQQLSADYPLALNTGRLRDQWHTMTRTGRASRLLDHTDQPFVAVHPATAAHYDLTDGDLAAVKTAHGTIEVVVQFDSNLKRDQLFVPIHWNQQFASNARVGTVIAPITDAVSGQPEFKFSAAALCKISATGNAVLVSRNRLMCDSFSNWSVSPLDNNQGYLYRVVVQEAFNWQEFIATKRLLERGPAQAYEHYSNVSCADHRFICYSDQQIELAIFSHVDKRQLPGRVWLQQIFSQTVKGDYWSLIAASDQADPGKQICACFNISEQRIIQAIEEGASSAVELGRQLKCGTNCGSCIPELNNLLSQTEHAID

SEQ ID NO: 8467 - protein, 411 aa, Methanococcus maripaludis S2
MDAIILCAGKGTRLHPITESRPKPMIPIAGKPIIEHIIEKIENHVEKIYLIVGYQKEKIIDYFKDNPKIEYILQEKQLGTGHAVLTAKNFIKGDFLVLNGDVIFEDSIDEILNYENAVSLSNVDNPENFGVIELGYDNKIINLLEKPKKEEITSNLINAGIYKLQNSVFGILENLAPSERGEIELTDALKKLIENGKLHGVELKGYWNDIGHPWDVLSANNHFLNKIISKVSGKIENTVSITGNVIIEEGAVIKPNSVIEGPAIIKSGSIVGPLAYVRPNTVLMKNTFVGNSSEIKGSIIFENTKIPHLSYVGDSIIGANCNFGCNTITANLRFDDKPVIVNIKGKPVKSVRKLGAIIGDCVKTGIQVSFMPGVKIGSNSLIGANCLIDRDIEQESFVYKKDELVITKKRN

SEQ ID NO: 8468 - protein, 242 aa, Rhodobacter sphaeroides 2.4.1
MEPPLQTRRSADLLRRLPILVILLVAAGGAVLLHDRLSFEALAQHREALLAFRDAHYGASVLAFLAAYVAVVTFSLPGSLLCTLTGGFLFGLFPGVLYNVAAASVGAVLLFLAARAGFGARLSQRIEAQGGAVARLQAGIRESEWSVLFLMRLVPVVPFFVANLLPAFLNVPLHRFAVTTVLGILPGALVYTSVGTGLGAVLARGEAPDLGIIFTPQVLGPLLGLAALSALPIVLKLARKGR

SEQ ID NO: 8469 - protein, 381 aa, Schisandra plena
PADVPVTAAGALKSYKLAAKAIARLQSLPSGNIGLLCDVLVREVSELTGYDRVMAYKFHEDEHGEVIAEYRRSDLEPYLGLHYPATDIPQASRFLFMKNKVRMICDCYAPPVEVIQDKKLAQPLSLGGSTLRAPHGCHAQYMANMGSIASLVMSVTINEDYDEPSSKQQNQQKGRKLWGLVVCHHTSPRFVPFPLRYACEFLLQVCGVQLNKEIELAAQMKEKHILKTQTLLCDMLLRDAPIGIVTQSPNVMDLVKCDGAALYYRKQIWLLGTTPTEAQIQDIAGWLLDCHDSTTGLSTDSLMEAGYLGATSLGDAVCGMAAVKITSKDFLFWFRSHTAKEIKWGGAKHIPVDKDDGKKMHPRSSFKAFLEVVTRRSLPWE

SEQ ID NO: 8470 - protein, 431 aa, Synechococcus sp. CC9605
MKRVLAIILGGGAGTRLYPLTKMRAKPAVPLAGKYRLIDIPISNCINSDINKMYVMTQFNSASLNRHLSQTYNLSNSFGGGFVEVLAAQQTPDSPTWFEGTADAVRKYQWLFQEWDVDEYLILSGDQLYRMDYSLFIGHHRRSGADLTVAALPVDPKQAEAFGLMRTDENGSIKEFREKPKGDSLLEMSVDTSRFGLSVESAKERPYLASMGIYVFSRQTLFDLLDKHPGHKDFGKEIIPEALARGDKLQSYVFDDYWEDIGTIGAFYEANLALTQQPTPPFSFYDEKFPIYTRPRYLPPSKLVDAQITNSIVGEGSILKSCSIHHCVLGVRSRIESDCVLQDTLVMGADFFESPDERAVLKERGGIPLGVGKGTTVKRAILDKNTRIGSGVSIINKDNVEEADRSDQGFYIRNGIVVVQKNATIADGTVI

SEQ ID NO: 8471 - protein, 380 aa, Trithuria submersa
PVTAAGALKSYKLAAKAISRLQTVPSGNINLLCDVLVHEVRHLTGYDRVMVYKFHEDEHGEVIAENKRMGLEPYIGLHYPATDIPQVSRFLFLKNKVRMICDCNAKPVKVIQDERLEKLLSLCGSTLRSPHGCHAQYMANMGSIASLVMSVTINENEEEIVNGQKRKGRKLWGLVVCHRTSPSFVPFPLRHACEFLIQVFSVQLNKEVELAAQLREKHILRTQAVLCEMLLRDAPAGIVTQSPNIMDLIKCDGAGVYYGKQFWSVGIAPTEVQVADIIEWLLECHSSSTGLSTDSLFEAGYPGAAALGDPVCGMAAVKITTRDFLFWFRSNSAKEIKWGGAKHNPVDDSKKMHPRSSFSSFLEVVKHRSLPWDDVEMDAI

SEQ ID NO: 8472 - protein, 302 aa, Pseudomonas syringae pv. syringae B728a
MQDLLNEILDEVRPLLGQGKVADYIPALGEVRPDQLGIAVYGNDGQVFSAGDAETAFSIQSISKVFSLVQAINHSGEEIWQRLGHEPSGQPFNSLVQLEFEQGRPRNPFINAGALVICDINQARFAAPSLSMRDFVRRLCGNRAITSDSKVADSEYQHRSRNAAAAYLMKSFDNFHGDVEDVLRSYFHHCALSMNCIDLAKAFGFLAHQGFCAHSGEQVLTARQATQVNSIMATSGLYDEAGNFAYRVGLPGKSGVGGGIVAIVPERASVCVWSPELNAAGNSLVGMAALEKLSARVDWSVF

SEQ ID NO: 8473 - protein, 364 aa, Synechococcus sp. WH 7805
MSKDTAVGTEVRTNSQSAQIGAHAERLSSLVTAQRATVNRATGLELYRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKEHHLLGGFAFIGEGIPVALGSAFTSRYKRDALGDSSSNAVTAAFFGDGTCNNGQFFECLNMAQLWKLPILFVVENNKWAIGMAHDRATSDPEIWRKASSFGMAGEEVDGMDVLAVRAAAQRAVERARAGEGPTVLECLTYRFRGHSLADPDELRAEEEKQFWAKRDPLKALERELLEANLVTAEELRAIEKEIDAEVQDCVDFALSAPEPDGSELTRYIWADD

SEQ ID NO: 8474 - protein, 427 aa, Candida glabrata CBS 138
MYKRYFSTSLKTNQQALKKILEEKTYQVTTYARPSDLCITRGLNAKLFDDFNNKEYIDFTAGIAVTALGHANPKVAEILQTQATKLVHSSNLYFTKECLDLSEKLIEKTKKFGGQHDASKVFLCNSGTEANEAALKFAKKHGITKNPKKQGIIAFENSFHGRTMGALSVTWNKKYRTPFGDLVPHVSFLNINDELSKIKDFINTKKDEIAGLIIEPIQGEGGIFPIPIEKLVALKEICQKNDIIVIYDEIQCGLGRTGNLWAHAALPKAAHPDIFTSAKALGNGFPIAATVVNEKVNNALQVGDHGTTYGGNPLGCAVSNYVLDVIGDQAFLDSVTKKGELLKKGLLKIKEQHPDKISDVRGSGLIWGVEFKDAPGAIVQKARELGLLVITAGKTTVRFVPSLTIEDEVVEEGLTIFNKAVNDVFSK

SEQ ID NO: 8475 - protein, 520 aa, Synechococcus sp. WH 7805
MHWPAVDADHLLVRSDQMLELEQQWLSSGLPVAALMETVGQRMAEWCLQRPDRLAQGVLVLVGPGHNGGDGLVLGRKLLEKGIAVRLWAPLPLRQALTHEHWRHLLWLGVPVQEFEPDPADPSLWIDALFGLGQTRPLPDQVTQLLQQRQLSAPGQLISLDCPAGLDSDSGTPLGTAVAVASDTLTVALIKRGLVQDAALPFAGKVHRIDPGVPPRLMASLTSPLVFQVGASDLKTLPVPAEKSTAMKYERGRLLLIAGSERYRGAAHLAVRGALASGAGSVRAALPKVVDQQLWQWAPEVVSEPALESDDSGSLLWGAALERSDLSRLDALLLGPGLGLMEGVWRGWAEPLQTFRGLLVLDADALNQLSGDVEGWRWFLKRMGPTWITPHPQEFERLFPFCDQGSPLERAAAAAERSGVVVLLKGAHSVIADPSGSVRQLVGTDCQVARTGLGDLLAGLAGGWGARLQAAASPADGAALAAAGLLHAQAACGCSRSSGALTIADQLTQLVRSVTRMSDE

SEQ ID NO: 8476 - protein, 520 aa, Ustilago maydis 521
MTASVSSNQTSLSRRSSHNRHSRISSGSSSASSGSSRPRSSRGRSTSPINPTKQEAAVQMAAKRASVSSVGSTISSSYSTLTADSKVADTTAATSTVSASASSNKVPAGLRAMLFEEEYQEEAIEHMHHMELQTVAAVELMDVQPELKWFMRPYLVDFLIEIHQTFRLRPETLFLTMNIVDRYVSKRIVYKRHYQLVGCAALLIAAKFEDAKDRVPTVKELSQMCCNAYDESAFAQMEGHVLSTIGWTLGHPTAEAWLRIESVRGGEDLKTVNLARFFLEVSLFHRDFISLKSSALTTGALILARFICGLPQSTQLSLNAEAAKAAHMLDAYVWENLQDLSLILIKKYSYAYFSSASTVACEWYRARVAAAKSSPPSGLLPAQALTRNAGAVAQEVDDDDSMCSQPTTPASSVQSTPSRSMDEDEDEDEEDDMPVTPLSLYSLHDPLVAAANAAGLPVPMPSSRASAQDKERRLSSSSASTEKPMPSSKSASTHLTVQQPMLGARKPLGNVVWNVNVQQF

SEQ ID NO: 8477 - protein, 577 aa, Streptococcus bovis
MTEMLKGIAASDGVAVAKAYLLVQPDLSFETVTVEDTSAEEARLDAALKASQDELSIIREKAVETLGEEAAAVFDAHLMVLADPEMISQIKETIRAKQTNAEAGLKEVTDMFITIFEGMEDNPYMQERAADIRDVAKRVLAHLLGAKLPNPATIDEESIVIAHDLTPSDTAQLNKQFVKAFVTNIGGRTSHSAIMARTLEIAAVLGTNDITSRVKDGDIVAVNGITGEVIINPTDEQVAEFKAAGEAYAKQKAEWALLKDAKTVTADGKHFELAANIGTPKDVEGVNANGAEAVGLYRTEFLYMDSQDFPTEDEQYEAYKAVLEGMNGKPVVVRTMDIGGDKELPYLDLPKEMNPFLGFRALRISISETGNAMFRTQIRALLRASVHGQLRIMFPMVALLKEFRAAKAIFDEEKANLKAEGVAVSDDIQVGIMIEIPAAAMLADQFAKEVDFFSIGTNDLIQYTMAADRMNEQVSYLYQPYNPSILRLINNVIKAAHAEGKWVGMCGEMAGDQKAVPLLVEMGLDEFSMSATSILRTRSLMKKLDTAKMQEYANRALTECSTMEEVLELSKEYVNVD

SEQ ID NO: 8478 - protein, 366 aa, Pseudomonas aeruginosa PAO1
MSKMMKAAVFIQPGRIELVDKPIPDVGPNDALVRITTTTLCGTDVHILKGEYPVAPGLTVGHEPVGIIEKLGSAVVGYREGQRVIAGAICPNFNSYAAQDGVPSQDGSYLVESGRCACHGYKATAGWRFGNLIDGTQAEYVLVPDAQANLAPIPDGLSDEQVLMCPDIMSTGFKGAENANIRIGDSVAIFAQGPIGLCATAGARLLGASTIIAIDGNAHRLDIARGMGADVTLNFRECDVIEEILKLTGGRGVDASIEALGTQSTFETALRVLKPGGTLSSLGVYSEDLTIPLSAFAAGLGDHRINTALCPGGKERMRRLLNIVASGRVNLGPLVSHEYRLDDIVAAYDLFANQRDNVLKVAIKPH

SEQ ID NO: 8479 - protein, 579 aa, Podospora anserina
MSGYGGYDGGLRSSGSMKQSERSRWTPLTRMLLSGEMTQERQKELTPREKFDKWMVNEGYRRIFVFVFMFLHAILFAFSFVNFAVKENLQIARDTFGPTFMIARSAALVLHVDVALILFPVCRTLISMARQTPLNGIIQFDKNITFHITTAWSIVFWSWVHTIAHWNNFAQVAAKNNLGIYGWLLANFVSGPGWTGYVMLIALMGMVITSVEKTRRANYERFWYTHHMFIVFFFFWSIHGAFCMIQPDFAPFCISIGTQAIGVFWQYWMYGGFAYLAERVAREIRGRHKTYISKVIQHPSNVCEIQIKKEHTKTRAGQYIFFCCPAVSLWQYHPFTLTSAPEEDYISIHMRVVGDFTRAVAETLGCEFDKKKGDASKVVGVDQSNDEVDPALRRVLPRVYIDGPFGSASEDVFKYEISVLCGAGIGVTPFASILKSIWYRMNYPQKRTRLSKVYFFWICRDFGSFEWFRSLLLAIEAQDVDNRIEIHTYLTAKIKVDDATNIMINDANADKDTITGLRSPTNFGRPNWDMIFRGIRKLHTPAEAGVFFCGPKGLGSQLHVFCNKYSEPGFNFVWGKENF

SEQ ID NO: 8480 - protein, 213 aa, Agrobacterium tumefaciens str. C58
MKDFPETLLNGYKNFMSGRYVDERERYRVLADTGQKPQTLFIACCDSRSAPETIFDCGPGELFVVRNVANMVPPFEPDGQYHATSAAIEYAVQVLKVKDIVVMGHGRCGGIQAALDPNLEPLSPGDFIGKWMNMVKSAAEQIQSNDVMTASERQTALERVSIRNSIANLRGFPFVKAQETAGKVKLHGAWFDISTGELWVMDSKTGDFRRPDL

SEQ ID NO: 8481 - protein, 154 aa, Triticum aestivum
  misc_feature (58)..(58): Xaa can be any naturally occurring amino acid
  misc_feature (71)..(71): Xaa can be any naturally occurring amino acid
  misc_feature (100)..(100): Xaa can be any naturally occurring amino acid
  misc_feature (123)..(123): Xaa can be any naturally occurring amino acid
  misc_feature (127)..(128): Xaa can be any naturally occurring amino acid
  misc_feature (134)..(134): Xaa can be any naturally occurring amino acid
MAPTVMASSATSVAPFQGLKSTAGLPVSRRSNGASLGSVSNGGRIRCMQVWPIEGIKXFETLSYLPPLSTXASSSSPTTWIRSKWGALPPIQQVGFIFRXHNASPGYYDGRYWDMLKLPISGXTGPXXVINKWXESRRIPDPTPHNRFNIASWV

SEQ ID NO: 8482 - protein, 111 aa, Crocosphaera watsonii WH 8501
MKRLLCKILLIFAFFCLSFASPALAGDAGAGKGIFTANCNACHMGGGNVVAGPSKGLAKNYLEKNGVDTLEKIVYQVTNGKNAMPAFGGRLDAQKIEDVATYVLSQAEAGW

SEQ ID NO: 8483 - protein, 487 aa, uncultured bacterium 561
MNIELTNPTLFRTEAYVNGEWIGADNGARLPVTNPATGALITDVAKTGAAETRRAIAAAETAMLSWRQKPAKQRAQVMRRWFDLIMANQEDLARIMTLEQGKTLAESRGEVAYGASYIEWFAEQAKRIDGDVIPAPSGDKRIICIKQPVGVCAAITPWNFPNAMITRKAAPALAAGCTIVIKPASETPLSALALAELAHQAGIPPGVLNVLAGSSSDIGAELTSNPTVRKLSFTGSTPIGKMLEAQCVPTLKKTSMELGGNAPFIVFDDADIDSAVQGALISKYRNSGQTCVCSNRLLVQAGIAEEFTAKLVAATESLKLGNGLDENVDLGPLVNAKAVNDVHELVQGSISAGAKLVLGGAPSNLGVCFYQPTILTGVRPEMPVFRNEIFGPVAPIISFETEAEAIELANDTEFGLASYFYTRDIGRVWRVAEALEYGIVGINEGIISNEMAPFGGVKESGSGREGSKYGIDDYLEIKYMLMGGLNQ

SEQ ID NO: 8484 - protein, 281 aa, Triticum aestivum
  misc_feature (110)..(110): Xaa can be any naturally occurring amino acid
  misc_feature (208)..(208): Xaa can be any naturally occurring amino acid
MAVDYGSREERWSLAGTTALVTGGSKGIGHAIVEELAGFGARVHTCSRNGAELEECRRRWEEKNLQVNASVCDVSIRADREKLMETVRETFNGKLDILCRLWGRYRPCLXGVLMVEVNNAGQLLFKPTTECTVKEYSNLLTTNLESSFHLSQLAHPLLIHASIAGGGSIINMSSIGGSIGYAGSAIYATTKGAMNQLIRSLATEWGSXKIRVNGIAPGFVTTDMLKDIDTEYMKKEHLKTPLGRSGKPVEIATAVSFLCMPAASFITGQVICIDGGRTISS

SEQ ID NO: 8485 - protein, 454 aa, uncultured bacterium 561
MLLGQAMTAMIYPTTNPAATEVMVVSRGEGPYIYDQAGKQYLEGMAGLWCTSLGYGNQEIIETATRQMEQLSFSHMFSGKTHPSAIELADKLAAMAPIDDARVFLGASGSDANDTLVKLIRYYAVASGQPDRVKIIARDKGYHGVSVASAALTGLHANHAHFQLPFDALGVLRTGAPHYYRCAEAGETEADFVARRASELEALILDEGPDTIAAMIAEPVNGAGGVIIPPEGYFEAVQAVLDKYGIMLWDDEVICGFGRLGAAFGAEKLNMKPRMMACAKALTSAYVPLSAAIVAGDIADAIAGPAADMGVFGHGYTYSGHPLGCAVASKVLDIYVRDRLFEHAATLGAYMSKRLDEFSDHPLVGEVSAMGLLGALELVANKDSKQPFEGMRVAQFCAKAAEDNGLIIRPLGGNRMALCPPLIIQEAHVDEIMDKLSRALDSTLDFVTAEGLTV

SEQ ID NO: 8486 - protein, 216 aa, Aspergillus oryzae
MPEHEEDLVASKTEGFKVGEKKTINEYTELAAPRASVTVCFLPPCTHISHKNDESLNRWKASLGLATGATIGDPSDPRKCIIKSLALEVEGRPDVVIDVSAPGAVDTLKDKPFTIKEGAHFRIKVVFQVHHEVLSGLKYLQVVKRKGVRVSKDEEMLGSYAPNTTDKPVYEKKFQEEEAPSGFIARGHYNAVSKFVDDDDHTHLQFEWSFDIAKDW

SEQ ID NO: 8487 - protein, 421 aa, Streptococcus mutans UA159
MSQELKLDVQERPRFGMLLGLSFQHLFAMFGSTVLVPILVGIDPAVALLSCGLGTLVHLSVTKYKIPAYMGSSFAYIGAMQTLMKTDGIAAVAQGAITGGLVYFIVALVIKWIGNSWIDKILPPVVVGPIVMVIGLSLAGSAVSDVMTKDGHYHLTYVFIGLITLFAVVLFNVYGKGMFGLMPILFGLIFGYLFAVAVGILTGQEIVSFSGVSKASWIQIPTIHLPILNDGFKLYPSAILTMAPIAFVTMTEHFGHIMVLNSLTGRDFFKKPGLDKTLTGDGLAQVVAGILGAPPVTSYGENIGVMALNKIFSVYVIAGAAFLAVLMSFIGKISALLQSIPTPVIGGISIALFGVIASSGLKILIENKTDFDNKKNLLIASIILVSGIGGLTLQIQSLQITGVAFSTLLGIILYQILPEKD

SEQ ID NO: 8488 - protein, 1059 aa, Streptococcus mutans UA159
MPKRTDIKKIMVIGSGPIIIGQAAEFDYAGTQACLALKEEGYSVVLVNSNPATIMTDKEIADKVYIEPITIEFVTRILRKERPDAILPTLGGQTGLNMAMELSRAGILDELGVELLGTKLSAIDQAEDRDLFKQLMEDLEQPIPESDIVNSVDEAVAFAAKIGYPVIVRPAFTLGGTGGGMCADEKELREIAENGLKLSPVTQCLIERSIAGFKEIEYEVMRDSADNALVVCNMENFDPVGIHTGDSIVFAPTQTLSDIENQMLRDASLKIIRALKIEGGCNVQLALDPHSFKYYVIEVNPRVSRSSALASKATGYPIAKLAAKIAVGLTLDEMINPVTGTTYAMFEPALDYVVAKIPRFPFDKFEHGERRLGTQMKATGEVMAIGRNIEESLLKACRSLEIGVYHNEMPELTNVSDDALVAKIVKAQDDRLFYLSEAIRRGYSIEELSDLTKIDLFFLDKLLHIFEIETELAAKVGDIAILKEAKHNGFADRKIADIWQMTADAVRKLRLDNKIIPVYKMVDTCAAEFESATPYFYSTYEWENESIKSEKESVIVLGSGPIRIGQGVEFDYATVHSVKAIQNAGYEAIIMNSNPETVSTDFSVSDKLYFEPLTFEDVMNVIELEQPKGVIVQFGGQTAINLAEPLSHAGVTILGTQVADLDRAEDRDLFEQALKDLNIPQPPGQTATNEEEAVASARKIGFPVLVRPSYVLGGRAMEIVESENDLRSYMRTAVKASPDHPVLVDSYLVGSECEVDAISDGKDVLIPGIMEHIERAGVHSGDSMAVYPPQTLSKEVQATIADYTKRLAIGLNCIGMMNIQFVIKDETVYVIEVNPRASRTVPFLSKVTDIPMAQIATKLILGSSLTELGYKDGLYPESQNVHVKAPVFSFTKLAKVDSLLGPEMKSTGEVMGTDSTLEKALYKAFEASYFHLPAFGNVIFTIADDTKEEALALARRFSNIGYSILATEGTAKFFAENNLEAVLVNKLGEDDDNDIPAYVRSGKVQAIINTVGNKRTFDEDGAAIRSSAIEHGVPLFTALDTADAMVRVLESRGFITQAI

SEQ ID NO: 8489 - protein, 201 aa, Synechococcus sp. WH 7805
MRDILISSAVCVACLVVALVSQIVSPSTVIAAPPSPTVQASAAQTADVQASAAMELDPDETNPTLFAMAPDSNQADASALGGAMSAEKPEITASGLRITNLVVGTGAEATSGQTVVVHYRGTLEDGSQFDASYDRGTPFSFPLGAGRVIKGWDEGVQGMKVGGKRKLVIPPDLGYGARGAGGVIPPNATLIFEVELLEVKG

SEQ ID NO: 8490 - protein, 439 aa, Pseudomonas syringae pv. syringae B728a
MTYKLPTTATAPFCPSATTDSVAIPPNASLLRKMTLFVGPGLLVSIGYMDPGNWATAIEAGSRFGYSLLFVVVLASLSGMVLQNLCSRLGIATGRDLAQLSAARYSRKVAKGQWLLAELSIIATDLAEVLGAALAFHLLLGVSITTGVALTAFDTLIVLALQGANFRRLEAIVLGLIATIASCFAVELFLIKPFWPDVVAGLKPSWDVLSSQEPLYIAIGILGATVMPHNLYLHSSVVQTRVNGSDQASKASAIRYARLDTIGSLSLALLINAAILILAAAAFHKTGHTEVVEIQDAYHLLDPLVGGAIASVLFGIALLAAGQSSTFTGTIAGQVVLEGFLQAKIPCWQRRLITRALALIPALIGVIWLGDSSVGQMLVLSQVVLSLQLPFALWPLIRFTSDPQLMGPFVNSRLVKTAAWGLFGLISAANLTLLWFWIS

SEQ ID NO: 8491 - protein, 355 aa, Arabidopsis thaliana
MADNTDNRRSLWGVPEKLQLHIAMLTLQFGYAGFHVVSRAALNMGISKLVFPVYRNIIALLLLLPFAYFLEKKERPAITLNFLIQFFFLALIGEPRILLVGTGQHFTNICFLHAKLSLCVAGASVITLYKGPTIYTPASHLHAHLLTTNSAVLAPLGNAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRNSIKSSITTPLLHQSTDNV

SEQ ID NO: 8492 - protein, 610 aa, Gibberella zeae PH-1
MATPSITLDRILAAAPVTTRGQPTQISVDTKGQRIAYPCGKSIFVRSIDDPSDAKEYTGHTAPTTVARFAPSGFKVASGDSSGMLKVWEPESIDGTRGEYAIISGRLNDIAWDGESQRVIAVGDGREQFGRCITADSGNSVGEIIGHSKSVNAVAMKPQRPFRAATVGDDGNMVFYHGAPYKFNNKSAQHTGFVLGAAYSPDGNTLVTVGADKRIQLYDGKTGEPTKEIGQGEHTGSIFAVSWSQDGKKFVTASADQTVKLWDFDAGNIIQSWKFGEDATVGDQQVGVVFVPGRSDGLIISLSLDGRLTYLTEGKQEPVRVVYGHNRGITALSTASDGKGADLWSGSFDGRVCHWDIKSGIATVVDGQSHTNQVAQFAVADGKAFSAGWDDNLRIVDESAKTFLRSSTKLQAQPKGVSAANGLVYVATYSGVSVYSGEKLVSEQSLDYTPGAIAASGSFVAVGANENSVRIYSAGSDGKLQEVKALSNPTGTISALAFSKDGSHLAAGNSVGKIYVYSVGSWELVADRWSAHTARVTSIAWDDTGAYAASGSLDTNVFIWCLEKKNQGKRIKAANAHKDGVNGVAWIEGGKIASAGGDASVKIWSVQNLP

SEQ ID NO: 8493 - protein, 223 aa, Glycine max
  misc_feature (54)..(54): Xaa can be any naturally occurring amino acid
LWRKQVETKENINKVSLLLPLGTIIRLGNQFNQPVQIGSINNLYESVQNLSPDXFLEMLLSPRNPLEASYQRLKVKVDDTEPTKYFICHSCSKGSDLLLSSFDGARCSCRKLMQKKMELLEESKDEASVVDGIFVKGDAMFLIFDDLTVLRSSPSDSVQRPLQLGHKNFSSKLEEKYSDVGTKEVILLYIHFRWYLHELFGLKEGKGVVKRINSSQYCLARKG

SEQ ID NO: 8494 - protein, 470 aa, Haemophilus influenzae 86-028NP
MSNAIASVFKLIEENDIRFVLLRFTDIKGKEHGVSIPVSLVDEDMFEDGKMFDGSSVEGWKTINKADMLLMPIAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKYVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 8495 - protein, 248 aa, Oryza sativa (japonica cultivar-group)
MVKLAFGSLGDSFSATSVKAYVAEFIATLLFVFAGVGSAIAYGQLTNGGALDPAGLVAIAIAHALALFVGVSVAANISGGHLNPAVTFGLAVGGHITILTGLFYWIAQLLGASIACLLLKFVTHGKAIPTHGVAGISELEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIGSYQPVADQDYA

SEQ ID NO: 8496 - protein, 214 aa, Schizosaccharomyces pombe 972h-
MCQEDEYDYLFKTVLIGDSGVGKSNLLMRFTRNEFNIESKSTIGVEFATRNIVLDNKKIKAQIWDTAGQERYRAITSAYYRGAVGALIVYDITKQSSFDNVGRWLKELREHADSNIVIMLVGNKTDLLHLRAVSTEEAQAFAAENNLSFIETSAMDASNVEEAFQTVLTEIFRIVSNRSLEAGDDGVHPTAGQTLNIAPTMNDLNKKKSSSQCC

SEQ ID NO: 8497 - protein, 213 aa, Oryza sativa (indica cultivar-group)
MESAGPKENGHTTGGAAAEAKAAAAWAEIAVTDAAAVPKPPPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLEVFSPFAHSQHAILLACNSEALDCAL

SEQ ID NO: 8498 - protein, 329 aa, Haemophilus influenzae 86-028NP
MKKQDLMSIDEIQKLADPDMQKVNQNILAQLNSDVPLIGQLGFYIVQGGGKRIRPLIAVLAARSLGFEGSNSITCATFVEFIHTASLLHDDVVDESDMRRGRATANAEFGNAASVLVGDFIYTRAFQLVAQLESLKILSIMADATNVLAEGEVQQLMNVNDPETSEANYMRVIYSKTARLFEVAGQAAAIVAGGTEAQEKALQDYGRYLGTAFQLVDDVLDYSANAQALGKNVGDDLAEGKPTLPLLHAMRHGNAQQAALIREAIEQGGKREAIDEVLAIMTEHKSLDYAMNRAKEEAQKAVDAIEILPESEYKQALISLAYLSVDRNY

SEQ ID NO: 8499 - protein, 477 aa, uncultured bacterium 561
MREYKQFYIDGEWVAPSAPSDFEVFDPATEEVCATISLGNETDVDKAVAAAKAAFETFSQTSVEERVALLERICEIYQRRLGDIAEAIRLEMGAPIKLASTAQAFAGLGHIAEAAKVLKTYAFTEDLGEHRVVKEPIGVCGLITPWNWPLNQVSCKVAPAIAVGCTMILKPSEIAPLSSYIYAEILHEAGVPAGVFNLVNGDGPTVGTALSVHPDVDMMSFTGSTRAGSLVAQNAAPTVKRVTQELGGKSPNIILEDADLEAAVTRGVLHMYNNTGQSCNAPSRMLVPRDKLAAAEAIAAKVTETMVTIGDTADDKTTMGPVVSKVQWDKIQGLINKGIEEGAKVVCGGAGLPDGIDRGYYVRPTVFSEVNNNMTVAREEIFGPVLTMIPYDSEEEAIKIANDTPYGLAGYVQGENIDHARQVASKIRAGNIHLNGASGGMDVPFGGFKQSGNGREWGSHGFTDYLEIKAIEGYSAA

SEQ ID NO: 8500 - protein, 258 aa, Magnaporthe grisea 70-15
MSAGKLDKSLDEIVSSQRRTAGRRGGAARRSTGRPAPAAPVGGIHKNPRAARSAVQKPAPAKASGAPGTSKVVVSNMPKDVSEAQIKEYFGQSVGPVKRVEISYGPGGVSRGIATVTFAHADGASKAFAELNGLLIDNKPVKVEVVVASADQIPAPKTLSQRVTQNKAQPKSAATDKRGATAGKGAGAGAQANGAKGAKKAAPRKGRNARPAKKTAEELDSEMADYFQGGETNTEAAPNGAAPAATNGGDAAMEDDIL

SEQ ID NO: 8501 - protein, 110 aa, Aspergillus oryzae
MSEGNVVKIESKKDFQEKVIESKDLVVLDCFAEWCGPCKAIAPQLARLSEEYTGAKFYKIDVDDLSEVAGELGVRAMPTFLFFKDGKKVNEVVGANPPALVAGVQSLVKQ

SEQ ID NO: 8502 - protein, 758 aa, Methanococcus maripaludis S2
MKLITWLDDLRNDDVDIAGGKGASLGEMWNAKLPVPPAFVVTSEAYRYFIKETKLQDEIERILSNIDVNNNEELNKASKEVRYAIENVKMPDDLKLSIIESYHKMCELNGDDETFVAVRSSATAEDLPDASFAGQQETFLNMKGNEQVLQAVQECFSSLFTPRAIFYREEKGFDHFEVALAAVVQKMVNADQAGVMFTVNPINQDYNQMVIEGAWGLGEGVVSGTVSPDTYIVAKDTQEVLSVNVARKDTMFIKDADGVTKEIKTPEDLIEKQVLSEEMIKKLENVGQTIENHYKRPMDIEWSIENGEIYMLQARPITTLTDKKDSKSSNEIEGKIILKGIGASPGVESGKVKIISEIEEIGRILDGDILVTKMTTPDMVPAMKKAAAIITDDGGLTCHAAIISRELGTPCVVGTKGATKNLKDEECVTVDGEKGIVYEGKVGKPEEKAPAQVVYAGAPVITATEIKANVSMPEVAERAAATGADGVGLLRAEHMILGTGVHPGKILKEQGEGALTEVFAEGIRKVADAFYPRPVTYRTLDAPTDEFVGLKGGEDEPHEHNPMMGWRGIRRGLDQSEILKCELKAIKKLREEGYRNINVMIPLVTNVDEIRKVKEIANEVGLKLRLDVEFGVMVETPAAALIIDDIIEEGIDFISLGTNDLTQYTIAIDRNNENVSKYYLENHPAVLKLIELVITSCKRAGVKTSICGQAGSRPQIVEKLVEWGITSISANIDAVETIRNVVARTEQKIILESIRKQK

SEQ ID NO: 8503 - protein, 193 aa, Glycine max
MTCPLQLHRFSPATDTSTAIANGVNCPKPAQTAPSTRRLLAKVGLSVTEMVARHHAHAVGPNQCCSFVIQAIDAPVSAVWPVVRRFDNPQAYKHFVKSCHVVSGLPAVSSTERLEILDDERHVMSFSVVGGDHRLRNYRSVTTLHGDGSNGGTVVIESYVVDIPPGNTKEETCVFVDTIVRCNLQSLAQIAET

SEQ ID NO: 8504 - protein, 233 aa, Glycine max
  misc_feature (137)..(137): Xaa can be any naturally occurring amino acid
MEFVDTRKLQLQHQQQLQQQPQHFHVLAVDDSVIDRKLLERLLRGSSCKVTCVDSGDKALKYLGLIDELDDTSSTSLESESSHPPPQPLQREGIKVNLIMTDYCMPGMSGYDLLKRVKGSSWKDVPVVIMSSENVPXRISKCLEEGAQEFLLKPLQLSDLDKLQPYFLKSLDNSCEKESANSSIDSNNDNVINNNSNNSNNNNNNNISKRKAMSPEPHQEERSRPKMKELAVV

SEQ ID NO: 8505 - protein, 516 aa, Schizosaccharomyces pombe 972h-
MRDFQSRFADRYNQITNSYSYSSSRQGLITGMVNVGSFFGCLLSSPVADKIGKRLSIIVWTTVYLIGIIIQVTTVPSWVQILVAKIWTGLSIGALSVITPGYQSEVAPAIMRGAIVTTYQLFITLGIFIAACINMGTHKYSHGTTAQWRISIGINLLWGIITLVGIIFLPESPRYLIAIGKDDEALKIMCYNNDLPLEHEIIQTEYHTIKSDCDAELAGGPARWPEIFNANIRYRTFLGMAVMMFQQLTGANYYFYYGTQVFRGTGMDSPYLAALIPDAVNCGCTFGAIFVLEFFGRRSPLIVGGIWQYICFFIYAAVGDRALYHKNGTSNHRAGAVMIVFSCLFIFSFSQTWAPAAYVIVGESYPVRYRSKCAAVATSANWFWNFLISFFTPFITNSIGFKYGYIFASCNLTGAAIIFLFVHETKGRTLEEINTMYASNLKPWMPHPEGYREFGREQNNATLKSHIGLNGETTELIENTDNQGDSGSFQTSTPDDSRPEQNQASATYIRPDKREP

SEQ ID NO: 8506 - protein, 532 aa, Prochlorococcus marinus str. NATL2A
MAITDIFQMNNNDKWARYCDLLYSDDSLGFWLDISRMDVAINDFEDFNEIYSKAFDALESLENGSIANIDEGRQVGHYWLRNPKVAPSPEISDSITKEIQDISKFGSSILNGEITNSDGEKYTDVFWIGIGGSGLGPLLIKESFKRESIGLDLHFLDNVDPEGISHKLNSILPNLNSTLFVVVSKSGGTPEPLIGMEQAMKFVRDNNQNWSSRAIAITSKGSKLDLLAHNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKKAATKIIKLQKEIEELLDDGKQRTLNEINDALSSDSTESIYLILRKLSENSDHYSMIGNQSNPDKLIISKT

SEQ ID NO: 8507 - protein, 437 aa, uncultured bacterium 561
MDRKTLEAHWMPYTGNRQFKKDPRIITSAEGVWYTDDKGRKVLDGHSGLWTSGLGHGRKEISAAVSQQINTLDFAPSFQFGHPPAFELADRIKGLMPEDLDYVFFTNSGSESADTSLKMARAYWRLMGQPTKTRFVGRMKGYHGVNFGGISVGGIAANRKFFGQGVEADHLRHTMLPQNRFCRGMPQDGAELADELNEMIALHDASTIAAVIVEPMAGSAGVIPPPVGYLQKLRDICDANDILLIFDEVITGFGRCGAMTGADAFGVVPDILNVAKQITNGAIPMGAVIARAGIYDTFMAHGGPDYALEFAHGYTYSAHPVACAAGLAALDVLTGEALPQRVADEAPFFEALLHDALSDKPHVSDVRNYGFAGAITLEPYPGEPLRRPFEVAMKMWEKGFLVRYGGDTIQLAPMFVMERPEMESLVGALADSLQELA

SEQ ID NO: 8508 - protein, 231 aa, Streptococcus pyogenes MGAS8232
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFGDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 8509 - protein, 128 aa, Photobacterium sp. SKA34
MTKVLHTEQAPAAIGPYVQGVDLGNMVLTSGQIPVNPATGEVPEEIAAQARQSLDNVKAVVESSGLQVSDIVKMTVFVKDLNDFAAVNEVYGNFFDEHNAPYPARSCVEVARLPKDVKIEIEAIAVRK

SEQ ID NO: 8510 - protein, 1155 aa, Oryza sativa (japonica cultivar-group)
MASGGGGRADAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSKPFYAILHRIDVGVVIDLEPARTEDPALSIAGAVQSQKLAVRAISRLQALPGGDVKLLCDTVVEYVRELTGYDRVMVYRFHEDEHGEVVAESRRNNLEPYIGLHYPATDIPQASRFLFRQNRVRMIADCHAAPVRVIQDPALTQPLCLVGSTLRSPHGCHAQYMANMGSIASLVMAVIISSGGDDDHNISRGSIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEVQIKDIIEWLTMCHGDSTGLSTDSLADAGYPGAAALGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSSRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVSYLSSFSIPEGNTYSHAGISCVEFGRGQVKYLVKFIFVGHICCSTLGLPVLAKAFPQRLFKTCLVTPAGQPKRVTWDLLMENPVYESSRNQHFVHSDEAHLNFGTASVILGVEVVPPVS

SEQ ID NO: 8511 - protein, 207 aa, Bordetella pertussis Tohama I
MSLLHRASFYISAARLDQLPPAGAPEVCFVGRSNAGKSSAINVLCNQRRLAFSSKTPGRTRLINMFGLPDPLAPGEQLGFLVDLPGYGYASVAHREKEKWADILGGYLRDRASLAGIVLLIDIRRGVTDLDRRLTNFIAPTGRPVLALLTKADKLPYGQRMRTVFAVRKDLADIGALHMVPFSSTERIGLEEAGAHIENWISPKVVP

SEQ ID NO: 8512 - protein, 406 aa, Synechococcus sp. WH 7805
MVEPKADSMSSAVMGTYNRFPLTLVRGRGCWVWDDQNRRHLDAVAGIATCTLGHSDRILRRALSRQLKTLQHVSNLYKIPEQEQLAQWLVVNSCADSVFFCNSGAEANEAAIKLARKHGHRRRGIERPVIITAAASFHGRTLAAVSATGQPRYHQGFEPMVEGFEFFPYNDGDAFEQLLIQLEQNGPRVAAVLIEPLQGEGGVNPGDPAVMQRIRKLCSERDILLIFDEVQVGMGRTGTLWGYQQLGVTPDAITLAKGLGGGHVIGALLVSQHADVFEPGDHASTFGGNPFACRAGLTVANELLRRDLLKNVQTRGKQLHKGLTHLVERYPDHLAGSRGWGLLQGLVLQDNCGFSAADVVKAALEEQLLLVPAGAAVVRMVPPLVIGPREIQTLLTRLDRALQHLM

SEQ ID NO: 8513 - protein, 949 aa, Oryza sativa (japonica cultivar-group)
MAMATGLGGGRPGEAATATPIWGARRRSSGQGYDGSGAGRREAATATMSEEDQALKEQLELYVVRAQDPDPGVQKLALESMRQEIRSATSSMTSVPKPLKFLRPHYGILKAYFETMPESELKKYMADILSVLALTMSAEGERESLKYRMIGSEGDIGSWGHEYVRLYLEITLEFSVFLFPLFVIENKIGFSNNVNVSLARNLAGEIAQEFQKRQDDGMTTDSLKELVEQIVSFHMKHNAEPEAVDLLMEVEKLDLLVKHVDSTNYKRTCLYLTSSSKYLPAPDDMSALKIAFEIYMKFGDFANALRIALLLDDKSLELKQIFTATDDFHLKKQFAFIIARHGLSTDIDDDIAADENEKEALQDIISNIKLSEGYLTLARDIEVMEPKSPEDIYKVHLIDGRGATSSSLDSARQNLAATFVNAFVNAGFGQDKLMTAPSDSSGSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVKILALGLAIPLVRENLTAFLSDSQVPLEVLVFAAISLGLVFVGSCNEEIAQTIICVLMEHSEPELAEPIIRLLPVALGLLYLGKQESVEATAEVSKTFDEKIRNYCDVTLMSLAYAGTGNVLKVQKLLGICSEHLEKGETHQGPAVLGISLISMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILALAMQPRMLLTVDEDLKPLSVPVCVGQAVDVVGQAGRPKTITGFQTHSTPVLLAAGERAELATEKYLPLTPVLEGFVILRNNPEYHED

SEQ ID NO: 8514 - protein, 226 aa, Candida glabrata CBS 138
MKSSYRGYGTSSLDEDANDIEALIKYLKSKEGGARRKIILMGHSTGSQDVLHYILTKNRYGIDAAVLQGSCSDREGFVDDVGENVYTKLNVLPKRLVDEGKGDELLSSEYSKYMGGTPVTAYRWCSLMLKGGDDDYFSSDLDTETIKQTIGKIDIPFLVAYPEIDEFVPKSIDKIALLKRWESCSQTQFWSKNSGLIKGGLHWLPEPETQDYFYVMVTKFIEEFNL

SEQ ID NO: 8515 - protein, 429 aa, Bordetella pertussis Tohama I
MTAVSVQPDLAGSPHFRYQNGVLHAEDVPLDSLAAQLGTPLYVYSRAALRSAWETYRDAIGERPVLVCFGMKTNSNLAVLKEFARLGAGFDIVSGGELARVLAVGGDPAKVVFSGVGKQAWEMRAALEADVKCFNVESEAELERLSDVAVSMGRRARVSLRVNPDVDAQTHPYISTGLKENKFGIAIESAPAAYRLAARLPGVEVVGVDCHIGSQLTDISPYFDALEKLLDLIEQLAENGIAIKHLDLGGGLGIRYTDEIPPSPKALLDRVFERINARGLGHLHIVLEPGRSLAGNAGVLLTTVQYLKHAEARNFAIVDAAMNDLLRPALYEAYHGVQPVTPRADKRIEYDVVGPVCESADWLARGRALAIQAGDVLAVESAGAYSMVMASNYNTRVRAAEVMVDGNRHYIVRQRETLESLYQGESTLP

SEQ ID NO: 8516 - protein, 290 aa, Silicibacter pomeroyi DSS-3
MFKGSMPALVTPFRNGELDLEALKRLVEWQIGEGSTGLVPVGTTGESPTLSHEEHETVVAEVVKAAAGRVPVIAGAGSNNTTEAIRFVQFAQRIGADAALVVTPYYNRPTQRGLIAHFTALHDCAEIPIVIYNIPGRSVVDMTPATMGALAKLPRIVGVKDATGDLARVSQQRASCGADFIQLSGEDATALGFNAHGGVGCISVTANVAPRLCAEFQQATLAGDYAKALDYQDRLMPLHEAIFIEPGLVGAKYALSKLGLCSEEVRSPLTGLEDSTKAAIDAAMKHAGLL

SEQ ID NO: 8517 - protein, 152 aa, Zea mays
MACSTGLCFLASIPPLSASCSSGSSCFLMIKRVSSAPSLSRWTIQYKQLGHTIYRRSHVLAFASADAPQGKRSSGENVVMVDPLEAKRLAAKQMQEIRAKEKLKRRRQAEAINGALAVIGLTAGLLVEAQTGKDILGQLAGYLTAISSLFGQ

SEQ ID NO: 8518 - protein, 267 aa, Arabidopsis thaliana
MESRKTFDSIPDDLFVEIALRLSSKSIARCRCVSKLWASILYRQDFTELFITKSSARPRLLFAVLKASGLIFYSSPQSQNPSLEVDFHNHMKFHEDMNLYMCSYVSGFDPIGKQHKVLCMNKRLNKEWVHYILTLGTENLKWRKMICPLTHEPYYGRALSINGVLYYFARTSCFLVVSFNVRSEKFKFLDGKDFSNFHREFINYKGKLGVTKLECDAGDGHPRELCVWVLEDVEKQEWSQYIYSLPKIKVNRIRNDNIFAMFLPLTI

SEQ ID NO: 8519 - protein, 258 aa, Prochlorococcus marinus str. MIT 9515
MSSQKLFLFDFDGVIVDGMNEYWHSSLLAFDKFLNSPDIYIDKSLYKKVSRTFIEMRPWVKYGWEMLIIVHQIIKKENPLNNTNKTDFLNKYHQNCQKVLLDNSWVAEDLQRSLDAARKYQIDKDFDNWIKLHIPFYEVIDFIEKIKKENIKTGIITTKGKIFAGKIIKKLNIVPELIFGYEAGTKVEIASQLSNKYEIMGFLEDRRNTLIDIKQNTATKNIPCYLADWGYLKNIDKTNLPYEIKLLKLKSLKNLLAI

SEQ ID NO: 8520 - protein, 87 aa, Neisseria meningitidis
VAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 8521 - protein, 461 aa, Arabidopsis thaliana
MISGSMENLDEIRTDIVESTAPLLQESSSESNGGGEFNGASFSGAVFNLATTIIGAGIMALPATMKILGLIPGITIIVLMAFLTDASIEFLLRFSNIGNQRSYGGVMDDSFGKCGRIMLQVSILVSNIGVLIVYMIIIGDVLAGKNEYGIHHAGMLEGWFGISWWNRRTFVLLVTTLTVFAPLTCFKRIDSLRFTSAISVALAVVFLVITAGITIIKLFTDGLMMPRLLPNVTDLSSFWKLFTVVPVLVNAYICHYNVHSIQNELEDPSRIKPVVRSALAMCSSVYVMTSLFGYLLFGDGTLDDVLANFDTDLGIPFGSVLNDAVRFSYAAHLMLVFPVVFYPLRINIDGLIFPTAPPLTSSESDLRFGSITAGLIAVIFLGANFIPSIWDAFQFTGATAAVCIGFIFPAAVILKDRHNQATKRDKTIAICMIVLAVFSNAIAIYSDAYALFKKHTYVYPI

SEQ ID NO: 8522 - protein, 215 aa, Synechococcus sp. WH 5701
MGWTVDDIPSQEGRIAVVTGANIGLGLETTRALAAKGATVVMACRSRSRGEAARRQLLDEGLTGLDLLEIDLADLRSIERAIAVLSDQYGHLDLLLNNAGVMAPPRQLSPQGHELQFAVNHLGHMALTQGLLPLMASQTDPRVVTVTSGAQYFGTIRWDDLSWAQGYDRYGAYGQSKLANVMFALELHNRLQSENSSVKSLAAHPGIARTNLQPA

SEQ ID NO: 8523 - protein, 290 aa, Magnetospirillum magnetotacticum MS-1
MTDPLTKYPRPPFEAQGQSFPGKTAKMAPEPDHGEESYKGAGKLTGKVALVTGGDSGIGRAVAIAYAREGADVAIAYLPDEQKDAEAVGNWIEKAGRRALLLPGDITDPAYAREIVERTVKELGRLDVLVNNAAFQQPNQGVTDIDDALFEKHFRTNVFGPFYATKAALAHLKPGASVIFTSSVNSKNPVPTLFAYSATKGALSNMVIGLAQLLAEKGIRVNGVLPGPIWTPFIPAGMSEDSVKSFGSQVPFNRPGQPAELASAYVMLASEESSYTSGALVTVAGGMPLF

SEQ ID NO: 8524 - protein, 286 aa, Pseudomonas aeruginosa PAO1
MSEQRQTLPAQHQDQRPGHESQMQPKPEFVSADYRPAAKLEGKVALVTGGDSGIGRAVAVAFAREKADVVLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 8525 - protein, 960 aa, Rhodobacter sphaeroides 2.4.1
MKDFILPDDRDFGTPRSRATETVTLEIDGFPVTVPAGTSVMRAAAEAGISVPKLCASDTLDAFGSCRLCLVEIEGRAGTPASCTTPVAPGMKVRTQTPKLKQLRRGVMELYISDHPLDCLTCAANGDCELQDMAGAVGLRDVRYEAVENHFTPRSAAGDLNPQWMAKDESNPYFTYDPSKCIVCSRCVRACEEVQGTFALTIDGRGFDSRVSAGMASDSFLTSDCVSCGACVQACPTATLQEKSVIEIGTPERAVVTTCAYCGVGCSFKAEMRGDELVRMVPYKGGKANHGHSCVKGRFAYGYAAHKDRILKPMVRESIHDPWQEVSWDEALGFAARRLTAIQEKHGRQSVGVITSSRCTNEETYLVQKLTRAVFRNNNTDTCARVCHSPTGYGLGQTFGTSAGTQDFDSVEAADVVMVIGANPTDGHPVFASRLKKRLRKGAKLIVVDPRRIDLVKSPHIAAAHHLALRPGTNVAVVTAMAHVIVTEGLADEKFIRERCDWDEFQDFAEFAADPRHAPEAIESLTGVPAAELRAAARLYATGGNAAIYYGLGVTEHSQGSTTVIGIANLAMLTGNIGRPGVGVNPLRGQNNVQGSCDMGSFPHELPGYRHVKSDAARAVFERLWGVEIDPEPGLRIPNMLDAAVEGTFKGLYCQGEDILQSDPDTRHVAAGLAAMECVIVHDLFLNETANYAHVFLPGSSFLEKDGTFTNAERRINRVRKVMAPKNGFADWEVTQMLANALGAGWGYTHPSQIMDEIAATTPSFAGVSYERLEEAGSIQWPCNEEHPLGTPLMHVEGFVRGRGKLIRTEYVATDEKTGPRFPLLLTTGRILSQYNVGAQTRRTANSVWHPEDVLEIHPHDAEVRGVAEGDWVRLASRAGETTLRARLTDRVSPGVVYTTFHHPTTQANVITTDFSDWATNCPEYKVTAVQVAPSNGPSDWQEDYRAQANLARRILPAAE

SEQ ID NO: 8526 - protein, 101 aa, Brassica napus
TNAERLLKPKQTGDPEPDGCKYVVWMEFSGLGNRIISIASAFLYALLTDRVLLVEGGEQFSDLFCEPFLDTTWLLPKDFALTNQFSGFAQHSPSCHGEMLK

SEQ ID NO: 8527 - protein, 319 aa, Agrobacterium tumefaciens str. C58; identical to SEQ ID NO: 872

SEQ ID NO: 8528 - protein, 275 aa, Cryptococcus neoformans var. neoformans B-3501A
MADKSKTERPSWNKEEYATKAKEKDKEAYEHAKATEESLAKGHAPKKQSQYDDLPKPTELLKARTEDLGLTKNLNKTMLVTTTTTGKGPRGAGFYCELCNRTFKDSLAYLDHINGRLHLLKLGQSTHVERSTLSQVRAKIASLRAATHQKVTAQNFDFQSRLKAVKNAQEAERERRKDERRRKKMEREKREERRRMGILDDDEGNRDESGEKMDVDGAEKDVKDGKKDKRQERKEKREQQVKDQQRDREVEKAIRENEDMSTMMGFGGFGTSKRK

SEQ ID NO: 8529 - protein, 174 aa, Debaryomyces hansenii CBS767
MGVASSKILENLMEGTNFDKEEIERLRKRFMKLDKDGSGTIDKNEFLTIPGISSNPLAARLMDVFDEDGNGTIDFQEFIMGLSAFSGKTSKLDKLKFAFKIYDIDRDGYIGNGELFIVMKMMVGKNLQDEELQQIVDKTMMEADEDGDGRLNFHEFKNAVDSKSVASALTLNMI

SEQ ID NO: 8530 - protein, 304 aa, Prochlorococcus marinus str. NATL2A
MHNFLPFAWFEGQCIPFNDAKLSIATHALHYGTAAFGGMRAIPDPNNSKSFLLFRADKHAKRLCQSAKFLMTELDEDFVLNSLETFLVKNKPTQPVYIRPFVYTSDLGIAPRLHNIETNFFIYGIELGDYLSPDGVTCRVSSWTRQQDNSLPLRGKISGAYITSSLAKTEAVKSGFDEALLLNSQGKVSEASGMNIFIVRNGDLITPGVDQDILEGITRASVIELAKSNGINVIERPVDKTELFISDEVFLTGTAAKITPIKMIETTLMSKEMPTMNLLRDKLTKITEGLVPEYENWVKRVNID

SEQ ID NO: 8531 - protein, 199 aa, Arabidopsis thaliana
METDDHNGDVLAPPSNFSMVEDGIYRSGFPRPENFSFLKTLNLRSIIYLCPEPYPEENLKFLEANNIKLYQFGIEGKTDPPTPMPKDTVLDALKVLVDVRNHPILIHCKRGKHRTGCLVGCLRKVQSWCLSSVLEEYQKNAGLKWRQRDLNFIEAFDIVSLRQCLLSIMYQYHGYGFKRRRLAYEEENVKTPKPQAARV

SEQ ID NO: 8532 - protein, 556 aa, Mesorhizobium loti MAFF303099
MYRYDEFDHDFVQARVAEFSDQVQRRLSGEISEDQFRPLRLMNGVYLQLHAYMLRIAVPYGTLNGKQLRMLGHIARKYDKGYGHFTTRQNIQFNWPALSDIPAILADLASVEMHAIQTSGNCIRNVTADHFAGAAADEVADPRPYAEILRQWSSVHPEFSFLPRKFKIAVTGAERDRAAIQTHDIGLHLKKNAAGELGFAVYVGGGQGRTPMVARKIRDFLPEADLLSYCTAILRVYNLYGRRDNKYKARIKILVHETGVEEITRQVEAEWQDLKDAELKLPDADIRAIQAYFAPPELADRPEGDQAVKLARLDSKGFSEWLDQNVVTHRHPDYAAVTISLKGIGEVPGDASDSQMEAIADIAEKYAFDELRVSHEQNLILPHVARADLKAVYDALVDIGLATANSNLISDIISCPGLDYCALATARSIPIAQEISQRFASLERQREIGELKLKISGCINACGHHHVGHIGILGVEKKGSELYQVTLGGSADENTSVGEIIGRGFSSEEITDAIEQIVETYLGLRLNPQEKFIDAYRRVGPAPFKEALYAGETKAA

SEQ ID NO: 8533 - protein, 103 aa, Triticum aestivum
  misc_feature (36)..(36): Xaa can be any naturally occurring amino acid
  misc_feature (93)..(93): Xaa can be any naturally occurring amino acid
MAPTVMASSATSVAPFQGLKSTAGLPVSRRSNGASXGSVSNGGRIRCMQVWAHRGALRSSKTLSYLPPAQHGRASSSKSNYLIPLQSGVPCLXVQARVGFIFP

SEQ ID NO: 8534 - protein, 207 aa, Neisseria gonorrhoeae
NISVGTIFSILAKPEGALATESFLQTGRQQLAAGYVLYGPQTQLAFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 8535 - protein, 277 aa, Synechococcus sp. WH 5701
MHQFLPYAWFQNQCVPFEEARISIATHALHYGTGAFGGMRAIPDPQQASTMLLFRADRHARRLSQSARLLLTDLTEETILTSLTAMLRANQPDQPIYLRPFVYTSDLGIAPRLHDIETDFLIYGLALGDYLSPEGVSCRISSWTRQEDRSLPLRGKISGAYITSSLAKTEAVQSGFDEALLLNSRGKISEASGMNLFLVRDGELITPGVDQDILEGITRASVIELAKAMGIPVVERAVDKTELFIADEVFLTGTAAKITPIRQIESTVLRHDRPIMQ

SEQ ID NO: 8536 - protein, 834 aa, Arabidopsis thaliana
MKRQAKPPEKKTKRTTNASSPTPSSSSPSLSSLPDEIVENCLARISRSYYPTLSIVSKSFRSIISSTELYVARSHLRNTEECVYVCLSDKSFEFPKWFTLWVNPNQANSMVEKKRKKKKTIGKLLVPIPSSNLSPVSKSAIAVGSEIYVIGGKVDGALSSAVRILDCRSNTWRDAPSMTVARKRPFICLYDGKIYVIGGYNKLSESEPWAEVFDIKTQTWECLSDPGTEIRNCTIYRIAEIEGKIHFGYTQKTYAYDPKQGEWECCEGEVAFPRSQCVMESVLYTFANNYTWEDDYGCKWWSTDGYGEKVKGLESLLEIHKRNGGSSDNTTKLVACGGKLLLLWEGYMKHNPNNRKKIWCAVIALEKRDGGKVWGIVEWVDVVHIVPTSCKLLHCLVVSLERGEGSKGKKECNMDYLSPHDQHSVFSFKIPSLPLIVITVAMNFQVEPPEKKKTKNSSPPHSPPSSSSPSLSLLPEEIVVHCLARISRLYYPTLSLVSKSFRSILSSTELYATRSHLGSTEQCVYLCLWDPSYQFPQWLRLLVNPNRTLANSIIKKRRKKKKTTGQMLVPLTSSKFTSVSKATVVVGSEIYVLGGPVDSAVRVLDCCSHTWRDAPSMNVSRMNAWACFHDGKIYVMGGCQGLKDEPWAEVFNTKTQTWEGLPEPGSEVRKCSIDRSGVIEGKIEFGNVNEMCAYDTKLCKWEYCVNKSAALRSECMIENVSYGFWNMRLLWYDNDIQKDYWKRLEGLESLDDKYMRNGGSSGNTTKLVACGGKLLLLWEGYMKHNPNNRKKIWCAVIAIEKCDGGGVWGIVESVDVLYTVPISCQLLHCLVVSV

SEQ ID NO: 8537 - protein, 984 aa, Staphylococcus aureus subsp. aureus COL
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTAIKEKHGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRQPQYSVQVQKKWERSDYVFPGNQVDK

SEQ ID NO: 8538 - protein, 104 aa, Xylella fastidiosa Temecula1
MLVMERIQAEIEEHPLVLFMKGTLEFPMCGYSSRATQALLAAGARHLHIVNVLAEAEIRANLPRFSNWLTFPQLFIHGELIGGCEIILELFESGDLKRILSEAD

SEQ ID NO: 8539 - protein, 375 aa, Paxillus involutus
MEDEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVMDSGDGVTHTVPIYEGFALPHAILRLDLAGRDLTEYLIKNLMERGYAFTTTAEREIVRGIKEKLCYVALDFEQELQTAAHSSALEKSYELPDGQVLTIGNERFRSPEALFQPAFLGLEAAGIHETTYNSIFKCDLDIRRDLYGNVVLSGGTTMFPGIADRMQKELTSLSPSSMKVKIVAPPERKYSVWIGGSILASLSTFQNLWCSKQEYDESGPGIVHRKCF

SEQ ID NO: 8540 - protein, 575 aa, Arthrobacter ramosus
MNRRFPVWAPQAAQVTLVVGQGRAELPLTRDENGWWALQQPWDGGPDLVDYGYLVDGKGPFADPRSLRQPRGVHELGREFDPARYAWGDDGWRGRDLTGAVIYELHVGTFTPEGTLDSAIRRLDHLVRLGVDAVELLPVNAFNGTHGWGYDGVLWYAVHEPYGGPEAYQRFVDACHARGLAVVQDVVYNHLGPSGNHLPDFGPYLGSGAANTWGDALNLDGPLSDEVRRYIIDNAVYWLRDMHADGLRLDAVHALRDARALHLLEELAARVDELAGELGRPLTLIAESDLNDPKLIRSRAAHGYGLDAQWDDDVHHAVHANVTGETVGYYADFGGLGALVKVFQRGWFHDGTWSSFRERHHGRPLDPDIPFRRLVAFAQDHDQVGNRAVGDRMSAQVGEGSLAAAAALVLLGPFTPMLFMGEEWGARTPWQFFTSHPEPELGEATARGRIAEFARMGWDPAVVPDPQDPATFARSHLDWSEPEREPHAGLLAFYTDLIALRRELPVDAPAREVDADEARGVFAFSRGPLRVTVALRPGPVGVPEHGGLVLAYGEVRAGAAGLHLDGPGAAIVRLE

SEQ ID NO: 8541 - protein, 355 aa, Erwinia carotovora subsp. atroseptica SCRI1043
MGQKYLFIDRDGTLIAEPPEDFQVDRLDKLALEPDVIPSLLALQKAGYTLVMITNQDGLGTDSFPQETFDPPHNLMMQILTSQGIHFEHVLICPHLPADNCTCRKPKTELVTAYLNGGLMDVANSYVIGDRQTDIQLAQNMGITGLLYQRGGLNWQAITDQLTKRNRHAHVNRVTRETAIDVNVWLDQEGGSKINTGVGFFDHMLDQIATHGGFRMNIEVKGDLYIDDHHTVEDTGLALGEALNNALGDKRGIGRFGFILPMDECLARCALDISGRPHLEYKAEFNYQRVGDLSTEMVEHFFRSLSYSMACTLHLKTKGRNDHHRVESLFKVFGRTLRQAIRVEGDTLPSSKGVL

SEQ ID NO: 8542 - protein, 346 aa, Novosphingobium aromaticivorans DSM 12444
MKALRYYGARDIRHESMDDPTPQSDRDAIVKVDACSICGSDLHIYHGHGFSEDIGFCVGHEAVGEVVEVGRGVHRLKVGQKVMIPAAVGCGACRSCLAGVVNTCENNGSGCYGLSAKLQGSQAEAVRVPAADANAVAIPEGVSTEQALMMTDALATAWFGARQADIRPGSSVGIIGLGPIGLMAAESAFVMGAHVVYAIDPVPERRAIAESLGAIALHPDEASARIKEDTHGRRLDCVVEVVGSDATVDMALRLVRVRGTVSVIGVQQSRRFPFPLERAFAGGLTFRVGTCSVPEELPALFPLVASGRLRPERYISHRLPLSQGAEAYRMFEAREAGALKMVLVPD

SEQ ID NO: 8543 - protein, 385 aa, Novosphingobium aromaticivorans DSM 12444
MIAQVEPFHAIAISRLAHDLEAAGQSVIHMEFGQPSTGAPAEAIALAHEVLDNEAMGYWESVPLKERIARSYAENHGVKVEREQVILTCGASPAFVMALSCLFRPGARIALARPGYVAYRNSLKAMYLEPVEMECGPAERFQVTAAAVDALDPVPDGLIVASPANPTGTIIEPGELAAIAEVCCRKGIRVISDEIYHGLSYGKAAASMLEYLPDAVIVNSFSKYFSMAGWRLGWLVVPPSLIDAARARMGSLFLTPPVLAQKAGLKAFDCRAELDGHVETYARNRAILLEALPQMGLGRIAPPDGAFYIYADASEFTDDSLALCEALLRDTGVATAPGLDFDPVNGKRFIRFSFAVSTPLIEEAVRRIGPWFAARRAVSPAQAPS

SEQ ID NO: 8544 - protein, 630 aa, Cryptococcus neoformans var. neoformans B-3501A
MVDTQYAFRAQKTAGVADAPAWEVSNRIPAETVGSKCYAYSPNGEWLAYAMNNCVEIIPSHSSSPTPVTLQQANIVALKFSPMSSYLFTFERPVKTESGEMYKNAKAWDVKNGEIVGGWYQKTMEDWEPIITPNETHLLRAGPSDLAIFSPPFAPRPSTRLKIEGIRGIFISDPSALPATSTNSRPIPAYHEPAVAIWIGEKKGAPASLGLWSLSSLMGKNALQANGNGDIQTETRDMPPTTARKAFYKADKLTVKWNNAGTMALFLAQSDVDNSGKSYYGETNLYLVGLDGTFDGLVELDKEGPIYDFAWSPISREFTVCYGYMPARTQMFDLKAKPVYSFGENPRNTLVYQPQGKLLLSAGFGNLAGGIDIWDVSTRNKVAEFKASNASHCEWSPCGRYVLTATLSPRLRVDNGVKIWWCNGQLLHIQPVEELYQASFAPQRVTEIGSFPAIVPKAPEANPSVAAYRPKGETDGVAAKPAGAYRPPGARNRPEGENASASFGSSRGKPGVRTVPGAGGRQPPGSTPGASTGAGGDDKKKRQRKRGGKDKEEEKKDEAPTQEAVKPEVKEEAGEDAVAKKIRNLMKKLKAIDELKTKLAAGEILEKTQLKKIESEAQVKSEIKALGGNV

SEQ ID NO: 8545 - protein, 440 aa, Schizosaccharomyces pombe 972h- [sequence omitted]

SEQ ID NO: 8546 - protein, 744 aa, uncultured bacterium 561
MVQVRALLETESLDQASFANWLTGLATPLDTLDQNRLIDAFVLLREQDSEQSQGTMDWAGDADVLSVGLETVQILAELRLGPDALIAGFLYRSVRQQVISIDTLKHRFGDKVASLLDGVLRMAAVSDLTDLSDVPVLGQSAAPNINIRRMLVAIVDDVRVALIKLAERTVAMRGLKGAEEHRQQRIAWEVFNVYAPLAHRLGVGHLKWELEDLSFRYTNKDAYHRIASLLDGRRQDRDSFIARVNAQLTQTLTQSELAFEITGRAKHIYSIWRKMQRKGIGFSQVHDIRALRILVDDVAACYQTLGVVHGMWRNIPNEFDDYIASPKENGYRSLHTAVIGPEGKILEVQIRTEEMHEEAELGVCAHWRYKASDAHGAGPDTYEEKLSWLRQVLEWHESVGDDEVVAEQFTFDSAQDRVYVFTPKGDVVSLVHGATPLDFAYHVHTEVGHRCRGARVNGTLVPLTYVLGTGERVEILTASTVQPRRDWLSSSSGFLRTARARNRVQQWFKSQNRDDNVAAGRELVERECARLALTSLDYKAMSGALDLDAVDDMFAAVGSGDLTSKQVLRVAKSVTHSDSVLHPEWAIHPQQAASEGAARVDGVGNLLTQFAGCCLPVPGDGIEGYITRSGGVTVHRADCARLLALHDEYPERIIAVNWGAAAVELFPVDIELTAYDRQGLLADVTLVLAQASANVTSINTQSHPDNNTAHMRLRAEVSTIDALMELLAKLHQLDNVISAKRVVE

SEQ ID NO: 8547 - protein, 103 aa, Hyacinthus orientalis
MSGRRKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 8548 - protein, 321 aa, Arabidopsis thaliana
MDKHHHQHLLLQHHQHLHHHQKLSLAKSSRQSCSEWIFRDVPSDITIEVNGGNFALHKFPLVSRSGRIRRIVAEHRDSDISKVELLNLPGGAETFELAAKFCYGINFEITSSNVAQLFCVSDYLEMTEEYSKDNLASRTEEYLESIVCKNLEMCVQVLKQSEILLPLADELNIIGRCIDAIASKACAEQIASSFSRLEYSSSGRLHMSRQVKSSGDGGDWWIEDLSVLRIDLYQRVMNAMKCRGVRPESIGASLVSYAERELTKRSEHEQTIVETIVTLLPVENLVVPISFLFGLLRRAVILDTSVSCRLDLERRRHFVRH

SEQ ID NO: 8549 - protein, 193 aa, Triticum aestivum
  misc_feature (37)..(37): Xaa can be any naturally occurring amino acid
LAWSRPRSSSSPPIIQYPWAPAVMASSATTVAPFQGXLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 8550 - protein, 516 aa, Prochlorococcus marinus str. NATL2A
MNMKYTITTPLYYVNDKPHLGSSYTTIACDAIARFERLNGNTVLFLTGVDEHGQKIERTAESKNLEPQLHCDEITEKYKYLWDKLNISYDRFVRTTSIEHTSLVHQFYSKVLKSDDVYMGRQSGWYCVGCEEYKDVEDKDKSPICSIHKKELEWRDEENLFFKLSKYQDQIEKLIHVDGFISPKSRKNEIINFVSKGLRDFSISRVNLKWGINVPGNKDHTFYVWFDALLGYVSGSLNDQCSPELTEKSLSNWPANIHVIGKDILRFHAVYWPAMLLSAGMKTPRSVFGHGFLTREGQKMGKSLGNVLDPIELLEYGGIDAMRWYLLRDIEFGEDGDFQMRRFVDIVNSDLCNTIGNLLNRTITMSKKWFKENIPIDNTLSSDSTLKVKSETKIIEYMESFKDSNFKSSANAIIDLANSANLYLNDRAPWKLIKDISNKNIVALDIYSVLESCRIIGILLNPIVPNLSNRILKQLNIDTSNINFKDSLQWGLLDPNNGLQDPTPVMDKIEFNEDPR

SEQ ID NO: 8551 - protein, 121 aa, Chlorobium tepidum TLS
MDQLIQLVEATQQRNDIPEVRPGDTVRIQLKVIEGEKERLQAFEGVVIGDKGMGASKTITVRKISHGVGVERIIPVNSPNIESVTVVRSGKARRAKLFYLRKRTGKAALKVKERKSASAEA

SEQ ID NO: 8552 - protein, 203 aa, Hyacinthus orientalis
HCTLHSDRMGNVLRRAVLQHVRVINPAFRPVIFSRSESVSSARLEEHGFESTTVSDVLKSKGKSADGSWLWCTTDDSVYDAVKSMTQHNVGALVVVKPGEEKDIAGIITERDYLRKIIVQGRSSKSTKVGDIMTEENKLITVTPGTKVLQAMQLMTDNRIRHIPVIGDKGMIGMVSIGDVVRAVVSEHREELDRLNAFIHGGY

SEQ ID NO: 8553 - protein, 124 aa, Pseudomonas syringae pv. syringae B728a
MTERAATGSIAMSKELQITDLHLGEGKAAVKGALITTHYTGTLEDGTVFDSSHERGKPFQCVIGTGRVIKGWDQGLMGMKVGGKRQLFVPAHLAYGDRSMGAHIKPGADLTFEIELLEVLTRDD

SEQ ID NO: 8554 - protein, 402 aa, Candidatus Protochlamydia amoebophila UWE25
MTKVSKERLKELEESGDVMELNLGPQHPSTHGVLRLKLRLEGEVVLSCDPVIGYLHTGVEKECESRTYHQVFTLVDRLDYLSGPAEEQAFAGALERLMNIEVPERAQTIRIILLELSRIASHLLWAGTSALELNMSSVFMYSFAEREKILDLFEQVSGARMFPSLWRIGGLAKDLNSDFISHLKEFISGFQKIWKELDRLLTDNFVWCKRLQGVAVIDQEICKQYMCTGPVLRASGISYDIRKAYPYLGYENYNFDIPTHIDGDSYARYLVRMEEMLQSISIIEQAIARLKPGVVLTNDRKVALPPRKELARSMEAVIHQFKLISEGLHPPVGSVYNCVESARGELGHYVISDGTPKPYRLRVRSPSFSHVEVLKKVLRGHVISDVVVAIASVDPILGDVDR

SEQ ID NO: 8555 - protein, 415 aa, Pseudomonas aeruginosa PAO1
MKAVVFHDIGDIRLEDVAEPRLQEPTDAIVRLTASAICGTDLHFVRGSVGGMRPGTILGHEGVGIVEALGDEVRNLQVGDRVVIPSTIACGNCVYCRAGYYAQCDVANPGGSQAGTAFFGGPRANGGFHGLQAEKARIPYANIGLIRLPSSISDDQAILLSDIFPTGYFGAELAGIAPGNTVAVFGCGPVGQFAIASALLLGAARVFAIDRHPDRLHMARQQGAEVIDFEREDPVQALRWLTAGIGVDRAIDAVGVDAEHSHGTATPAPRQEGTSWSPGNAPAQALEWAVQGLAKAGTLSIIGVYAEDSRQFPIGLAMNRNLTIRMGNCHHRKYIPLLLEHVLSGRIDPAKILTQVKPIGDAIEAFEAFDRRETGWIKVELVPQKRQVEGSEERLDERAVDELARRPTPESGARG

SEQ ID NO: 8556 - protein, 716 aa, Pseudomonas aeruginosa PAO1
MSRKRSPAPSRISEGHPFPLGATWDGLGVNFALFSAHATKVELCLFDARGEKEIERIELPEYTDEIWHGYLPDAHPGQIYGYRVHGPYEPDAGHRFNPNKLLLDPYAKQLVGRLRWSEALFGYTIGSADADLSFDERDSAPFVPKSKVIDPAFTWAERPPVRVPWDRTVIYEAHLRGLSMRHPQVPEAVRGTFAGLMNADLLAHIRRLGVTSVELLPIHGFVDDKHLLENGMSNYWGYNSIAFFAPHPAYLASGQVNEFKEMVAHLHDAGLELILDVVYNHTAEGNELGPTLCMRGIDNASYYRLMPDQRRYYINDSGTGNTLDLSHPCVLQMVTDSLRYWATEMRVDGFRFDLATILGRHPDGFDERHGFLVACRQDPVLSKCKLIAEPWDCGPGGYQVGGFPPGWAEWNDRFRDCVRAYWRGDDGMLPELARRLTASGDLYDQRGRRPYASVNFVTAHDGFTLRDVVSYDHKHNEANGENNADGSDHNLSWNHGCEGPTDDPEIRALRLRQMRNLLSTLLLSQGTPMLVAGDEFSRTQQGNNNVYCQDNELGWIDWRLDDEGRSLLAFTQRLLALRQRYPILRRGRFLVGEYNEALGVKDVTWLAPGGEEMTEEHWHDEHARCLGVLLDGRAQPTGILRSGEDATLLLILNAYHDAVSFRLPEVAEGSGWTCLLDTQRPEDPLGERYPFASEFLVGGRSFLLFELQPPGAGAEG

SEQ ID NO: 8557 - protein, 453 aa, Zea mays
MSTSPAASSSAPTAFAASAVTMAAEAADGPVLSVVSKRLRALRKKYNRITQMEESLAAGKSLNREQEEVLRSKPVVAALIDELERLRPPLASALAEELSSRSAPAPAPAPAATASSSDPDSSVQDLLALVYFGSLFDVKQQSDFVSLVYTRELERSSCLTYDYVGDDPEDSLVETDLNAVSALATLAASRPPAAAGVSHRDALQACAHHARLWLNRADEPIHPDSTITYAGVRAKLDRIMASGYYTAQLEMRTPMDLAAAVANFGAGGVQVQESMVVSPQALEAVEGSQDVEEHKDEKEDSQATEIYSDHQAPVVDAEHVDDEGLVNPAHEVPSAEAEQETFDDYVDDQEQKDQQFTQRRSYQNQRSGGGRGGGRRGYPNGRGVRGYQNGRGGGGYQNGRGGGGGYYESGYYQPRNYNNRGRGGRNSYYNNHGGGAQAGGHGHPGRVELGANA

SEQ ID NO: 8558 - protein, 168 aa, Magnaporthe grisea 70-15
MAASGSSNSSTRTMQSRTGRSKQRYNSKGERLVAGVVALSEDKEYVLLTQSTRRKGWVLPKGGWETDEECTEAAEREAWEEAGIVVTIDYDLGQIEETRVKTSSKSAKSGKREKAIYHFYEATVTSEEQDWPEKDKRQRKWMTFVDAWESLKDRPELQEALNRSTMKR

SEQ ID NO: 8559 - protein, 210 aa, Erwinia carotovora subsp. atroseptica SCRI1043
MLSEECFLNDEQRNQLDWEKTDGMLPVVVQHAVSGEVLMLGYMNQDALQATEESGKVTFFSRTKQRLWTKGESSGHFLNVVSITPDCDNDTLLILVNPIGPTCHLGTSSCFSPAASDWTFLYQLEQLLAERKHADPDSSYTARLYASGTKRIAQKVGEEGLEAALAATVHDREELTNEAADLMYHLLVLLQDQDLDLATIINRLKERHNK

SEQ ID NO: 8560 - protein, 553 aa, Escherichia coli
ASIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 8561 - protein, 294 aa, Rubrobacter xylanophilus DSM 9941
MLRFPGIQVAIVTPFDDSGEVDYPCLAEHADWLIENGVHGLVSPGSVGEYASLTDEERKRVVEAVVEAARGRVPVTAGIMAPSTARTVGWAEHAKEVGAKAVMALPPINYNPTKREVFAYYKAISDVGLPIAAYNNPHDTATDLTPEFLAELSEIENFVAVKDFSGDVRRIARIRELCDLEIIVGVDDLALEGFLAGATGCIAGFANALPKETVEVYELARAGKLDQAWELYRRLLPLFRYDSTPLLVQAIKYTMELVGRPAGKTRPPRLPLDDEDRGAVERAFEHFAATRTAG

SEQ ID NO: 8562 - protein, 109 aa, Novosphingobium aromaticivorans DSM 12444
MSNTTEERISEIVNGNDVVLFMKGTPLFPQCGFSSKAVAILEHLGVEYATVDVLQDMEIRQGIKSFSDWPTIPQLYVKGEFVGGSDIMMEMFQAGELQQVMDDAGVKAA

SEQ ID NO: 8563 - protein, 292 aa, Methanococcus maripaludis S2
MVENQKKIINTVADITILIYYYTAVVFLENLQFIRVNTLKISSEELKTRLEEKGVNLEDTFLDYVFRVVKSPFSMGSTPEYLLGYYFLQSISSIIPSITLNPSKDDEVLDMCAAPGGKTTHLAQLMENEGSILAVEINKNRLKSLRSNINRMGFKNTLMINTNAVNIDKKLRFDKILLDAPCTGNEVKDSNRVKTKRDILFCAKRQVELFRTAIEVLKDGGELVYSTCSPEIEEDEDIVRYILKTNKNMELIELTVDDFPGINMIEGEVKGTLKVIPPNEPFFIAKFRKTKN

SEQ ID NO: 8564 - protein, 563 aa, Photobacterium sp. SKA34
MTDQKLSDNERLKRESNALRGTIEQDLGDRMTGGFTADNFQLIRFHGMYQQDDRDIRAERAKQKLEPLHNVMLRARMPGGIITPKQWLEIDKFADEHTSYGSIRLTTRQTFQFHGVLKPNIKLMHQTLNSIGIDSIATAGDVNRNVLCTTNPVESELHQEAYEWAKKISEHLLPKTRAYAEIWLDGEKLETTDEEPILGSNYLPRKFKTTVVIPPQNDVDVHANDLNFIAIADNGKLVGFNVLVGGGLAMTHGDHSTYPRRADDFGFIPLEKTLDVAAAVVTTQRDWGNRSNRKNAKTKYTLDRVGSDVFKAEVEKRAGIQFEDSRPYEFTDRGDRIGWVEGIDGKHHLALFIENGRLLDYPNKPLKTGVAEIAKVHGGDFRMTANQNLIVAGVLTKDKDEIEKIARDHGLIDDGVSEQRKNSMACVSLPTCPLAMAEAERFLPEFVTDVEGILEKHGLDDDENIILRVTGCPNGCGRAMLAEIGLVGKAPGRYNLHLGGNRNGTRVPKMYRENITVAQIMDEIDSLVGRWSTERQESEDFGDFTIRTGIIDEVKVSKRDFYG

SEQ ID NO: 8565 - protein, 307 aa, Prochlorococcus marinus
MSGIQVLLVAGTHGNEINAPWLFEQWKQKDSLINTHNINIQTVIGNPVALEQGKRYVDRDLNRSFRKDLLVSSDLNAAEHFRALELVSEYGPNGNNPCQIAIDFHSTTSSMGSSLVVYGRRPADLAIVSLIQNHLGLPIYLHEGDNAQSGFLVESWPCGFVVEVGPVPQGLLHFQIINQTLLTLDSCLKEISNVINSKTVYPEQLIVHRHLKNIDFPRDSSGVPSSLVHGDNPGRDWYPIKNGHPLFESLSGDLTLLLEGGLEEEFVPVFINEAAYAEKNIAMSLTKKEMWDVQKDWINDLSKLLNP

SEQ ID NO: 8566 - protein, 334 aa, Triticum aestivum
  misc_feature (60)..(60): Xaa can be any naturally occurring amino acid
  misc_feature (69)..(69): Xaa can be any naturally occurring amino acid
  misc_feature (76)..(76): Xaa can be any naturally occurring amino acid
  misc_feature (107)..(107): Xaa can be any naturally occurring amino acid
  misc_feature (245)..(245): Xaa can be any naturally occurring amino acid
  misc_feature (256)..(256): Xaa can be any naturally occurring amino acid
  misc_feature (278)..(278): Xaa can be any naturally occurring amino acid
  misc_feature (289)..(289): Xaa can be any naturally occurring amino acid
  misc_feature (310)..(310): Xaa can be any naturally occurring amino acid
  misc_feature (321)..(321): Xaa can be any naturally occurring amino acid
MAASLQAAATLMPAKIGGRASSARPSSHVARAFGVDAGARITCSLQSDIREVASKCADAXAKMAGFALXATSALLXVSGASAEGAPKRLTFDEIQSKTYMEVKGTGXTANQCPTIDGGVDSFPFKAGKYEMKKFCLEPTSFPFKAEGIQKNEPPAFQKTKLMTRLTYTLDEMEGPLEVGADGTLKFEEKDGIDYAAVTVQLPGGERVPFLFTVKQLVATGKPESFSGPFLVPSYRGSSFLDPKGXRGGSTGYDNAXALPAGGRADEEELAKENVKKRXSPSTGTITLSXVTKSKPETGEVIASSKSVQPXETNLGAKAPKXFKIQGVWYAPARV

SEQ ID NO: 8567 - protein, 203 aa, Oryza sativa (japonica cultivar-group)
MFSLFYGLWQHVFSKAEFHVVILGVHKAGKTTLLEKVKSIYLKEEGLPHDRIVPTVGLNIGRIEDANVKLVFWDLGGQPGLRTIWEKYYEEAHAVIYVIDSAAASSFEDAKSALEKVLHHEDLQGVPLLIFANKQELPAAVTEEELARHLHLKGLDERPYMFQAGSAYDGTGIKAGIDWLVEEMERSKRTEVLMARTETAEKI

SEQ ID NO: 8568 - protein, 277 aa, Bordetella pertussis Tohama I
MPMQYPAQSPFQGIWIPLVTPFADGAVDLPALRRLVRDYKAAGVDGLVACGSTGEAAALDEAEQLAVLDAVLEEAGALPVAMGLAGNHQDHVLRRLARLGERPLAGVLAPAPLILYDIPYRTGAQLDTATLLALAEHPNIAAVKDCGGSVDKTLALIAHGGMAVLAGEDLQGLGTLCLGGTGMIAAAAHVRPDLFVAMHRAVRAQQLGQAQRLFLALAPVIRLLFAEPNPAPLKALLASQGRLRNEMRAPMLPAAEALTRRLQAELDVLDRAFAPGA

SEQ ID NO: 8569 - protein, 131 aa, Kluyveromyces lactis NRRL Y-1140
MVRRVEWKEVGVESGPTFLAPAYVTSKDTELVYTSGCVGSDLLTGEIPEDLEKQVRNALDNLGRVLKASNSSFDDVLKILLFVADGSYASTVNAVYKEYFPERPARSCIVVSFPDPTLKVELECVAAVSST

SEQ ID NO: 8570 - protein, 634 aa, Bacteroides fragilis NCTC 9343
MNDNKIKSSSPLSDLQHQQLLLRMEYEYEKEEFRRQTETMGIARKVKRGLCWYPVGTGRSFYNSLNQLVIEIERKEDKDIEHVFEFGRPVCFFEQGYDGKIHYFNSICTVSYADEERMVVAVPGAGSLLEIQGAERLGVQLYFDETSYRTMFEALEDVIRAKGNRLAELRDILLSKQPSCWRATYPVRFPWLNSTQEAAVNKVLCAKDVAIVHGPPGTGKTTTLVEAIYETLHRENQVLVCAQSNTAVDWIAEKLVDRGVPVLRIGNPSRVNDKMLSFTYERRFEGHPAYTELWGIRKSIREMGNRMRKSSYSEREAARSRINHLRERATELEIQINEDLFSGARVIASTLVSSNHRILTGRRFTTLFIDEAAQALEAACWIAIRKADRVIFAGDHCQLPPTIKCIEAARNGLEQTLMEKVAANKQETVSLLKVQYRMHQSIMQFSSEWFYQGELQAAPEVTNRGILDLDLPMSWIDTSEMEFHEEFVGESFGRINKPEANLLLQELEAYIRKIGEKRVLEERIDFGLISPYKAQVQYLRGKLKGCLFFRPFRSQITIHTVDGFQGQERDVIFISLVRANEDGQIGFLNDLRRMNVAITRARMKLVILGDAVTMSKHAFYKKLIGYIRHISQGL

SEQ ID NO: 8571 - protein, 491 aa, Solanum aculeatissimum
MDNGSNQLHVLFLPYFATGHIIPLVNAARLFVFHAGVKVTILTTHHNASLFRSTIDNDVEDGHSVISIHTLRFPSTEVGLPEGIENFSSASSPELAGKVFYAIYLLQKPMEDKIREIHPDCIFSDMYLPWTVNIALELKIPRLLFNQSSYMYNSILYNLRLYKPHKSKTITSTDSISVPGLPDKIEFKLSQLTDDLIKPEDEKNAFDELLDRTRESEDRSYGIVHDTFYELEPAYADYYQKVKKTKCWQIGPISHFSSKLFRRKELINAVDESNSCAIVEWLNEQEHKSVLYVSFGSVVRFPEAQLTEIAKALEASSIPFIWVVKKDQSAETTCLLEEEKLKNKGLIIRGWAPQLTILDHSAVGGFMTHCGWNSILEAIIAGVPLVTWPVFAEQFYNEKLVEVMGLGVKVGAEVHESNGGVEISSLVIESEKIKEAIEKLMDDSKESQKIREKVIGMSEMAKNAVEEGGSSWNNLTALIDDIKNFTSTTNV

SEQ ID NO: 8572 - protein, 651 aa, Oryza sativa
  misc_feature (432)..(432): Xaa can be any naturally occurring amino acid
  misc_feature (441)..(441): Xaa can be any naturally occurring amino acid
  misc_feature (447)..(447): Xaa can be any naturally occurring amino acid
MHVGYGIVAVVLVLLPPSATPAGIADCDEGVGNTYVANSTFEANLNVLAAALSPNVSVAPAGFAVATVGADPDKVFAMALCRGDVNASACSACVAAAFVDGKKDCPGNSGVAMYEDACVARFSRYRFMDFLSPDQWQVSQMIWYPEQASASVDVPAVGWFNAAVTKILAAMVDHAVTSTTGNSTTKKYFVTGEEEFDPNIYGFAQCVPDLTPAQCNDCLKDLLFYAKQAYLGKSLSWVRVNSVWCRLMYSVQPFYRGRAMLQVSAPPPTAEAPVLSPEPGSGKKISTAGIAAGVASSVVVLLILSVFAFVRFRRRTKVTDAVHPLKKITRAQCMIFDLSALQEATENFSPNNKLGEGGFGAVYKGVLSDGQEVAVKKLLGTGHGLDQLYNEIKLLAELQHKNLVRLQGFCLHQEQTLLVYEYLKNRSLDNFXLFDPSRGNXALNWDXQYNIILGIAKGILYLHEDSSLRIIHRDLKSNNILVGDDMEPKIADFGLARLLGEGHTHSKTTRVVGTFGYMAPEYAIDGNVSTKIDIFSFGVLVLEIITRRRNWHSDDHDLVSDVWNCWTKGTATKMIYQSLNGYSESQALRCIHIGLLCVQPDPDDRPHMSSIIFMLTKENMKLQPPAEPAFFLGRESASSPPSCGQHGYNCD

SEQ ID NO: 8573 - protein, 600 aa, Triticum aestivum
KTSDFLGYSIKAITQGILPAVRTYVDTTPGEFDSFQDIINLYEGGIKLPNVPALEELRKQFPLQLIKDLLPVGGDSLLKLPVPHIIQADQQAWRTDEEFSREVLAGVNPVMITRLTEFPPKSSLDPSKFGDHTSTVTAAHIEKNLEGLTVQQALESNRLYILDHHDRFMPFLIDVNNLPGNFIYATRTLFFLRGDGRLTPLAIELSEPVIQGGLTTAKSKVYTPVPSGSVEGWVWEFAKAYVAVNDSGWHQLVSHWLNTHAVMEPFVISTNRQLSVTHPVHKLLSPHYRDTMTINALARQTLINAGGIFEMTVFPGKFALGMSSVVYKDWKFTEQGLPDDLIKRGMAVEDPSSPYKVRLLVSDYPYAADGLAIWHAIEQYVSEYLAIYYPNDGVVQGDVELQAWWKEVREVGHGDLKVAPWWPRMQAVGELAKACTTIIWIGSALHAAVNFGQYPYAGFLPNRPTVSRRRMPEPGTEQYAELERDPERAFIHTITSQIQTIIGISLLEVLSKHSSDELYLGQRDTPEWTSDPKALEVFKRFSERLVEIESKVVGMNHDPQLLNRNGPAKFPYMLLYPNTSDHKGAAAGLTAKGIPNSISI

SEQ ID NO: 8574 - protein, 483 aa, Arabidopsis thaliana
STFFVSDSEKLILKMSSRSDLKIKRVSLIIFLLSVLVEFCYGGFTSEYVRGSDLPDDMPLDSDVFEVPPGPNSPQQVHVTQGNHEGNGVIISWVTPVKPGSKTVQYWCENEKSRKQAEATVNTYRFFNYTSGYIHHCLIDDLEFDTKYYYEIGSGKWSRRFWFFIPPKSGPDVPYTFGLIGDLGQTYDSNSTLSHYEMNPGKGQAVLFVGDLSYADRYPNHDNNRWDTWGRFVERSVAYQPWIWTAGNHEIDFVPDIGEIEPFKPFMNRYHTPHKASGSISPLWYSIKRASAYIIVMSCYSSYGIYTPQYKWLEKELQGVNRTETPWLIVLVHSPFYSSYVHHYMEGETLRVMYEQWFVKYKVDVVFAGHVHAYERSERVSNIAYNIVNGLCEPISDESAPIYITIGDGGNSEGLLTDMMQPQPKYSAFREASFGHGLLEIKNRTHAYFSWNRNQDGNAVAADSVWLLNRFWRAQKKTWLDAF

SEQ ID NO: 8575 - protein, 322 aa, Crocosphaera watsonii WH 8501
MTIRTVTTTPFEGQKPGTSGLRKAVSVFQEQNYLENFIQSILDSLDGCEGQTLVVGGDGRYYNRQAIQIILKMAAANNIGRILVGTNGIFSTPAASAVIRKNNAFGGIILSASHNPGGPKGDFGVKYNVGNGGPAPEKVTNAIFERTKTIDEYKILEAGDINLDRPGSFKLGTMDVEVMDSVNPYVELMQELFDFDKIKSMVSSDNFKMCMDSLHAVTGPYARALFEQFLGAKEGTVQNGIPLEDFGGGHPDPNLVYAHDLVEIMFGDNAPDFGAASDGDGDRNMVLGKNFFVTPSDSLAVLTARATLVPGYKDGIAGGARS

SEQ ID NO: 8576 - protein, 449 aa, Streptococcus mutans UA159
MTTGKEYVASVFEKVKAQNAHEPEFLQAVEEVFESLIPVFDNYPKYIEENLLERLVEPERIVSFRVPWVDDKGQVQVNRGFRVQFSSAIGPYKGGLRFHPSVNQSIIKFLGFEQIFKNSLTGQPIGGGKGGSNFDPKGKSDNEIMRFCQSFMTELSKHIGADTDVPAGDIGVGGREIGYLYGQYKRLRNEYTGVLTGKGLTWGGSLARTEATGYGAVYFAEQMLKARGQDFAGKTAIVSGSGNVAIYATEKLQTLGAKVVAVSDSSGYVYDPDGIDVALLKELKEVQRARIIKYADARPNASFTPAGGDSIWTIKADLAFPCATQNELNEADAKTLVANGVIAVSEGANMPSTLEAIDVFLKAGVSFGPAKAANAGGVAVSALEMAQNSQRTAWTFEEVDRKLYDIMKGIYDNSAAAAKSFGQEGNLVVGANIAGFLKVADAMSAQGIV

SEQ ID NO: 8577 - protein, 550 aa, Cryptococcus neoformans var. neoformans B-3501A
MGGGAPAGGDFEALLTQRQNEGWRGLFKNGRALGLACFASLGGVLYGYNQGVFGQVQVMYNFEQRYTATLTNPDTKGLLTSILELAAFVGALMAGPLSDRYSRKYSISAWCVVFMMGTAIQTGANSNVACIYAGRWFAGMGVGALSMLVPMFNAELAPPGIRGSLVALQQLAITFGILISYWIGYGTNYIGGTGAGQTTAAWRIPLGLQLIPGVVLCVGACFLPFSPRWLMLRGREEECLTNLARLRSSTEEAPEIQYEFRALQAERLVEREAAKERYGQEDVNFRVTMLEYKRLFTTRPLLHRLMLGAGAQALQQWTGINAIIYYAPTIFAQIGLTGSGASGTISLLATGIVGVVNFVFTIPAVLFVDNFGRRPLLAWGEANMAISHAIIAAIVAEFGDRFDSNKKAGNAAVFFIYWYIANFAVTWGPLAWVVSAEVFPLDMRAKGMSISSGVNWLMNFTVAMVTPHMIDNIGYKTYIVFMCFCVVGFLYSIFILPELKGLSLEEVDRVFHDESGAEDRARRERVAAQIGLDKVAEQIQHKEKVNDSEA

SEQ ID NO: 8578 - protein, 489 aa, Cryptococcus neoformans var. neoformans B-3501A
MGGGAPAGGDFEALLTQRQNEGWRGLFKNGRALGLACFASLGGVLYGYNQGVFGQVQVMYNFEQRYTATLTNPDTKGLLTSILELAAFVGALMAGPLSDRYSRKYSISAWCVVFMMGTAIQTGANSNVACIYAGRWFAGMGVGALSMLVPMFNAELAPPGIRGSLVALQQLAITFGILISYWIGYGTNYIGGTGAGQTTAAWRIPLGLQLIPGVVLCVGACFLPFSPRWLMLRGREEECLTNLARLRSSTEEAPEIQYEFRALQAERLVEREAAKERYGQEDVNFRVTMLEYKRLFTTRPLLHRLMLGAGAQALQQWTGINAIIYYAPTIFAQIGLTGSGASGTISLLATGIVGVVNFVFTIPAVLFVDNFGRRPLLAWGEANMAISHAIIAAIVAEFGDRFDSNKKAGNAAVFFIYWYIANFAVTWGPLAWVVSAEVFPLDMRAKGMSISSGVNWLVSLLLQRVSFRIALIIAVDELHCRYGYPSHDR

SEQ ID NO: 8579 - protein, 491 aa, Rhizobium sp. NGR234
MTLTSALTRHLKCPELFRNLANEPHPSVAGQRQRFSVFNPSTGELLAEVPDMGAADAHAAIERADAAQEPWSGLTARARSDILWKWHRFILEHSDDLAAILTAEMGKPLGEAKSEVQHAAAYLQWYAEEANRIYGETISAPSTDRRMLVIKQPIGVVGAITPWNFPASMVARKISPALAAGCTVVLKPAEQTPLVAGAMFALAKLAGFPDGVLNLVYASEGDAIGRELCTNPKVRKISFTGSTEVGRLLMRQCSDQIKRISFELGGNAPFIVFDDADIDAAVDGAIQAKFRNAGQTCVSANRIYVQSGVYAEFAEKFTERVRTLKVGDGFDPNVAIGPLINQEALKKIELHISDAVQKGARVRSGGRRTGSSGTFFEPTVVTDVSKTMRLAEEETFGPLAPLLRFDDADHVVREANDTIYGLAAYFYASNLKRVWRVAEALEYGMVGINTGRMSSEAAPFGGVKQSGIGREGSRHGLEDYLDMKYLCVGGL

SEQ ID NO: 8580 - protein, 126 aa, Rhizobium sp. NGR234
MIEPISTNDAPGAVGPYSQAIKVGDLLFVSGQLPIDPATGEFNSANAVEQAEQCLKNLQAIARAAGTDLSKTVKTTVLLTDLGDFADINRVYTGFFSTPYPARACYEVKALPKGAKVEIEAVISLT

SEQ ID NO: 8581 - protein, 550 aa, Photobacterium sp. SKA34
MLKNINPTQTQAWQDLTAHFEQAQDFQLSDLFANDSARFSKFSAQFGSDILLDYSKNLITEETLTKLFALAKETELDVAIADMFSGEKINRTEDRAVLHVALRNRSNTPIMVDGEDVMPAVNAVLEKMKSFSDRIISGEWKGYTGKEITDIVNIGIGGSDLGPYMVSEALGAYKTRLNMHFVSNVDGTHIAETLKDLNPETTLFLIASKTFTTQETMTNALSARDWFLAKAEDKAHVAKHFAALSTNGEAVAEFGIDTDNMFEFWDWVGGRYSLWSAIGLSISLSVGFDNFVALLDGGHAMDKHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRPTNSILVKEITPYTLGALIALYEHKIFTQGVIWNIFSFDQWGVELGKQLANQILPELNNKEEVSSHDSSTNGLINAFKQWRA

SEQ ID NO: 8582 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSGMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 8583 - protein, 316 aa, Oryza sativa (japonica cultivar-group)
MAPPQLAGKMTAKAAAAVKPATRAYVTFLAGDGDYWKGVVGLAKGLRKVGSAYPLVVAVLPDVPESHRRILISQGCIVREIEPVYPPENQTQFAMAYYVINYSKLRIWEFVEYERMVYLDADIQVFDNIDELFELPKGHFYAVMDCFCEKTWSHTPQYQIGYCQQCPDKVAWPTAELGPPPALYFNAGMFVHEPSMATAKEQYKPIPLIYNLVLAMLWRHPENVQLEKVKVVHYCAAGSKPWRYTGKEANMDREDIKMLVKKWWDVYNDGSLDFKGLPPIAAADDADEVEAAAKKPLRAALAEARTVKYVTAPSAA

SEQ ID NO: 8584 - protein, 104 aa, Triticum aestivum
QFALQIRAVGACGYVLVSSFLIRENILQLITVNVHASLTYILAAAGVNAIPSMDAIYVIFGTLLLLNCGFFVFILHIIYTIFLTKLGIKPSLRPPRWLGKTTFS

SEQ ID NO: 8585 - protein, 146 aa, Pseudomonas syringae pv. syringae B728a
MKTVAQLLKLKDLQNQQVHTIGPDQMVLDALKLMAEKNIGALPVVEGNVVVGVISERDYARKVVLKGRSSVGTPVRDIMSSKVITVDSQRSVEACMGIMTDSHLRHLPVVEGGQLLGLLSIGDLVKEAIAEQANLIQQLEQYIRGE

SEQ ID NO: 8586 - protein, 454 aa, Haloferax volcanii
MTEDNALTDGGLSDEAQAVIDEIEEKNVDFLRLQFTDILGTVKNVSIPASQAEKAFTEGIYFDGSSIDGFVRIQESDMRLEPDPSTFAVLPWRKKENSAAGRLICDVFNTSTGEPFSGDPRGVLKRAIEPEELGYDVNVAPEPEFFLFEEDEDGRATTVTNDAGGYFDLAPKDLASDVRRDIIYGLESMGFDIEASHHEVAEGQHEINFTYDDALSTADNVRTFRSVVRAIAAEHDLHATFMPKPIPRINGSGMHTHISLFKDGENAFHDGDDEFDLSDTAKSFVAGILDHAPAITASLTRRSTPTRRLVPGYEAPVYIAWSDRNRSALIRKPAARTPAASRIEARFPDPSCNPYLAFAALIHAGLDGVEKGLDCPDPVRENIYEFDEAKREEYGIETLPKTSAARRRPRRDEVIQEALGDHVFEKFVEAKRSEFKDYLVDVSQWELDRYLETF

SEQ ID NO: 8587 - protein, 468 aa, Pseudomonas syringae pv. tabaci
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMSKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 8588 - protein, 104 aa, Glycine max
  misc_feature (81)..(81): Xaa can be any naturally occurring amino acid
MATLDSDVPMVPAGEPSSSAGPSSKKPKRFEIKKWNAVALWAWDIVVDNCAICRNPIMDLCIEGQANQASATSEECTVAWXRWLKTRQVCPLDNSEWEFQKYGH

SEQ ID NO: 8589 - protein, 493 aa, Catharanthus roseus
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 8590 - protein, 196 aa, Zea mays
VLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKSLEGAFVLNQHQPAEHDESSSQTDVTV

SEQ ID NO: 8591 - protein, 316 aa, Ustilago maydis 521
MSTWNKHYHWKTKGCTPWAKNHITEATVGKSVSVGKSGQVKVDRLSSFEGDVELGNRKGKLITIYDCAITYAWSGTSDDGTEASGTITFPEVSHEIEDEGDEYQFETEMSTKPSAEANQLYDAVRKELAPSLRLVFHAFRQNLIDAHAKDLGHDSPASTPGAATPTASVAASAGAPAAPSSQAKATVSSSSSDVRVSSELAISTSDLWDLLTNPSRIPMWTRAPAKFEPKADAEFALFGGNVIGKVVSVDAPKQLIQKWRTPQFPEGYYGTLAINLTEGGDSTKLELVLSGAPSGDEEIVEKNLETYYIRGLKSMG

SEQ ID NO: 8592 - protein, 151 aa, Triticum aestivum
GVCPICATRVGMDLIGHLTMQHGSYFKMQRRRRVRKVSTGSHSLLSLLRKDLRNGSLQSFLGGSSYVSNPPAAAPDPFLSSLICSLPVAEPSKDLHSDSSDNNFLLNKFPDEKTVERAEPSLSEKDQKERIQRSKFVRGLVLSTIFDDDNL

SEQ ID NO: 8593 - protein, 486 aa, Synechococcus sp. WH 8102
MWMAGGFTEQSQRFRPSSKEEHVVQKAEEHFERTLITIRGELAGSVAALEHPSDDEALNYGEIFLRDNVPVMIYLLLKRRFSIVRQFLTVCLDLQSTSVQTRGVFPTSFVEENEELVADYGQRSIGRITSVDASLWWPILCWIYVKRSGDTEFGRSAEVQRGLQLLLDLVLHPSFEGTPVLFVPDCAFMIDRPMDVWGAPLEVEVLLFAALRSSIELMELCQRHESSVLLEERLRLSRRWMHDLRQYLLKHYWVTSKTMQVLRRRPTEQYGDNQYQNEFNVQPQVIPDWLQDWLDNRGGYLIGNMRTGRPDFRFYSLGNSLACLFGLLTAPQQRALFRLVQHNRQHLMAQMPMRICHPPMEGVEWENKTGSDPKNWPWSYHNGGHWPSLLWYFGGSILLHERIHPHADMLLMTQMKTLVEECYWSQLNQLPRQQWAEYFDGPTGTWVGQQSRTYQTWTIVGFLLLHHFLRVEPNDVLMLHLDAGLS

SEQ ID NO: 8594 - protein, 546 aa, Cryptococcus neoformans var. neoformans B-3501A
MPVFSTLINSTESYQRRFDQMARAVLVYWVLKYVLLDGFRHIKARGLCGTANEIRNKIKSLVVRIMLAFPSNRAKLNSELAKTRAELKEKLAPSQYPDGVRLTTVRTLPETGRGREWLESEWENLKKLEKADVDNGRVSGAVYHGGDELNAVINEAMAKFVVTNPLHPDVFPGVRKMESEIVSMCLNLFNGPNGAGTTTSGGTESILMSVKTHRDWARVTKGITRPEMVIPSSAHAAFWKASEYFNIKLHVIPVNQKTRKAEVTAMKRAINPNTIMIVGSAPNFPDGAIDPIPELGALAKRRNVGLHVDCCLGSFIMPFLEKAGFSEGIDPFDFRVPGVTSISCDTHKYAFCPKGTSVIMYRSSELRRFQYYVITDWAGGVYASPSMAGSRPGSVLAGAWAVLNHIGADGYTSSCRQIISAARYLTSSLRTLFPDDLYVLGDPKGPVVAFNSKTINIYAVGDVMSKKGWHLSALGGDGGLHMAFTRLSAKSVDKLIEDLGDALKEVKASPQGAGGDMVALYGLGQTSAGPHVVGKLAETFLDTLYE

SEQ ID NO: 8595 - protein, 149 aa, Brassica napus
  misc_feature (146)..(146): Xaa can be any naturally occurring amino acid
MEYSGDHRFDVIIVGAGVMGSSAAYQLAKRGHKTLLLEQFDFLHHRGSSHGESRTIRATYPEDYYYTMVSESAQLWAQAQSEIGYKVHFPTQQFDMGPKDQQSLLSVVATCRKHGLAHRVMDSKTVSEYFSGRINIPESWIGVSTXLGG

SEQ ID NO: 8596 - protein, 614 aa, Novosphingobium aromaticivorans DSM 12444
MSLPLRNIAIIAHVDHGKTTLVDQLFRQSGTFRDNQRVEERAMDSNDLEKERGITILAKCTSVEWTSPTSGETTRINIVDTPGHADFGGEVERILSMVDGVILLVDSSEGAMPQTKFVTGKALALGLKPIVVVNKIDRPDGRAQEVLDEVFDLFVSLDANDEQLEFPVLYASGRNGYASDNEEAREGTLEPLFEKIVSHVPAPNLDVDGPFSFLATLLDRDNFMGRVLTGRVQSGTIKVNQPIHALDADGKVIEVGRASKLMSFNGLDRVPVEEAKAGDIIALAGLEKATVANTIADPSVTEPIASQPIDPPTLAMRFAVNDSPFAGREGDKVTSRMIRDRLLREAETNVAIRVTESADKDSFEVAGRGELQLGVLIETMRREGFELGISRPRVLFQTDENGQRTEPYETVVIDVDDEFSGTVVEKMQRRKAELTDMRPSGAGKTRILFSAPSRGLIGYHGEFLSDTRGTGIMNRLFEKYGPHKGPIEGRQNGVLISNGTGEAVGYALNSLEDRGILFVRPQDKIYEGMIIGENAKPEDLEVNPMKSKQLTNFRSTGKDDAIRLTPPKIMTLEQAIAYIDDDEMVEVTPKTIRLRKAILDPNERKKASRKKEAA

SEQ ID NO: 8597 - protein, 172 aa, Clostridium tetani E88
MDLKDKIRVIQGFPKEGISFKDVTTILQEKEAFKYTIDTLVEELKDKNVDVVVGPEARGFLFGAPLAYALGAGFVPVRKKGKLPSTTISSKYELEYGSDELEMHKDSIKPGQRVVIADDLLATGGTICSVIEMIESLGGEIVSINFLIELTDLKGREKLGKYDISSLVQYDI

SEQ ID NO: 8598 - protein, 411 aa, Zea mays
MNALAATSRNFKQAAKLVGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRRVLFATEALLAEHGKGIAGQRFVIQGFGNVGSWAAQLISEAGGKVIAISDVTGAVKNVGGLDIAEVVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELQTYMTRAFGDVKQMCRSHSCDLRMGAFTLGVNRVARATVLRGWEA

SEQ ID NO: 8599 - protein, 472 aa, Neisseria gonorrhoeae FA 1090
MSIKNAVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 8600 - protein, 445 aa, Lactobacillus delbrueckii subsp. bulgaricus
MSKVITEEEIRKDVEEKNVRFLRLAFTDINGTLKNLEVPVSQLDDVLGNQTRFDGSSIDGFVRLEESDMVLYPDLATWLVLAWTTVEEGTIGRLVCSVHNVDGTPFEGDPRNNLKKVIAEMEEMGFSDFEIGFEAEFFLFKEGKNGEETTKVSDHSSYFDMASEDEGAKCRREIVETLEKLGFRVEAAHHEVGDGQQEIDFRFDNALATADKLQTFKMVVKTIARKYHLHASFMAKPVEGLAGNGMHTNMSLLKDGKNAFYDKDGQYNLSTTALTFLNGILEHARAITCVANPTVNSYKRLIPGFEAPVYISWASRNRSPMVRIPNANEVGTRLEMRSTDPTANPYLLLSACLKAGLTGIKEGKLPMAPVTSNLFEMTDDERKELGIKPLPSTLHNAIKAFKEDEVVKSAFSEHIVDSFLELKETEWALYTQSVSEWEVKRYFNY

SEQ ID NO: 8601 - protein, 467 aa, Rhodobacter sphaeroides
MSKVADALKLMKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGAAVKAEAYLKASGIGDVAYFGPEAEFFIFDDVRYSVTPAKVAYQIDADAGAWNTDSEYEMGNLAHRAGHKGGYFPVNPIDEAQDLRGEMLSTMKRMGMKVDKHHHEVATCQHELGLIFGGLTEQADNILKYKYVIHNVAGMHGKTVTFMPKPMKGDNGSGMHVNMSIWKEQALFAGDKYADLSQEALWFIGGILKQPSVNALTNPATNSYKRLIPGFEAPVLRAYSARNRSGCVRIPWTESPNAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 8602 - protein, 388 aa, Pseudomonas aeruginosa PAO1
MRALTFHGSHDVRIDRVAEPRLQEPDDLLLRVTATAICGSDLHLYRGKIPMVEQGDILGHEFMGVVEEVGSAVTAVRPGDRVVVPFVIACGECFFCRLNLHAACETTNPGRGAILNKKQIPPGAALYGYSHLYGGVPGGQAEYVRVPKANSGPFVIPDVMEDERVLFLSDILSTGYQAVRNAGVRQGSSVAIYGAGPVGLMAAACARMLGAERIFIVDHHPYRLDFAARTYGAIPIDFDQEDDPAAAIIERTDGHRGVDAVIDAVGFEAKGSVTETVLTALKLEASSGKALRQCIAAVRRGGTVSVPGVYAGFIHGFLFGDAFDKGLTFKMGQTHVQALLPALLEHIGNGDLHPEAIISHRLRLDDAPEGYALFDEKREDCRKVVLRP

SEQ ID NO: 8603 - protein, 209 aa, Brassica napus
MAGMIMMNEHVAEKLCSELQELEREKAEETNTPLRQYDTEDFKSFNERVTQFAGMLSYDSLGKLHYLHAVVTETLRLYPAVPQDPKGVLEDDILPNGTKVKAGGMVTYVPYSMGRMEYNWGSDAAMFKPERWLKDGMFQNASPFKFTAFQAGPRICLGKDSAYLQMKMAMAILCRFYRFHLVPNHPVKYRMMTILSMAHGLKVTVSRRS

SEQ ID NO: 8604 - protein, 364 aa, Oryza sativa
MSQPKTHKIALLPGDGIGPEVCAEAVKVLEAVGALRGHTFAFERALCGGASYDVHQSHLPQETIDIVARSDAVLFGSVGGPPDAQEDPKWKDAEKNCLLGLRKNFGLAVNIRPAKIYSMLPDLSPLKPSLIASGVDMVIVRELISGIYFGEHATNGDVATDVMRYTEAEIKIPMRFAFETAMSRTKKLTVVDKANVLDCSRLWRKVAKEMHAEFPQVALEFMYIDNAVMQIIQKPSHFDVIATGNMFGDILSDAASVLPGSLGLMPSASLGDKIHLFEPIGGSAPDIAGKGVANPIAQILSAALLLRYSFALEAEAQLIEKAVEDVLQDGLRTGDLTHDRASAVGTAAMGDAIVAKIHALHQQQ

SEQ ID NO: 8605 - protein, 113 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGHGLNEPVQTKPGV

SEQ ID NO: 8606 - protein, 269 aa, Neisseria gonorrhoeae FA 1090
MHALPRYAVFGNPAAHSKSPQIHQQFALQEGVDIEYGRICADIGGFAQAVSTFFETGGCGANVTVPFKQEAFHLADEHSDRALAAGAVNTLVWLEDGRIRGDNTDGIGLANDITQVKNIAIEGKTILLLGAGGAVRGVIPVLKEHRPARIVIANRTRAKAEELARLFGIEAVPMADVNGGFDIIINGTSGGLSGQLPAVSPKIFRDCRLAYDMVYGEAAKPFLDFARQSGAKKTADGLGMLVGQAAASYALWRGFKPDIRPVIEHMKAL

SEQ ID NO: 8607 - protein, 412 aa, Rhodococcus erythropolis
MTSDIVVIGGGVAGVSAVQSLRSEGYDGRLFLIGKERELPYDRTSLSKAVLAGDLADPPPLAPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTALEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 8608 - protein, 120 aa, Odontella sinensis
MLSLNTQKTIDNLHNVFTKKNIPPIRIGDNVKVGVRIIEGNKERVQFYEGTVIAKKNSSINTTLTVRKVLQGIGVERIFLIHSPKVDSIEVLRSSKVRRSKLYYLRNLKGKASRLKQQFR

SEQ ID NO: 8609 - protein, 165 aa, Oryza sativa
CPVCRFVVIPEAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDG

SEQ ID NO: 8610 - protein, 351 aa, Neisseria gonorrhoeae FA 1090
MDGRGLKAYATPIRKFWVVLLQQRRMAMAENEKYLDWAREVLHTEAEGLREIAAELDENFVLAADALLHCKGRVVITGMGKSGHIGRKMAATMASTGTPAFFVHPAEAAHGDLGMIVDNDVVAAISNSGESDEITAIIPALKRKDITLVCITARPDSTMARHADIHITASVSQEACPLGLAPTTSTTAVMALGDALAVVLLRARAFTPDDFALIHPAGSLGKRLLLRVADIMHKGGGLPAVRLGTPLKGAIVSMSEKGLGMLAVTDGQGCLKGVFTDGDLRRLFQECDNFTGLSIDEVMHTHPKTISAERLATEALKVMQANHVNGLLVTDADGVLTGALNMHDLLAARIV

SEQ ID NO: 8611 - protein, 120 aa, Hyacinthus orientalis
GSNYYACLSMLSLLILTPFAIAERAPSMWAVGWQNAMSQIGPNFIWWVAAQSIFYHLYNQVSYMSLDEISPLTFSIGNTMKRISVIVSSIIIFHTPVQPVNALGAAIAILGTFLYSQAKQ

SEQ ID NO: 8612 - protein, 467 aa, Rhizobium sp. NGR234
MTIDIKDISEKDRNTVLHPFTQLKDFATGKLREPTIVETGKGIRIQDARGNQLIDGFAGLYCVNVGYGRTEVAEAISRQAYRLAYYHSYAAHTTDELAILSDRLVKMAPGKMSKVFYGMSGSDANETQAKLVWYYNNLRGKPTKKKIISRERGYHGCSVVSGSMTGMSFYHDHMDLPLPQICHTGVPHHYWGANPGETEREFSARRAAELDEMIETLGPDNVGAFIAEPVLGTGGITPPPEGYWEAIQAVLKKHDVLLIADEVITGFGRTGSMFGSQHYGIEPDLITVAKGLTSAYFPLSASIVGEKVYKVLEDGADRVGAFSHGYTYSGHPIGAAAANAVLDIVEKEDLPGNAREVGGYFQAQLKEKFAQLPIVGEVRGVGLMGAIEFVGDRENKKRFDPLLKVGARVSKAARDRGLIARAMPHGDILGFAPPLVTTKEEVDEIVAMAEKAVRSVMDELVRDGQKL

SEQ ID NO: 8613 - protein, 512 aa, Rhizobium sp. NGR234
MDAGRRRLVINDCMKPERGRRSPLPRRPTRPPDERSSGIGNLAMTPAKLHMTTSLAPIAVHSPYDGSLLGSVEATDPADIDRLLATARRGAEISRNLPRHKRASILEGAAQMVESRHDAFAEIIVREAGKTIVQARKEVLRCVNTLKLSAEEAKRNAGEIVPFDAYTGSEQRQGWFTRDPLGIITAITPYNDPLNLVAHKLGPAIAGGNAVMLKPSNLTPFSAIKLVGALREAGLPEEVITISHGDRELVTAMIAAREVRMVSFTGGFATGEAISRAAGLKKLAMELGGNAPVIVMNDCDFDKAVEGCVSGAFWAAGQNCIGAQRILIQSELYGRFRDAFVAATKKLKAGDPLQEDTDVGPMISKQVAERTEAAVNEAIKAGATLLCGNYREGSLYHPTVLEGTPLTCRLWHEEVFAPVVMLAPFDTLDKGIEMANDPDYSLHAGIFTNDLNVALEAANRIEVGGVMINDSSDYRFDAMPFGGFKYGSMGREGVRFAYEDMTQPKVVCINRG

SEQ ID NO: 8614 - protein, 272 aa, Zea mays
TVDERSYELLLVPCLFKENKKPSAEGAAAAPQPANRGAARVAGKQNAAAAAAGTRRALGDIGNVVSDALDRAIKLPEGIHRPITRSFGAQLMKAALANKNADAAVAPAQPVAARAVTKPARKVTTKNVPRPGAGQAPKAACGLTEKPKEPIEDIDKFDGDNQLALVDYVEDIYTFYKTAQHESRPIDYMGNQPELSPRMRSILADWLIESHRRFQLMPETLYLTIYIVDRYLSLQPTPRRELQLVGVAALLIACKYEEIWAPEVNDLIHIAD

SEQ ID NO: 8615 - protein, 859 aa, Candida albicans SC5314
MRSRFFGKVHDTFISIRIFYNDFTTIDWTKAYLKGNQFNYSIEKKQWIGDDSVNDGQAIPFLHRAYYTLGKWFLILIIAFFFSIIAFCIDKVEILLVGFKHGYCRSNWFASQISCCIDNPKKLNVFKSGYVTNNTCDNWVSWNKFFHEHWLNTMRFDFIIYVVLTILLAMFACLITLSTKITGGSIPEDQSNHGKEIHADDNENATNQGRSVSVKPRVIYTATGSGVPEVKTILSGFVIRRFLGTYTLIAKTVALVFAIASGMSLGKEGPYVHLATCVGNITSRFFPFIYENDFFEKQILSASASAGVALAFGSPLGGVLFILEEINNYLPSNQLFQIFFCAIISTLFLKFLNPYGTGKTVFFELEYFSDWSPMELIFFVVIGIMGGVFGASFIKFSQWWAKKFRSNKHIKTHPIFEVFLVAAVTGIISFWNPYTKQASAELVLDLATPCSGGELDRSLCPQTEKQLLNELASLLFAFVVKVFLTFITFGLKLPCGIYVPSMVCGALFGRIFALFIRWLEFLSRKSSSSSSAFSTLSLPAPPLEFGLLCSSAGPHCVDMGIYAMISAGAFMAGVTRMNITLVTILFELTSSYTYVLPISIAIAVANWSGGLLEKNSLYESLLISNDYPFMAPETEPIDPYVSAGDIINQDSVPTTRISRHIPPDRQLYIDVSDSGYVPVSTLESKLQMLADRCLLDGCIALIKNQLCVGLLFFSELEICLDQIRAFTLKHDVKEELYCNLFDDDDGDGGGVDNKSLSKSRAMHNDKVVKNILNQSLDYFNYGAINEDEYLEIKSSIDVLTNLTNFVDRVPMFINYDTELCFAHLIFDRIGNRVIVLIKDGKYYGVLHKKVLIDYLRRTE

SEQ ID NO: 8616 - protein, 386 aa, Oryza sativa (japonica cultivar-group)
MATRKNAEQRRGEAASVTSRHRVFAEDLLLPREAEGEDHFDRVPDSLVLLIFNRLADARSLGRCSAVSKRFNSLVPLVDDACLRIDRVITDAADADDALGLAGPRPAGRGVLSHLLKAMLLAVLKPFGHCDAGVRGGGGGERAGKHGGGGGGCGAQQHHSPAQLPVSDVGTDDGVLLRWKAVFGSTLQSCVILGGTRVDRAAAPAAAAATATAAGDSEASQGDDTGSIPESFYTNGGLKLRVVWTISSLIAAATRHYLLREIVKEHPTLERVALTDAHGQGTLSMGRDQIREFRDKPLAAAAAANRTQVPACNMKLRYAPMLELSDGTRIQGATLVVIKPVGEAGGIGGGRKELDEFVADAFDGPYREAVSALSKRRTYLLEMNGF

SEQ ID NO: 8617 - protein, 138 aa, Leptospira interrogans serovar Lai str. 56601
MQSEVFKDPIVFFDGICNLCNSVVLFFLDRNRKGNLKFASLQSMAAERILGKKVGLNDSPSSVLFLEDGILYQKSNAILKISAHLCFPWNIFPLFKWVPGCIRDYIYDWIARNRYRWFGRLEICRIPDPSLKHRFLDD

SEQ ID NO: 8618 - protein, 524 aa, Candida glabrata CBS 138
MLSVLSKTTVIKRAPGAIALFPRYNSTSSKPKETQGVEKKGTGPTSFKTMKVIDPNSRDKPNVVILGSGWGAISFLKHIDTKKYNVSIVSPRNYFLFTPLLPSAPVGTVDEKSIIEPVVNFALKKKGNVTYYEAEATSINPDRNTVTVNEVSAVEQVALGNKESEQEIGIERKSDAEIKYDYLITAVGAEPNTFNIPGVEKYGNFLKEIPHSLQIRKRFLENIQKANLLPKGDPERKRLMSIVVVGGGPTGVETAGELQDFVHQELGKFLPSLAEDVQIHLVEALPIVLNMFEKKLSSYAQSVLEDTSIKLHLRTAVSKVEETQLLAKTKHEDGSVTEETIPYGTLIWATGNKCRPIITDLFKKIPEQNTSTRALNINSFLQVQGSNNIFAIGDNAFCGLPPTAQVAHQQAEYLAKTFDKMAQLPNFHKSLAERKEKADLLFEENNFKPFKYTHLGALAYLGSERAIANITYGKRSLYTGGGLFTFYIWRLSYLAMLLSARLKFKVVSDWLKLAFFRRDFFKDL

SEQ ID NO: 8619 - protein, 345 aa, Pseudomonas aeruginosa PAO1
MSQSTQVNRRIVLASRPHGAPTRDNFRIEQVPLPEPGAGQVLLRTVYLSLDPYMRGRMSDAPSYAPPVELGAVMVGGTVSRVEASNHPGFKVGDWVLSANGWQDYALSDGSGLARLGESPEHPSYALGLLGMPGFTAYMGLLDIGKPQAGETLVVAAATGPVGATVGQIGKLKGCRVVGVAGGAEKCRHAVQVLGFDACLDHHAADFAERLAEACPDGIDIYYENVGGKVFDAVFPLLNAKARIPVCGIVAHYNDTELPPGPDRLPALMGTILRKRIKVQGFIIFDDYGHRYDEFQRDMSKWFADGLIQYREERVDGLENAPEAFFGLLQGRNFGKLVVRVGADA

SEQ ID NO: 8620 - protein, 433 aa, Oryza sativa (japonica cultivar-group)
MPASPKEAQSRAGAGVRMISSEELRAHASRDDLWISISGDVYDVTAWVPHHPGGDIPLLTLAGQDATDAFAAYHPPSARPLLGSSPPPGLFERVGPTPKVQVAGMLLLLCAALYCVLACASAWAHLLAGGLIGFIWIQSGWMGHDSGHHRITGHAALDRLLQVLSGNCLTGLSIAWWKCNHNTHHIACNSLDHDPDLQHMPLFAVSSKLFGLWSYFYQRTLVFDAASKFLISYQHWTFYPVMCFARINLLIQSAVFLLSSRKVPQRGLEIAGVAAFWVWYPMVVSCLPNWWERVAFVVASFVITGIQHVQFCLNHFSSEVYVGPPKGNDWFEKQTAGTLDIQCSPWMDWFHGGLQFQIEHHLFPRLPRCHLRKVSPFVRDLCKKHGLPYAAASFWQANVLTWKTLRAAALQARKATSGAAPKNLVWEAVNTHG

SEQ ID NO: 8621 - protein, 308 aa, Triticum aestivum
  misc_feature (270)..(270): Xaa can be any naturally occurring amino acid
  misc_feature (278)..(278): Xaa can be any naturally occurring amino acid
MSPPENPNGGAAAAAPSEPAPPAKPSSSKGKKKDDKKDDDLSEEDLALKEQLELYVVRAQDVDPGVQRLALESMRQEIRSATSSMTSVPKPLKFLRPHYGTLKSYYETMPESELKKYMADILSVLALTMSAEGERESLRYRLLGSEGDIGSWGHEYVRNLAGEIAQEFEKRQGDDMPIDELMELVQQIVSFHMKHNAEPEAVDLLMEVEDLDLLVEHVDSTNYKRTCLYLTSSSRFLSSPDDTLALDIAYTIYMKFEDSASALRIALLLXNKYVKQVXTSTDDLVLKSHSHKSLPPCLGMEMMIRTPQ

SEQ ID NO: 8622 - protein, 544 aa, Novosphingobium aromaticivorans DSM 12444
MYQYDSYDQAMVDARVAEFRDQVQRRLAGDITEDQFKPLRLKNGLYLQLHAYMLRVAVPYGTLNSRQMRMLGDIADKYDRGYGHFTTRQNIQYNWIKLEDAPDILADLASVEMHAIQTSGNCIRNTTADQFAGAAADELVDPRPYAELLRQWSTFHPEFDYLPRKFKIAIIGSETDRAAMKLHDIGIQLVKNDAGEIGCRFYVGGGMGRTPMIAPVIGDFVPPLQMISYAEACLRVYNRYGRRDNKYKARIKILVHEIGADEYRRQVEEEFKHILTLGLEPPAAELERIKGFFEQPGFDANASDELDLSDPDFALWVDQNVHAHKAKGYAIVNISLKPVGGIPGDATADQIRLMADLALEHSFDELRVTHAQNIVLPHVKKADLHAIWQKLDAAGLANANLDLIGDIIACPGLDYCSLANARSIPVAQKISERFADLGRQRELGELKLKISGCINACGHHHAGHIGILGVDRKGVENYQLLLGGCEGADTSLGTITGPGFNEDGIVDAVEKATDVYLAQRAEGERFVDTYRRIGMAPFKEAIYG

SEQ ID NO: 8623 - protein, 384 aa, Staphylococcus aureus subsp. aureus COL
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 8624 - protein, 524 aa, Hevea brasiliensis
MASSVLPSPSLQSQFMSLRSSTKPYSRRSSLSPIKASVSEKPSIGISSPTVSPTDSSKLPLRKIPGDYGLPFIGPINDRLDYFYKQGKEEYFKSRAQKYQSTVFRANMPPGPFISSNPHVVVVLDGKSFSVLFDVTKVEKKDLFTGTFMPSTDLTGGYRILSYLDPSETKHGQLKQLLFYLLKSRRDYVIPEFSSTYSQLFESLEKDLASKGKVSFNDPGEQAAFSFLGRCYFGVNPVDTKVGTDGPTLIAKWVLFQLAPILTLGLPAFIEEPTIHTFRLPAFIIKKDYQRLYDYFYSSGGSVLDEAERMGLTREEACHNILFATCFNTFGGLKIFFPNVLKWIGRAGVKLHTQLAQEIRSVIKSNGGQITMAALEQMPLMKSAVYEAFRIEPPVPAQYGRAKRDLIIESHDAAFGVKEGQMIFGYQPFATKDPKIFDRPEEYVPDRFVGEGEKLLKHVLWSNGPETEHPTVGNKQSAGRDFVVFISRLFVVELFRRYDSFEIEVGSSALGSSITITSLKRASF

SEQ ID NO: 8625 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 8626 - protein, 494 aa, Photobacterium sp. SKA34
MITHDIPLSLYTAEQIRQGEQLLIDQRNSVTLYHLMERAGEATFDLMGQRYPQCKKLLVCCGKGNNGGDGYVVARLAHELGVDVTVWEFPNVEHLPADARCARSHWLQCNGKTITDTPTTSYELIIDALLGIGVKGEVRSEIADRIRWINHQMMPVIAVDVPSGLCANTGATFGAVIKASQTLSFIGFKQGLTTGQAAEYCGERYFSDLGFALQFAQVMKPSALHVTESQVQPLLFPRSRVAHKGCFGRVLCIGGDLGMAGAIRLSSEACARSGAGLTAVITRPDNALSIVMMRPEIMAIGWQESSNILVDKLTWSDVVVLGPGLGTTDWGQSLFAQCHHIDKPCVVDADGLNLLAKAPDYRDNRIITPHPGEAARLLNVSIDEIEADRFAAVQRLQQNYGGVVVLKGTGSLIYDGKTLWICTCGNPGMATGGMGDVLSGIIGALLGQGLALVEAAYAGVWIHSRAADLCAQSGERGMLASDLFPFIRQLVNPR

SEQ ID NO: 8627 - protein, 197 aa, Streptococcus mutans UA159
MSEFLNTHNASILLSAVNKSHYPQDDLPEIALAGRSNVGKSSFINTLLGRKNLARTSSKPGKTQSLNFYNIDDKLRFVDVPGYGYAKVSKKERAKWGKMIEEYLTSRENLRAVVSLVDFRHDPSSDDVQMYDFLKYYEIPVILVATKADKVPRGKWNKQESAIKKKLDFDSNDAFIIFSSVDRTGLDTSWDAILESL

SEQ ID NO: 8628 - protein, 443 aa, Rhizobium sp. NGR234
MSFLDLPEGLPERIIQCNSPYTVRFGVRLRGRMYSFIGWRSVREHCEPVKGDIRYASNADAEEVEALAALMTLKCSLVDVPFGGSKGALKIDPRGWTPQELEHITRRFTQEMNKRPDRARRQCVGSDIGTGEREMAWMMDEFRRANPTDVVTSGACVTGKPLSKGGIAGRAESTGRGVQFAIQSSLRDTRTPGLDGRRNLKGASTVIQGFGNVGYHAARFLSEEDDARVTVLAERDGYVANPEGLSIEALKQHQIRTGSILGFDGAKSIAGDMCGVEQPCDVLIPAAMENAIHAENAERMKAHLVVEAANGPVTFEADEILRSRGVTILPDLYVNAGGVVVSYFERVKNLTHIPFGLMERRRRERGNHTIATALERMTGKESPADMRDEFLEGGAEIDLVRSGLEDVMRSTWTRIADLMEQQPELGDYRTAAYVASIRQVADL

SEQ ID NO: 8629 - protein, 458 aa, Streptococcus mutans UA159
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 8630 - protein, 147 aa, Hyacinthus orientalis
FQLSEMLHVQLLLPVLGEEEKLKQLRVRDFAGEKVEMKKLVDVNCKEAAEKAKVQGAPPSALDNILEQIKKRPKLSVLDKTKKDWGEFKEENKGVEDQLDAYKKSSNQYLDRVSFLQRTDMREFERERDARLASQAKRRTDMREDDM

SEQ ID NO: 8631 - protein, 360 aa, Arabidopsis thaliana
MNEIHQPLARRVWRSNVDEEMARMAECLKRFPLIAFDTEYPGIIFRTYFDSSSDECYRAMKGNVENTKLIQCGFTLFNAKGEIGGVWEINFSNFGDPSDTRNELSIEFLRRHGLDLQKIRDEGVDMFGYGFFPKLMTVFRSQKHVEFVTFQGAYDFAYFLSILNHGKLPETHGEFATEVVKVFGQVYDTKVMAGFCEGLGEHLGLSKLAQLLQITRVGRAHHAGSDSLMTALVFIKLKHVYEDSRFARGLIYGIGKSNLVAAPAPAPVPEPTLPLMCQQNVASYPVFHNGYVQNYEQPQLVSYDPSGAPWAFCNATGTYVQLTHLPASTFAYPSQTPSATVDYLGPVPNYYNNNACYVVE

SEQ ID NO: 8632 - protein, 142 aa, Yersinia bercovieri
MVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVV

SEQ ID NO: 8633 - protein, 160 aa, Xanthomonas campestris pv. campestris str. ATCC 33913
MGVSGSGKTTIAQALATHYGFRFLDADDYHSVAARAQMASGQPLTDAMRLPWVELLSATLRDCVQSGESVVLAFSGLRGTHRQLLRRSGVPMRFVFLHAAPHVIAARLSARAGHFMPPSLLDSQLQTLELPLDEADVVSVDVDATVPEVVQDAIAQLALE

SEQ ID NO: 8634 - protein, 197 aa, Yersinia bercovieri
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8635 - protein, 389 aa, Oryza sativa (japonica cultivar-group)
MASEKEAALAAVPNDNPTIFDKIIKKEIPSTVVFDDEKVLAFRDINPQAPTHIVIIPKVKDGLTGLSKAEERHVEILGYLLYVAKVVAKQEGLEDGYRIVINDGPSGSGDSLGEEVLRMFLAERQAHGDFVTKISDMVWRRNGGDLGVLEAAAEQENSADVAPPQPEEASNTENHPVVQDVMGEGMLRIAATRDWVSGESSLPVSKRLSAKDRQDERERRKELNLLRYEALKDELLLLTTGIGAACSLYCLLVFSLEAAVSYAFGVAFSCLYLQLLYRHTDNLSKKDVPEIFMKKKVKRIGIRSEDLKNTIEKVLGGISVALSSPRLVIPAIFFGLSTLSDHFQNSILNFELVPGMMGFFAYKAAALVQVYRDNEDLRLILPEEDADSS

SEQ ID NO: 8636 - protein, 116 aa, Yersinia bercovieri
FEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTM

SEQ ID NO: 8637 - protein, 201 aa, Yersinia bercovieri
GSSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGK

SEQ ID NO: 8638 - protein, 537 aa, Ralstonia eutropha JMP134
MPSKALPCQDPRRIWPPARRDEFQTRIRLCRVRLPPHPDTMTTTTLPDQNAAEQTFESFGLDARILRALSEQGYTKPTPIQAQAIPVVLLGKDVMGAAQTGTGKTAGFALPIIQRLLPMASASASPARHPVRALMLTPTRELADQVYDNVARYAKHTDLRSTVVFGGVDMNPQTDALRRGVEILVATPGRLLDHVQQKSVNLSQVQMLVLDEADRMLDMGFLPDLQRIINLLPAQRQTLLFSATFSPEIKRLAASYLKQPVTIEVARSNSTNENVRQMVYQVEDGQKQAAVVHLLRQRAEQGLSKQCIVFVNSKIGCSRLARHLEREGINAAAIHGDKTQTERMQTLEGFKNGTIDALVATDVAARGLDIADMPCVINFDLPFSAEDYVHRIGRTGRAGASGDALSIFVPGDERLLTDIEKLIKRSVPRGTLEGFDPTGEKARQEDSDRRRQRTDVRRARGNGDGEGEDRRRRHDHGGSRSAFRPSDDPFFSRPYEPSPNSASAKPADEMIAAALSRGRQAPKRPVAALLGGAPRKS

SEQ ID NO: 8639 - protein, 138 aa, Yersinia enterocolitica
TAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHH

SEQ ID NO: 8640 - protein, 458 aa, Magnaporthe grisea 70-15
MPCTSNVRSTRNYSASSEPDLKTTLKSVIPAKRELLKKVKAHGSKVIGEVKVENTIGGMRGLKAMVWEGSVLDADEGIRFHGRTIKDCQRELPKGKTGTEMLPEAMFWLLLTGQVPSTNQVRVLSRQLAEQAQLPAFVNKMLDDFPRDLHPMTQFAIAVSALNHTSKFAKAYADGLNKADYWEPTFDDSISLLAKLPTIAAKIYHNSYKGGGALPAEVDLEQDWSYNFAAMLGKGGKGNENFQDLLRLYLALHGDHEGGNVSAHATHLVGSALSDPFLSYSAGLQGLAGPLHGLAAQEVLRWIIQMKEAIPATYSEKDVTDYLWSTLNSGRVVPGYGHAVLRKPDPRFQALMDYAASRPEIAKDPVFQLVQLNSQVAPEVLKKHGKTKNPYPNVDSSSGVLFHHYGFHETLYYTATFGVSRGLGPLAQLIWDRALGLPIERPKSINLEGILKIVGDKS

SEQ ID NO: 8641 - protein, 111 aa, Cryptococcus neoformans var. neoformans JEC21
MSQYAHVPKSELDEAQIRELEEYEISQGPLSVLQQSVRNSSQVLISLRNNKKLLARVKAFDRHCNMVLENVKEMWTETPKGKGKKPVNKDRFISKMFLRGDSVILVLRNAA

SEQ ID NO: 8642 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 8643 - protein, 214 aa, Triticum aestivum
  misc_feature (38)..(38): Xaa can be any naturally occurring amino acid
MDAADAASPCDGHRTVWSEPPKRPAGRTKFKETRHPLXRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGSPAPSALSMSSELLNEHWFGGMDAGSCYSEGLFMESPDTRPWREDLELGGVETPPWSYLFD

SEQ ID NO: 8644 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 8645 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 8646 - protein, 145 aa, Hyacinthus orientalis
NLGDSRAVLGRKGSDGRAVAERLTSDHNVALEEVRKELTDNHPDDSHIVVYTRGVWRIKGIIQVSRSIGDVYMKKPDFSRDPLFQQFAAPIPLKRAVMTAEPAVRMQKLTPHDLFLIFASDGLWEQITDEAAVEIVFKSPRAGVA

SEQ ID NO: 8647 - protein, 151 aa, Yersinia enterocolitica
AVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATR

SEQ ID NO: 8648 - protein, 474 aa, Bacillus cereus E33L
MAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLFSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYVADGGKLEDLKFKTPLYPLVPMLGFGLYGIILISLIFIPEQRLGIYCTVPFIIFCYTYYHFKVKKRISTNTSSENKISETI

SEQ ID NO: 8649 - protein, 152 aa, Yersinia enterocolitica
GINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVKRTT

SEQ ID NO: 8650 - protein, 444 aa, Bacillus thuringiensis serovar konkukian str. 97-27
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKNEAHAAYTIFEGMAIPSSLIVGLLSDKLFKGKRMPLCIFSMVGVVIGTFVYWQATSILVISIAVSIIGCLIYVPQFLIGLSAMELVPKFAVGTTVGMCGLFGYVGGSLVANAAIGVIVDRSGWDGCFILLLTGAILSTIFLFIVQRGHESKASKVA

SEQ ID NO: 8651 - protein, 164 aa, Yersinia enterocolitica
ESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRF

SEQ ID NO: 8652 - protein, 468 aa, Methylococcus capsulatus
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGANGNGMHVHQSVAKDGKNLFSGDLYGGLSETALHYIGGYISMPKALNAFCNASTNSYKRLVPGFEAPVMLAYSARNRSASIGIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTACDEHSSVEFDMYYSL

SEQ ID NO: 8653 - protein, 153 aa, Yersinia enterocolitica
KGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHH

SEQ ID NO: 8654 - protein, 144 aa, Yersinia frederiksenii
LMPDASTAVMDPFFEDSTLIIRCDILEPGTMQGYDRDPRSISKRAEDFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHH

SEQ ID NO: 8655 - protein, 569 aa, Oryza sativa (indica cultivar-group)
MDEEARAAGCSPAPPRAPAASCGAAAELCLCSPTGVEGIEQVPGCPCFEDAGAVVVSGEAPEGPGVLCSGDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESECGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 8656 - protein, 324 aa, Magnaporthe grisea 70-15
MSNSLDQLKSSGTTVVCDSGDFATIGKYKPQDATTNPSLILAASKKAEYAKLIDDAIAYAKKQGGSVDDQVDASLDRLLVEFGKEILKIIPGKVSTEVDARFSFDTKASVDKALHIIKLYEAEGISKDRVLIKIASTWEGIKAAEILQRDHGINCNLTLMFSLVQAIAAAEADAFLISPFVGRILDWYKAAHKKEYKKEEDPGVESVKNIFNYYKKFGYKTIVMGASFRNTGEITELAGCDYLTISPNLLEELLNSSEAVPKKLDAQGAAALDIQKKTYISDEPLFRFDFNEDQMAVEKLREGISKFAADADTLKGILKEKIQA

SEQ ID NO: 8657 - protein, 371 aa, Arabidopsis thaliana
MKLTVKTLKGSHFEIRVLPSDTIMAVKKNIEDSQGKDNYPCGQQLLIHNGKVLKDETSLVENKVTEEGFLVVMLSKSKSGGSAGQASVQTSSVSQPVSATTSSTKPAAPSTTQSSPVPASPIPAQEQPAAQTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQFQQLRTMVHSNPQILQPMLQELGKQNPQLLRLIQENQAEFLQLVNEPYEGSDGEGDMFDQPEQEMPHAINVTPAEQEAIQRLEAMGFDRALVIEAFLACDRNEELAANYLLENSGDFED

SEQ ID NO: 8658 - protein, 140 aa, Glycine max
  misc_feature (31)..(33): Xaa can be any naturally occurring amino acid
  misc_feature (95)..(95): Xaa can be any naturally occurring amino acid
  misc_feature (97)..(97): Xaa can be any naturally occurring amino acid
  misc_feature (103)..(103): Xaa can be any naturally occurring amino acid
  misc_feature (107)..(107): Xaa can be any naturally occurring amino acid
  misc_feature (125)..(125): Xaa can be any naturally occurring amino acid
  misc_feature (139)..(139): Xaa can be any naturally occurring amino acid
QRGFRGKHRERTGGGAKRREKEERCRSGRVXXXNAYAWKPNLGRKINETEPGGRFRPLSEITGVCQRCRDQIDWKRKYGKYKPIVEPAKCQKCSXRXVRQAYXNVCXGCSKELGICAKCCTSVKXLVGRDAEEANSERXE

SEQ ID NO: 8659 - protein, 253 aa, Streptococcus pneumoniae TIGR4
MAKNVVITGATSGIGEAIARAYLEQGEDVVLTGRRIDRLEALKAEFAETFPNQTVWTFLLDVTDMTMVKTVCSDILETIGQIDILVNNAGLALGLAPYQDYEELDMLTMLDTNVKGLMAVTRCFLPAMVKANQGHIINMGSTAGIYAYAGAAVYSATKAAVKTFSDGLRIDTIATDIKVTTIQPGIVETDFSTVRFHGDKERAASVYQGIEALQAQDIADTVVYVTSQPRRVQITDMTIMANQQATGFMVHKK

SEQ ID NO: 8660 - protein, 429 aa, Mycobacterium leprae [sequence omitted]

SEQ ID NO: 8661 - protein, 194 aa, Brassica napus
MAEETKNVVHEQEVPKVTTEESSAEVTDRGLFDFLGKKKEETKPEETIDSEFEHKVHISEPVVPEVKHEKEEKKHSLLEKLHRSDSSSSSSSEEEGEDGEKRKKKKDKKKTATTAEGEVKTEEEKKGFMDKLKEKLPGHGKKPEDASPAAPVVAPPVEEAHPAEKKGILEKIKEKLPGYHPKTVDEVKKEKETD

SEQ ID NO: 8662 - protein, 81 aa, Hyacinthus orientalis
GLQFQVGAPPVSEAAQLPFEEDLANCQGNIARKHNLTYNSASFIEANRKTLRVLKAAALQARDWTNPAPKNLLWEAVNTVG

SEQ ID NO: 8663 - protein, 346 aa, Oryza sativa (japonica cultivar-group)
MSSSSVQTSPSPSHEVDAETDEELYKQFTDSVSSWPSSEPMPFLPLYRHDKGWYSSLMPMVGAMVADARFAARPSDIIVATLPKSGTTWIKALLYATVHRREHPADAAADHPFNSLGPHECVNFLEYQLYTNNRVPDLGRLPDPRLFATHVPFTSLPSAAAASGCKVVYVCRDPKDNLISMWDFANKFRAREGQEPMSPEAIAELFCLGVSPSGPYWDHVLGYWGAHVARPEQVLFFRYEEMKLDAAAHVRRLAEFVGLPFSAEEEEGGVVDAIVRLCSFDHMIGLEATKSGKTELVVGTAANSSFFRRGQVGDWANHLSPEIAQRIDAITEARFNGSGLRPSGTK

SEQ ID NO: 8664 - protein, 905 aa, Candida albicans SC5314
MDEKNPTTELSVPNIEAVGSHLQVQDHEINLQAIISNPLSIGEVATTLTESQKWFVLKRLHFDALVSLDELPPQASFIFEKIEQMTTEEAVEILEKNIEEHETDVNIPENDLVLWKELVENSHKFTKVQLQEKLGSNSSSSVEGEKTADVEKGHEIVDWDLQVRLEAVLVAYWSPYPEVRAVTFPYDDPTIPAETFRVYLIAIIWTAIGAVINQFFVERQPAITLAMSVVQVFLYPSGLLCEWILPKWKFKIWKLSIDLNPGPYTYKEQMLATIFCGVTGGGTSYVSSNILMQKSEIFYDNKWVDFGYQVLLILSTNFLGIGLAGIMRKFAVYPTKAVWPSILPGLALNKTLLTPAKKEVINGWKISGYNFFFIAFVASFLYFWVPDYLFQALSTFNWMTWIKPDNQNLAVVTGSVGGLGLNPITTFDWNYFSSMLQPLQVPFFYPVNNIIGMAIAFFCIIGVWYSNYKWTGYLPINDNGLYTNTGEPYSVRSVVDANSLFDQAKYAEMGPPFYTAANLVVYGAFFAIYPFHFVYELGMNYDQMWDAFKSFWRVIKDYKKSTYDGFDDPHSTMMRAYPEVPEWAYLIIVVISLVLAILCVKVYPAETPVWGIFFALGINFVFLIPLTTIYARTGFAFGLNVLVELIVGYAIPGNGLALAFIKALGYNIDGQAQNFVNDLKQGHYAKLPPRAVYRVQLLSIFISSFIQLGILNFQINGGIKDYCEPGNTQKFTCPSSRTFYSASVLWGVIGPKRVFNGLYPILRWCFLIGFLIAFPCIAIKKWGPRKYVKYFEPSIIIGGFLNYAPYNLSYYIPGLYVSFTFMSYIKRKYEAWWQKYTYVLSTGLNAGIAFSSIIIFFAVMYHEKDINWWGNTVMYSGVDYAMTGWLNATVDAPDGYFGPRVGHFP

SEQ ID NO: 8665 - protein, 488 aa, Burkholderia thailandensis E264
MPSGDILIGGEWRRGRGATTPNFYPADGSLNTEIHMADAADTREAVEAADAAWRRANWSGLKPHQRAGVLYRVADLIHANREALAQLQRRDNGKPINETRALVASAANTFRYFAACAETLDEALTPSRGDYLSMSVHEPLGVVAAITPWNSPIASDAQKLGPALAAGNAVVLKPAEVTPLASLALARLCEQAGVPRGVISVLPGKGSVIGDALVRDPLVKKVSFTGGTEVGRGIARLAAEKLMPLSLELGGKSPTIVFGDADLDHAVNGVLYGIFSSSGESCIAGSRLFVQRSIYDAFVARLVDAARKLRVGDPASERTQMGPLITAQHRDTVERYVALGRDEGARVLCGGERPTGEGRDAGFFYLPTILDGLSNRARICREEIFGPVLVALPFDDEAALVAEANDSVFGLAAGIWTRDYKRAWRVARALDAGTVWINTYKQFSISTPFSGWKESGMGREKGSLGIREYMQQKSLYWGLNDSPLPWAN

SEQ ID NO: 8666 - protein, 197 aa, Yersinia frederiksenii
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8667 - protein, 178 aa, Oryza sativa (japonica cultivar-group)
MEGEDAVVPEAVAADAEKAEEKESGSRMITLKSNEGKAFVVTEVSARQSTTIGHMIDDDCTREAVPLPNVDSKTLEKVIEYFDEHANNKADTDDEKAALDKFDKDFIGELDGDKAFLFHVTMAANYLHAQGLLDLTTQCIADTIKGKTPEEIRTAFNIAYDLTEEDQEEIKEEDAWAF

SEQ ID NO: 8668 - protein, 193 aa, Yersinia frederiksenii
GWKGINESDMVLMPDASTAVMDPFFEDSTLIIRCDILEPGTMQGYDRDPRSISKRAEDFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8669 - protein, 632 aa, Ralstonia eutropha JMP134
MTQHDTRAEQAIASATDASITSAVQSPLDKLDAMLNPAQVTETVAAEEVTNGFATLGLDAAILRALSELNYNNPTPVQAQAIPAFLAGRDLLVSSQTGSGKTAAFMLPAIQRISEKPATNRPTEPAKRMKGKRPRPSPAQPSLLVLTPTRELALQVTEAAAKYGRNLRRIVCASILGGMPYPKQLAALSKMPDILVATPGRLLDHISAGRIDLSALDMLVFDEADRMLDMGFADDIDAIVDATPASRQTLMFSATLDARIAQLASRQLKDPQRIEIAAARADQSHIEQRLHFTDDMSHKERLLDHLLRDATLKQAIVFTATKRDADSLAERLSDTGFAAGALHGDMTQGARNRTLTALRRGNLRVLVATDVAARGIDVPDITHVVNFDLPKQAEDYVHRIGRTGRAGRSGVAINLVNHNDTFQWKRIERFTNNRIDASVIEGLEPRRSPKPRSNFGGKPGGRGNGGGYRGGERSFGDRNFGDRKFGGESRGFGNRGNQEGGRSFGDDNRGFGNREGSGYRGGEQRSFGGGDRNFGGERKFGGDNRGFGQRANPEGGRSFGDDNRGFGNREGGGYRGGEQRSFGDRSFGDRKVGGEGRSFGDRGGRDGGRSLGNREGGFGGQRNGNSRSRYER

SEQ ID NO: 8670 - protein, 390 aa, Mycoplasma pneumoniae M129
MAAGKRDYYEVLGVSRSATAQDIKRAFRKLAMQYHPDRHKGEGETVQKQNEEKFKEVNEAYEVLSDTEKRGMYDRFGHEGLNASGFHETGFNPFDIFNSVFGEGFSFDMDGGSPFDFIFSRGKKSRQNRVVLPYDLEIAVGVDISFFEMTNGCTRTIEYTKRVTCSACDGFGAEGGETGMVSCNSCEGNGFILKNQRSIFGTVQSQMLCQSCGGQGKQAKHKCKTCKGSKYKKVPTTKEIQIPAGIYHGDALVDDHGGNEFGGHVGKLVVHVGVLPSKIFKRVDHNVVANVLVDPMIAITGGKIELPTLEGIKEFNLRAGTKSGEQIVIPGGGIKFTKNFRKKAGDLIIIISYARPSEYSAPELRKLKEFIKPNQEVKQYLNALKNEYKS

SEQ ID NO: 8671 - protein, 187 aa, Yersinia frederiksenii
ESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8672 - protein, 512 aa, Mycoplasma pneumoniae M129
MKRCYITTPIYYASGKPHIGHAFTTILADVIKRYKQQNGYEAYFLTGTDEHGNKIESKAKSLGLDPQTFVDQNVAYFQQMWKQLDINFDHFIRTTDLSHKAQVQHAFQLLYDKGLIYQSNWEGAYCVECEQNYFTYDKQTMLCEIGHQLTLVQEPSLFIAFKDSKDWIGEMIATNKLNITPESRAAELKNNFLDGGLNDLALTRQNVTWGIPVPFDNKQTIYVWFDALFNYITNLGFAHNDPKFNKWWNNNDEEHEVIHLISREITRFHCIYWPIFLHQLGFKLPTQFLSHGWIVDGNGHKMSKSLGNVISPEELLAQFGVDGTRYCLLKEMRLDKDNRCSMAIFKDIYNADLANSFGNHASRTFGMIKKYLGGQLDFIEVQDPQVKQLMDQANQAMVQFDTAWNNFQFYKGINGLLQLVFQASKLIDQLKPWELVKQTDYTLLKQLLFACVRCTQVCFVLLAPILVHTSTQIFDLFNFSAQARSKTHLADPQQLQKISLAPVIQPLFKRLD

SEQ ID NO: 8673 - protein, 432 aa, Zea mays
  misc_feature (101)..(101): Xaa can be any naturally occurring amino acid
  misc_feature (107)..(107): Xaa can be any naturally occurring amino acid
AIVEGVDIISDSTVGAARAQSFSGTSASHTWPRSTFYWQLSDPLVDLLGSVHENMSEGGSRRNSFFPVFNSFSFPEHEHMNEHRDGNSDQQTRETYYAGDXNNGDGXRASLLSQAASVEVNDTNTSFTSEGSSSYLRRHGTSVLAQEFMASIHDYDIEEEEEEIHGFALPHQSAPRDMESTGRHPFRHQIVRLSETADMKFKWRVLLQPGIRHALCYGMLIQALQQSTGISGLLRCAPEIFEQSGVASLFSDIGLSPHSTSILMSTLNALLILPCITAAMLLMDVCGRRVLVLATTPVLILSMSVMSMSTLVNMGPFESAVLFHFALTICFWSYVIGLGPIPNILCSEIFPTKARATCASFCSLSFWFGGLLSAYCFPVMLSTIGLGGACGVYALVCCAPLFLVYYRIPETKMLNLELIAELFKLSRQEYVQ

SEQ ID NO: 8674 - protein, 133 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGGHGGGGHYGGGGGGYGGGGGHHGGGGHGLNEPVQTKPGV

SEQ ID NO: 8675 - protein, 689 aa, Magnaporthe grisea 70-15
MFRLNIARLSSGAPNRRLLTATTARIPSCLSCASLARPTRRIPTAILPSIRTLQTQHTPSDFRPAVPPSPSSLGGPRKARTYTRSRKWARRLFIASAVLGTLYAIDSQVYASGMGRSLRTFGTGLLVALDYKINFRPDPLPLIGSSGTIEDLHRRNAERLFELLRKNGGLYLKIGQAIAMQSAVLPPEFQRMFARMFDDAPSVSWDEVERVIREDFGGRSVQDVFGVSFAGADGRGVMERSARASASVAQVHWARLSDGTEVAVKIQKPEIAKQIGWDLWSFKAVTWIYSWWFDLPFYSMVPFITERLELETDFINEAKNSDTMRDLIADEPYLRGRVYIPKVFSELSSKRVLVTEWIEGVRLWDREAMTRPWYGGYGKGSLGVNGTPLPSPDMAAVRAELRRNPESSKLKPERDEWRGRNGKGGLGLSKKDVMTTIVDLFSAQIFKFGVVHCDPHPGNIFIRRLPGGRAELVLIDHGLYVYLTPKFRREYSEFWKALMTFDNKTIARVCDQWGIKGADLFASATLMRPYEGGDGHYRRQLLGMDLPEDMTPKQRRFELQKRSKQAVREMLADENKWPKELIFIGRNMRIVQGNNQHMGSPVNRVKMMGEWASRSMFEDRDRPFRERVANMWRHALFKTVLTASDVVFYFFKLRQFLGLGGGMEDEVEARMRQMAGDFGVELQHDVFAG

SEQ ID NO: 8676 - protein, 281 aa, Clostridium tetani E88
MDLWLKEGQISDAVMTYKIKETLVRKKTEYQDLAIVDTYALGRMLVLDGIVQTSIKDEYVYHEMITHIPLYTHPNPKKVLVVGGGDGGTIREILKHPSVEKAVLCEIDEEVVKECKKHLPEISNNALEDSRCEVFIGDGIKYVNEHKNEFDVVIIDSTDPFGAAEGLFGGSFYGKISECLTEDGIFVAQTETPFYLPEIVKRVYDDSKAVFPVTKLFMAAIPTYPSGYWSFTIGSKKHDPEKAPVPEVLPFETKYYTPRLHSASFVLPKFVENLIFANISE

SEQ ID NO: 8677 - protein, 469 aa, Anaplasma marginale str. St. Maries
MSCVMSLILSVAQFRVFEQGSAVPVEELILRAGAAVVEEVVRYFPKRPVLVLCGPGNNGKDGAVVAGLLEKSGWPVRVLSYRGGARSEGLPALTPEGFSIHEDVIIDAIFGIGLSRPMDEGLQKIVSKINSSGKYVVAVDMPSGINSDTGEVMGAAIRSDLTVTFSCLKFGHVISPGRYHAGEVRIKDIGLEVNGAQAFRNTPDLWRALIPRPDYKSHKYNRGYAAVCSVGVRSVGAVKLAALAALRIGSGAVAVACADEEICLYASALTAVMYKPYEEVLSDSRVTTLLIGPGGDVLDDALRYKVLVALNSGRKCVLDAGGISVFQSDPNMLLSRIAGGNVVMTPHEGEFKRVFPSLKGSVVERARDAARISGAIIVLKGHDTVIAQPDGSVVVNNNAPSSLATIGSGDVLAGIITGLIAAGMPEFAAACCGVWIHGECGKRYGIGLIADDIIQQIPRELNLLVNGAA

SEQ ID NO: 8678 - protein, 207 aa, Legionella pneumophila str. Paris
MSDLDINSLDWQKMNGLLPAIIQNAENGKVLMLGYMNQEALIATLTTGQLTLYSRSRKRLWRKGESSGNSMALQHISADCDNDSLLIQVIPKGPACHLGYSTCYQPHNNYTLGFLDGLIELINERAEEKNPNSYTAQLLDSGVNRCAQKLGEESVEAVIAAVSNNKEELINEASDLIYHLLVLLKACELSFYDVLLCLQARDRSVHT

SEQ ID NO: 8679 - protein, 635 aa, Saccharomyces cerevisiae
MSGARSTTAGAVPSAATTSTTSTTSNSKDSDSNESLYPLALLMDELKHDDIANRVEAMKKLDTIALALGPERTRNELIPFLTEVAQDDEDEVFAVLAEQLGKFVPYIGGPQYATILLPVLEILASAEETLVREKAVDSLNNVAQELSQEQLFSDFVPLIEHLATADWFSSKVSACGLFKSVIVRIKDDSLRKNILALYLQLAQDDTPMVKRAVGKNLPILIDLLTQNLGLSTDEDWDYISNIFQKIINDNQDSVKFLAVDCLISILKFFNAKGDESHTQDLLNSAVKLIGDEAWRVRYMAADRFSDLASQFSSNQAYIDELVQPFLNLCEDNEGDVREAVAKQVSGFAKFLNDPSIILNKILPAVQNLSMDESETVRSALASKITNIVLLLNKDQVINNFLPILLNMLRDEFPDVRLNIIASLKVVNDVIGIELLSDSLLPAITELAKDVNWRVRMAIIEYIPILAEQLGMQFFDQQLSDLCLSWLWDTVYSIREAAVNNLKRLTEIFGSDWCRDEIISRLLKFDLQLLENFVSRFTILSALTTLVPVVSLDVVTEQLLPFISHLADDGVPNIRFNVAKSYAVIVKVLIKDEAKYDALIKNTILPSLQTLFQDEDVDVKYFAKKSLAECQELLKN

SEQ ID NO: 8680 - protein, 687 aa, Myxococcus xanthus DK 1622
MTTDKQDVLAINTIRTLAMDAVQQAHSGHPGAPMSLAPVAYQLWQQELRYDPSHPIWPDRDRFILSNGHASMLLYALLHLAGVKRVTREYTVEDAPTVSLEDIKKFRQLDSSTPGHPEYRWTSGVETTTGPLGQGVSNSVGMAMASRWLASYYNRPGFEMFGYDVYAICGDGDLMEGVASEAASIAGHLQLPNLCWIYDSNHISIDGSTDLAFTEDVGRRFEAYGWRVLRVPDANDLNAMGEALRTFKTARGKPTLIIVTTQIAYGAPKLQGSSKAHGEPLGDEEIKGTKRFYGWPEDEKFLVPDGVRERFQERMGARGKQLRTEWEQKFAEYRKQFPELADQLERMQRRDAPQGWDAELPTFPADAKGLATRDSSGKVLNAIAKHYPWLVGGSADLNPSTKTYITGGEAMKPGEYAGRNIHFGVREHAMGSIVNGLCLSKLRGYGATFLIFSDYERPAIRLSALMELPAIHIFTHDSIGVGEDGPTHQPVEQLASLRAIPGIIVLRPGDANEVVESWRVIAQQRKHPVVLVLTRQPVPTLDRSKFGAASGVARGGYVLSEAEGGKPEVILIGTGSEVSLCLDAQEKLKADGIPARVVSLPSWELFEAQSQEYRDSVLPPSVRARVAVEKGATFGWERFVGHDGNIVAMRSFGASAPLKALQQKFGFTADHVAQQAKDSLKKTKTRP

SEQ ID NO: 8681 - protein, 230 aa, Glycine max
MPSSLQLDRFNPITDAVTTATVAIANGVNCPKQPQAPPSTAARRLMVPSLSSGRGIAASDTVALHHANVVGLNQCCSVVTQHINAPVAAVWAVVRRFDNPQGYKNFVKSCHVITGHGIRVGAVREVRVVSGLPAEMSTERLEILDDERHVISFSVVGGDHRLRNYRSVTTLHANGNGTLVIESYVVDAPQGNTKEETCVFVDTIVRCNLQSLAQIAENRTKNCENAAQHC

SEQ ID NO: 8682 - protein, 352 aa, Legionella pneumophila str. Paris
MKKILFIDRDGTLVEEPFDFQVDSLDKIKLTSGVIPALLQLQKAGFTFIMVSNQNGIGTVAFPEEDFAVCHEFILDLFSSQGILFDEIFICPHTPEDNCICRKPKTGLLEPYLKETAFAKHYSWVIGDRDTDKEFADNLGVNFLPISKTHTWEMVVSAIINDARKASVQRKTKETAIDLSVQLDSDQTSVIDTPIPFFTHMLEQVAKHGGFDLRLQASGDLEVDEHHLIEDTAIALGEAIRTALGDKWGINRYGYTLPMDESLACVAIDISGRSFCDFKGQFTREFVGGMATEMVPHFFQSLSSALGATIHIEVTGTNHHHMIEACFKVLGRALRQACSRTNNYLPSTKGVL

SEQ ID NO: 8683 - protein, 365 aa, marine gamma proteobacterium HTCC2080
MSHSILLLPGDGIGPEVVAQARRVLERAADLYKLTIELDEANLGGVAIDREGQAYPESTQAKARSAAALLLGAVGGPQWDGLPAEERPERGLLAIRADLDLFANLRPAILFPQLADASSLKPELVAGLDILIVRELTGGIYFGEPRGIRTREDGEREGYNTYIYRESEIERIAKLAFELATKRGGRLTSVDKANVLEVTQLWREVVTNVAGNFPEVDLDHLYVDNAAMQLVRAPKQFDVLVTGNIFGDILSDTAAMLTGSIGMLPSASLNAHSAGLYEPVHGSAPDIAGQDCANPLATILSVAMLLRYSLDAPDAAIAVEAAVSAVLDQGCRTADIAAKGDVVIGTEAMGTAVLNALEGPQGNQL

SEQ ID NO: 8684 - protein, 590 aa, Xylella fastidiosa 9a5c
MPHSAHRPTPTLHTQMNVRLQGHGAARGAALGRAWVRQMNVMEIQDKYITDTNAELHSLYQAMSAARQEIQVLRERMHGTLSHEVGEFLDLHTLLIDDPELLRSPNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLQLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGALKTSATTLLHARDRKSIEEWMAAHANTTPT

SEQ ID NO: 8685 - protein, 555 aa, Oryza sativa (indica cultivar-group)
MAMATATASSCVDATWWAYALPALLGADTLCAHPALLAGAVLLAFATAAVLAWAASPGGPAWAHGRGRLGATPIEGPRGLPVFGSIFALSRGLPHRALDAMSRDAAAPRARELMAFSVGETPAVVSSCPATAREVLAHPSFADRPLKRSARELLFARAIGFAPSGEYWRLLRRIASTHLFSPRRVAAHEPGRQADATAMLSAMAAEQSATGAVVLRPHLQAAALNNIMGSVFGRRYDVSSSSGAAADEAEQLKSMVREGFELLGAFNWSDHLPWLAHLYDPNHVARRCAALVPRVQAFVRGVIRDHRLRRDSSSTAADNADFVDVLLSLEAHENLAEDDMVAVLWEMIFRGTDTTALVTEWCMAEVVRNPAVQARLRAEVDAAVGGDGCPSDGDVARMPYLQAVVKETLRAHPPGPLLSWARLATADVGLANGMVVPAGTTAMVNMWAITHDGEVWADPEAFAPERFIPSEGGADVDVRGGDLRLAPFGAGRRVCPGKNLGLATVTLWVARLVHAFDWSLPDGSPPVSLDEVLKLSLEMKTPLAAAATPRRRRAA

SEQ ID NO: 8686 - protein, 406 aa, Burkholderia thailandensis E264
MYSNIGSRSKAADIAAPDVARCPCLRRRGHRARGAACGRSHSGEQANTETALYAYQALVGLPYRLSVFHRRRFARPTARRIERDAAVESCECRMRAGRAARGVRTVVRANEEQAMLTGGMLIGSAVTLGVWAGRHPLAVLNAAARRPTFVGRFDIAYGAGPRRALDIYLPADRCAPTAGGGLPIVVFFYGGSWRRGRRGDYRFVGEALASRGCVVAIPDYRLYPDAVFPDFVEDAAAAVRWACDHAAELGADPRRVYVTGHSAGAQIATLLATDGRFLRAHGLDKRDLAGVVGLAGPYDFLPLNDATLERIFPEPVRDASQPIRFVDGSEPPMLLASGLRDATVKPGNTARFAARVAAAGGAVQVRLYPGIGHALLVGAFGLPLRRFLPVLDDVAAFVRGAPRART

SEQ ID NO: 8687 - protein, 150 aa, Yersinia intermedia
NESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHH

SEQ ID NO: 8688 - protein, 153 aa, Zea mays
  misc_feature (108)..(108): Xaa can be any naturally occurring amino acid
MSVNGKTIDMTEDHRVASATERARIARTGQPLKDGEVRLNGLNLARMFGDKFLKEQDSRFSSEPYLSQAVRITKACTAFAVIASDGLWDVISTKRAVQLVVELQERRXSGDSASAAKVANRVLDEARSLRTKDNTSLIFVDFDILRTDPCIAK

SEQ ID NO: 8689 - protein, 160 aa, Triticum aestivum
  misc_feature (51)..(51): Xaa can be any naturally occurring amino acid
  misc_feature (85)..(85): Xaa can be any naturally occurring amino acid
  misc_feature (92)..(92): Xaa can be any naturally occurring amino acid
  misc_feature (102)..(102): Xaa can be any naturally occurring amino acid
  misc_feature (110)..(110): Xaa can be any naturally occurring amino acid
  misc_feature (126)..(126): Xaa can be any naturally occurring amino acid
MAPTVMASSATSVAPFQGLKSTAGLPVSRRSNGASLGSVSNGGRIRCMQVXWPSEGIKNSETLSYLPPLNTEASSKQVDYLIRSXKWVPCLXFNKVGFIFRXEHNESPGXYYDGRYWTMLELPKFXCNDATQVIQQGGGVKKGYPDPMSDNFTWPSSSSP

SEQ ID NO: 8690 - protein, 196 aa, Yersinia intermedia
SIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8691 - protein, 200 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGK

SEQ ID NO: 8692 - protein, 642 aa, Leptospira interrogans serovar Lai str. 56601
MQSVRLTSVSLKTKVFDFQGNLEKIKRVLKLEKKSDLILFPELCISGYGCEDAFYFPRIWKRSWNSLIQLLPHTENKIIVVGLPIFQNPYLFNCAAVLCNGVVAGIVPKSNLASTGVHYENRWFTRGEESQENFIAPDGSTIPFGSLIFETDHFSFGVEICEDSWVLQKPSIPLAEAGTDLILSPGASHFAFGKQRIRRQIFQESSRRESNVYLFSNLCGNESGRLIFEGGSMIVQNGKLLSESERLFFGDFSLCSNEIDFEASQADRAKNFRPSGNRFSKTKSTEENKIYLGIEFPKRAPKVNKSLLEISVSKEEESYLDFTKAVALGLFDYLMYSNTKGYTLSLSGGADSSACALLVTAMKKIAKLELGENFFKSKGIPEESILCTLYQSTSNNSDRTKFLAKSLAKEIQSIHGDLTIDSEIQSISEKISKLTGISLRWDEHNLTLQNIQARVRSPIIWMLANLNGHLLLSTGNRSEASVGYTTMDGDSSGSIAPLTGVSKEFILKWLRFVSEGKDPILPAYPSIKEIVNSPPSAELKPPEDKQEDEKDLMPYPLLQKIEELFIVRGAGYSEIIQLLSEDSEIQNLPPKFLEESVKKYISLFHKNQWKRERLPPSFHLDDYGLDPKSSFRFPILSEDIEL

SEQ ID NO: 8693 - protein, 239 aa, Eriobotrya japonica
MGGGRVQLKRIENKINRQVTFSKRRTGLLKKAHEISVLCDAQVAVVVFSNKGKLFEYATDSCMEQILERYERYSYAERQLVEPEFESQGNWTFEYCRLKAKVEVLQRNHRHYLGEDLDSLTLKEIQNLEQQLDTALKQIRLRKNQLMHESISELQRKRKAIQEENNLLAKKIKEKEKAAAQPQVQDWEQQNIGLDLLPQPLPCLNNGGTQQDEFLQVRRNQLDLTLEPLYSCHLGCFAA

SEQ ID NO: 8694 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8695 - protein, 741 aa, Medicago truncatula
MNVPATRKDLMIVNMGPQHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGMRMMHNYFRIGGVAADLPYGWIDKCFDFCNYFLTRVIEYQKLITRNPIFLERVEAVGVVGREEVINWGLSGPMLRASGIQWDLRKVDNYECYEEFDWEVQWQKEGDSLARYLVRIGEMMESIKIIQQALEGIPGGPYENLEIRSFDREKEPEWNDFEYRFIGKKSSPTFELPKQELYVRVEAPKGELGIFLLGDQNGFPWRWKIRPPGFINLQILPQLVKRMKLADIMTILVQDINYFSGLESFKEVYGILWILVPILILVLGITISVLAIVWLEREISAGIQQRIGPEYAGPFGILQALADGTKLLFKENLIPSRGDIRLFSIGPSISVISILISYSVIPFGYNFVLSDFNIGVFLWIAISSIAPIGLLMSGYGSNNKYSFLGGLRAAAQSISYEIPLTLCVLSISLRAIRLSNSLSTVDIVDAQSKYGFWGWNLWRQPIGFIVFLISSLAECERLPFDLPEAEEELVAGYQTEYSGIRFGLFYVASYLNLLISSLFVTVLYLGGSNISIPYIFVSEFFEINKTYGVFGTTIDLFITLAKTYFFLFVSIITRWSLPRLRMDQLLNLGWKFLLPISLGNLLLTTSSQLFSL

SEQ ID NO: 8696 - protein, 532 aa, Oryza sativa
  misc_feature (154)..(154): Xaa can be any naturally occurring amino acid
MKKGLNKIKIQVLNERIRLASHASRLPRNGWLRARAIALSPVSTPQSPSGDRRALRAKYIYARIRPPRSIQPSELRKEEAYRRQRRAMATHAALAASRIPATARLHSKAASKQRVDFADFSGLRPGSCSISHAAREASFSDVLGSQLVARAYPXEPPVRAPAEAKLKVAINGFGRIGRNFLRCWHERENSPLEVVVVNDSGGVRNASHLLKYDSMLGTFKADVKIVDDQTISVDGKLIKVVSNRDPLKLPWAELGIDIVIEGTGVFVDGPGAGKHIQAGAKKVIITAPAKGADIPTYVLGVNEGDYSHEVANIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWPGAAVQGSGDPLEDFCKDNPETDECKVYEN

SEQ ID NO: 8697 - protein, 161 aa, Medicago truncatula
MFLMVTGFMNYGQQTVRAARYIGQSFIIILSHANRLPVTIQYPYEKLITSERFRGRIHFEFDKCIACEVCVRVCPIDLPVVDWKLETDIRKKRLLNYSIDFGICIFCGNCIEYCPTNCLSMTEEYELSTYDRHELNYNQIALGRLPMSVIDDYTIRTIQIK

SEQ ID NO: 8698 - protein, 439 aa, Pyrococcus abyssi GE5
MNVSEVKSGATRSPKFVQLIFVDINGMPKGMEIPASRLQEAIEDGISFDGSSVPGFQGIEDSDLIFKADPDTYVEVPWDNVARVYGYIYKDGKPYGADPRGVLKRVIEKLAEMGIKAYIGPEPEFYLFKKNGSWELEIPDVGGYFDILTLDKAKDIKREIAEYMPSFGLVPEVLHHEVGKAQHEIDFRYDEALKTADNIISFKYIVKAVAEVHGLYATFMPKPIYGMPGNGMHLHISLWKEGENIFKGEEGLSETALHFIGGLLKHAKALTAITNPTVNSYKRLVPGYEAPVYISWGYKNRSALIRVPAFWGNGARIEYRCPDPSANPYFAFAAILMAGLDGIKHKVEPFAYVEENVYEMDEGKRKELGIDTLPGSLGEALDELEKDKVVREALGEAYKNFIEYKRKEWESYLEYLEAKHLPKDTKRVTEWELERYFFI

SEQ ID NO: 8699 - protein, 333 aa, Xylella fastidiosa 9a5c
MAVSSLQHNHLSDTALIASARRVIEIEREALTLLNERIGTPFVAACRLILNSHGRVISTGMGKSGHIARKIAATFASTGTPAFFVHPGEAGHGDLGMITDSDVILALSYSGESDEVRMLLPVLKRQGNPIIAMTGRPQSTLAQAADVHLDVSVTTEACPLDLAPTSSTTTSLVIGDALAVALLDVRGFTAEDFARSHPAGHLGRRLLLHITDVMHSGNDLPAVHEEATLSEALLEMTRKRLGMTAIVDNEGRLQGVFTDGDLRRALDSNIDVRNARINEVMTRHPKTINADQLAAEAARLMEANKINGLIVVDPQQRAVGALNIHDLLHAKIV

SEQ ID NO: 8700 - protein, 520 aa, Burkholderia thailandensis E264
MSPHPNSDNSTAQSNPPQLRRSLKARHLTMIAIGGSIGTGLFVASGASISQAGPGGAVLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVLAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLVPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSNLYPYGPIFAFALCIVIALGQDYQAFLANKIDWVGVLATYVGIPLFLVVWLGYRLVHKTRFVGYEDMDIASWVAEHERAAAHEAREAAAIRVPSSPEAAS

SEQ ID NO: 8701 - protein, 277 aa, Pavlova lutheri
TRLVLTSALFAFSPQSVTSRLNRSALRTPAQQVVMATQDELKKLAGYKAVDDYVRSGMVVGLGTGSTAAFAVERVGMKLKSGELKDIIAIPTSVRTKEQAEALGIPLVTLGTHSDLDVAIDGADAVDPRLNLIKGGGGALLREKMVEVCAKKFIVIVDDTKLCAGLGPSFPLPVEITPFCWEHTLRKVAACPAAAGCEAKLRLGSAATGSKVDGTDPAVTDNDNYIVDLFFKQPIADPVALAAQLKATVGVVDHGLFCGMTTACIIAGKDGISVQTP

SEQ ID NO: 8702 - protein, 687 aa, Erythrobacter sp. NAP1
MADTSHPFYDMHAHGFVRVATATPCMRTGDVAYNVKGILAEARKAHEQNVDLVVYPELCVSSYAIDDLHLQNAMLDASEAALGTIAEQSRDLTPVLVVGAPLRRNSKIYNCAIVIARGEVLGVIPKSYLPNYREFYEKRYFAHGRNCQDLWIGVNGEEVPFGTDLVFSASNLPGFTFGVEICEDFWAPNPPGTLAALAGAHILCNLSASPITIGRADDRHLHCRSSSSRSICAYVYSASGHGESTTDLAWDGQGVIYELGGLLAESERFDLDPELCVVDVDTNRIAGERMRNQTFSDAAEAHGRPEDSFRRVVFDHEYEEGDIGLERPVRRFPFVPNNPKTLDEDCYEAFNIQVDALMRRIQATKAKSLVIGISGGLDSTHALIVAAKACDRLGLPRSTIRGYTMPGFGTSDGTKSNAWKLMEVFEITAEEIDIKPAAQRMLEDMGHPFAEGEPVYDVTFENVQAGLRTDYLFRLAGQHNGFVIGTGDLSELALGWCTYGVGDHMSHYGVNSGVPKTLIRYLIRWTVQTEQFLPVCSEVLMSVYDTVISPELVPAGEDGAIQDTEAHIGPYELNDFFLHHCVRFGQRPGTIAFLAWHAWRDAEAGDWPAGFPEERKNEYTLGEIAEWLQSFLKRFFGFSQFKRSALPNGPKVSSQGALSPRGDWRAPSDAVADVWLDELKASLPDKL

SEQ ID NO: 8703 - protein, 490 aa, Oryza sativa (indica cultivar-group)
MALKSPVDFAGSITSGQKDPCCFGVPGCNPRCVRYNKKSRTCRLVTRAISVDRPQLDFSNSDWKKQFQEDFDSRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLAEVPARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 8704 - protein, 199 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 8705 - protein, 333 aa, Triticum aestivum
MGNCSSFSLPKWIFGDLHSNGMVSIEGDGTHDGIKTIRIQKACEFTTSSVLCVCIITWNMNGKDLRKLVSSTRKFDLLVVGLQEVPKCGVEQVLQEAMADTHILLCQKAMQSIQMFLFGAKSSEAYIKEMKVDEHAVGGCGGVIGRKKGAVAMYVNFSGIRMVFVSCHLAAHEHKVEKRNSECRHISHSLFSKNDIHYAKSADITVWLGDLNYRLEGISSMPARKMIEENRQSKLRDRDQLLQEAEKGQVFNGYCEGTLSFKPTYKYNVGSSNYDSSYKIRVPSWTDRILFKVDHSSGLDAVLSSYEALDCVSSSDHKPVKAHLCLKVRGGNT

SEQ ID NO: 8706 - protein, 390 aa, marine gamma proteobacterium HTCC2080
MSKQFEAVTIPKWGIEMTHGRIVAWRYSEGEQIAAGAELVDIETDKIVNSFEARVAGSLVKILVPEGEELPVGTLIGVLAMTDFQPAELEAFIAKQKLAEAAVPEPATMAQNVESPASLANTAPIKISPALRRKLEKAGLSAADVTGTGHDGRILKEDIDRAVASAASDPGASGKALSPTQSRVAQTLVGAQNTVPLFHLQRRLDVGQAIAALKRENPNLKSVITLLLIKGLRAALARHPELNVEFQGDTVRPVPTFNVALAVSRSDGAVSAPVVGDEPDEAVPQLAQRVAEIVDRARQGKLTASDQLPAAITISNLGMYDVTAFTAMVTPPQVMVLSVGMVQTQPIWNEDLQAFVPKECLDVTLGCDHRWVNGAQGAQFLKALADFVQS

SEQ ID NO: 8707 - protein, 714 aa, Oryza sativa (indica cultivar-group)
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSITPGHPENFETPGVEVTTGPLGQGFANAVGLALAEKHLAARFNKPDLKIVDHHTYVILGDGCQMEGVSNEASSLAGHWGLGKLIAFYDDNHISIDGSTGISFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSVEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 8708 - protein, 139 aa, Solanum tuberosum
NSEKIGEGTYGVVYKARDRVTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNVLKL

SEQ ID NO: 8709 - protein, 178 aa, Oryza sativa (indica cultivar-group)
MPNILMLRPADGNETSGAYKIAVLNRQRPSVLALSRQKLQQLKGTSAEGVAKGGYIISDNSSGNKPDIILIGTGSELEIVEKAADELRKDGKTVRVVSLVCWELFEEQSEKYKESVFPSEVTSRISVEAGVTFGWEKYIGEQGKAIGVDRLGSSAPAAKIYNELGLTVENVLATAKSL

SEQ ID NO: 8710 - protein, 197 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8711 - protein, 146 aa, Yersinia kristensenii
NESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVV

SEQ ID NO: 8712 - protein, 248 aa, Pseudomonas putida GB-1
MENVIVITGGSRGIGAATALLAARHGYRICINYHTDDQAAQNILGQVRALGAEAIAVRADASVEDEIIQLFQRVDEELGPVTALVNNAGTIGQQSRVEEMSEFRLLKIMKTNVVGPMLCAKHALLRMAHRHGGQGGAIVNVSSMAARLGSPNEYVDYAASKGALDTFTIGLAKEVAGEGVRVNGVRPGYIHTGFHALSGDPDRVSKLEPGLPMGRGGRPEEVAEAILWLLSDKASYSTGSFIDLSGGR

SEQ ID NO: 8713 - protein, 838 aa, Candida albicans SC5314
MIFPILPVISSPEDKQSIDEFSLVGQVLFPIESVSPKKHFIHQFPHDLDIFVNAIDNATTDQIVELLNVGIKQVFVNEKQYHDAIEAGLPSSRFVVAVDVPSTELLTSEASFVTSKPFSESDLKKYNANENRVIYIESNFTQDGAIELAKNYVPVIPSTKLTVKREEENKISISAVFVSTLTTDRPDGLYTTLITTPSPSYTALGIVYSSKDSIIAAIEEKVGVYQSRKRRDELWYKGKTSGATQKLVKLSKDCDSHVIQFMVEPRTGYGFCHRETKFTCFGDDIADSPARGLPKLDSTLQDRLENAPEVSYTKRLFDDEKLLIAKLKEELDELIEAKSKEEIAWECADLVYFAMVWCIKHGVRLADIEKNLDVKSLKVSRRKGDAKPQYQEAPVNSSYKLEIVSVDDAAAVERAMTRPVQKTADIMKLVLPIIEKVKSDGDKALIELTSKFDGVKLDAPVLQAPFPADLMDISEEMKAAIDLSMQNIEKFHAAQLPKEKVMTVETSPGVYCSRFAKPIENVGLYVPGGTAVLPSTAMMLGVPAKVAGCKNIIVASPPSRATGKLTPEVVYVAHKLGAKCIVMAGGAQAVTAMAYGTESVLKCDKILGPGNQFVTAAKMYVQNDTQALCSIDMPAGPSEVLVIADSNADADFVASDLLSQAEHGVDSQVILIGVGLSDEKLNEFQAAVERQAKVLPRKDIVAKCLAHSYILLAKTYKEAFDLSNQYAPEHLILQIDDAPSYVPDSIENAGSVFVGALSPESCGDYSSGTNHTLPTYGYARQYSGVNTATFQKFITSQEVTEKGLQNIGKAVMELARVEGLEAHRRAVEIRMERMAETK

SEQ ID NO: 8714 - protein, 148 aa, Yersinia kristensenii
KGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLV

SEQ ID NO: 8715 - protein, 392 aa, Nocardioides sp. JS614
MSGRIVIVGGGLAAGTAAAALRDAGYDGDVVLHAAEPHLPYERPPLSKGYLAGDAEADSMLVHPASWYAENDVEVRTGSRVERIDADGHTVTAGGATESFDRLLIATGASPRHLAVADESGAPVAYLRTREDSDRLRSVLSPGHRIAILGGGFLGLEVAAAARTAGADVTVLEALDQPLLRVLGPEMGAMFADLHREHGVDLRLGAKVTGFDGDGRTARLTVEGSPDVDADLLVIGIGASPDVALAEAAGLAVDNGILVDERMRASRPDIYAAGDAARAHHPVLGRSIRVEHWDNAIRQGRVAGRAMAGDEDAVATDLPYFFTDQYDLGMEYVGDVGPEGYDEVVIQGDLAKRVFKAFWVAGGKVVAAMQANDWDASDSLRPAIGKSLAEIS

SEQ ID NO: 8716 - protein, 293 aa, Hordeum vulgare subsp. spontaneum
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8717 - protein, 337 aa, Marinobacter sp. ELB17
MDIHAELLSTIQGLVQPGKGVLAADESLPTISKRFDAVGVASTEDKRREYRSLVFSTPGLGEFVSGVILFEETLGQNSLDNVPIAKLLESQGIVPGIKVDTGKKPLINAPGDEITYGLDGLDDRLEIYKNQGARFAKWRAVYNVSDTLPSRQAVEANAEMLARYAALCQSKGIVPIVEPEVLIDGNHTIKRSAEVNEAVIAEVFNALRRHRVQLETIILKPSMVTPGKACAKASPAAVAEATLRVLRRVVPAAVPGINFLSGGQAPEEATLNLNAMNSLGQQPWNLSFSYGRALQEPAQRAWAGKLDNAHAAQTAILKRARLNGAASSGAYKTDMEG

SEQ ID NO: 8718 - protein, 357 aa, Oryza sativa (japonica cultivar-group)
MAGARSVGSLPVPNVQALAEICNDPDEHIPERYIRPEASSEEVINNYQGDMAIPIIDLKKLLCPQSSEEECVKLRSACQYWGFFLLINHGVPDEVIANLKRDIVDFFSQPLDTKKEYTQLPNSLEGYGQSFVFSEDQKLDWADMLYLHVHPSDSRDLRFWPTSPASFRQSIDAYSSETKSLALCLFEFMAKAVGAKPESLLDLFEEQPRGLRMAYYPPCRQADKVMGLSPHSDAGGLTLLLEINNVQGLQIKKDGKWFSIDAPNGALIANIGDTLEILSNGKFRSVEHRAVINPNKERISAALFHYPSENMVISPLPEFVKDGKVKYRSISYLDFMKQIFTQQLDGKNRVEVLKLDQ

SEQ ID NO: 8719 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFRETRHPVYRGVRRRRNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8720 - protein, 332 aa, Neisseria gonorrhoeae FA 1090
MSRPVPAVFGSVFHSQMPVLAYREGKWQPTEWQSSQDLTLAPGAHALHYGSECFEGLKAFRQADGKIVLFRPTANIARMRQSADILHLPRPETQAYLDALVELVKRAADEIPDAPAALYLRPTLIGTDPVIGKAGSPSETALLYILASPVGDYFKVGSPVKILVETEHIRCAPHMGRVKCGGNYASAMHWLLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKNQERGYAIRKAITDIQYGLAEDKYGWLVEVC

SEQ ID NO: 8721 - protein, 561 aa, Azoarcus sp. EbN1
MYRYDDYDQQLLDERVVQFRDQMRRHLAGELSDDEFRPVRLQNGLYIQRHAPMYRISVPYGHLASRQLRKLAYLARTYDRGYAHFTTRTNVQFNWSPLEAIPDMLAELASVQMHSNQTSGNDIRNITADAFAGVAADEIVDPRPWAEILRQWATYNPEFAYLPRKFKIALNGATEDRVVVRIYDIGLDLKRDADGNIGFRVLVGGGLGRTPILGEEIAGFVPWQHLVTYCESILRVYNRHGRRDNVWKARIKILVKALGAEEFARQVEEEWAHVKDGPNTLTEAEVQRVAAHFVDPDYETLPGRNALYEAQLADSKPFAAWVKRNVRAHKVPGYASVTLSLKKTGVPTGDITAEQMELVADWADRFSFGEARMTHEQNIVLADVKLSDLHTLWQLAREAGLATPNIGLLTDIICCPGGDFCALANAKSIPIAEAIQQRFDDLDYLYDIGDIDINISGCMNACGQHHVGNIGILGVDKNGEEWYQVTIGGCQGNATALGKVIGPSFARAQMADVVEKLIETYIEYRHEDERFVDTVHRLGIEPFKQRVYGGEVQKQRKVAHA

SEQ ID NO: 8722 - protein, 791 aa, Clostridium tetani E88
MKVPFKWLKDYVNINISANELGDRLTLSGSKVEEIISSGDEIQNVVTGKIEKIERHPDADKLVVCSVNIGKEEPIQIVTGANNMKEEDIVPVAVHGAVLPNDVKIKKGKLRGIMSNGMMCSEKELGMPESGVDGLMILPSDTAIGKDIKEVLDLDNAVIEFEITSNRPDCLSVVGIARETAATLGIKYTMPKLDYTPKNKANIKDSLEVEIRDDLCRRYMARGVKNVKIQESPEWMQERLEEAGVRAINNIVDITNFVMLELGQPLHAFDGRQITSNKIVIEKGKVGEKFATLDKVERTIDESVLCIKDGDRAVALAGIMGGLNSEVKEDTKEIILECANFDGTNIRVSSKKLGLRTESSSKFEKDLDPNLVEIAMDRVCHLIEELDAGEVMEGTIDIYKNPIKERNLKVDSNWMNKFLGTDISKEDMKEYLDRLELKTDVEGDTLNITVPTFRSDIVLKQDVAEEIARIYGYNNIPTTMFNSVSKRAGKTLKQHLEDKVVEILIGSGLNQSISYSFVSPKIFDKILIPKDNDLRNTVKIKNPLGEDYSLMRTTTLASMMEALSRNYSRNNSYARLFEMGKVYIPSQDEKVLPEERNTLVIGMYGEVDYLNLKGILENLIEELNIEKSSYKRESEHPTFHPGKTAKLYVNKEFAGLLGEIHPDVLDNYDIDEKCYIAELNLDVLFKNANIEKKYKALPKFPAVDRDMALLVDDEVLVQDIESIIRNKGGKILEDVKLFDVYKGAQIPEGKKSVAYSIVYRMPNRTLTDAEVNKVHDKIVRTLENNLGAELR

SEQ ID NO: 8723 - protein, 547 aa, Neisseria gonorrhoeae FA 1090
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETAHHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYRECRLKGGGAA

SEQ ID NO: 8724 - protein, 379 aa, Bdellovibrio bacteriovorus HD100
MAEVNIYEGALDKGLEGVVACTTKVSFIVGDSLNFRGYTIDDLAANSTFEEVTYLLWNDKLPNAQELAAFSTQLRNEMALSPDFIKVLKAIPTNVHPMGWLRTAVSLMAHWDSDANDNGAEANLRKSVRLTAKMGTLLCAFDAIRKGKEPVAPKADKSMAWNMMYMLGGGAEPKAEHVKVMDTCLILHADHELNCSAFATRVTASSLSDLHSAIVSAIGALKGPLHGGANEQVILMLQKIGTMEKAQQFVKDALAAKEKVMGIGHRVYKNGDPRARILRGMSDKLTKDAGIHHMYEMSTLIDDTMFNEKGLMPNVDFYSATVYFSMGIPTDLFTPIFAASRISGWCAHAFEQYANNRIYRPRGKWAGKEGLKWTPANQR

SEQ ID NO: 8725 - protein, 325 aa, marine gamma proteobacterium HTCC2080
MKMSVREAINLTLHEEMARDPRVVIMGEDVASGQGGVYGVTAGLTEKFGVARVIDTPITESAIVGAAGGAALTGLRPVAELMFIDFLGVCLDQLLNQIAKFRYMFGGQARTPLVIRTMIGAGEGTGPQHSQILYPMLAAIPGIKVVAPSNAADAKGLLAEAIRQDDPVVFCEHKALYMDECEVPEGDYVIPFGKARTVVQGTDITLCGLSRMAVLADQAAAELAAEGISAEVIDPRTLSPLDEESILASVSKTGRLVVVDESNPLCSMASEISGMVAEFGFDYLDAPVQRVTAPHTPVPATPCLEKDYVPSVADIVRAAKKALAY

SEQ ID NO: 8726 - protein, 105 aa, Glycine max
DYFYCGSSLCGNLNPQRVREWIAYHVRFFGPKSHFVIHDAGGVLEEVLEVLKPWMELCFLTLQDITDPLRFDGYYPFFFLPVHDCLLRFKLMAGWMFFFDVDEYL

SEQ ID NO: 8727 - protein, 372 aa, Burkholderia xenovorans LB400
MRIVIVGAGQAGGWVARALRDEGFTGQITLVGEEAHPPYQRPPLSKEVLLGDVPPEHCYLWPAGLDAELRLNTRVRSIDRSARQLRLADGGTIAYDRLCIATGGRVRRLDMPGAHYLRTIDDALALRAALLRGGSVLVIGGGWIGLEAAAAARRFGCSVTVVEAAARLCSRVVPPMLSEYLHGLHHRNGVTIACNATPDVAAHDTIIVGIGIVPNTELAEDAGLEVANGIVVDEYGTTSDADIFAVGDVAALNGQRIESWANAQNQAIATARSMLGKYTPYSEIPWFWSNQYDVNLQFLGFARPEDEVVVRGDVASDRFSLFFLSSDRISAMIAANSMKDIRAGKRLIERGISVSPDRLADPSQSLQDLLKA

SEQ ID NO: 8728 - protein, 325 aa, marine gamma proteobacterium HTCC2080
MDYNLDELTRAYRLMKTIREFEERIRSEYQQGKLPGFIHMYRNQEAIAVGACLDMRNDDYIASTHRGHGHCIAKGCELEGMMLELACKQDGLCNGKGGSMHIADMTKGMLGANAIVGGGPPIAAGAALTAKTLQTGGVSMAFIGDGASDQGTVAEALNLAVVLQLPMIFMYENNFYAEFTRNPKPEGRIAERAGAFGMPSTVVDGSDFFAVHAACREAIERGRNGGGPTAIEAVSARYYGHFEGDPQAYRDDDELRSQREAGDPLPHFLADSRVAALDASLIAEIDSSIFAELDRTVEFALAAADPTPEKLYTDVYVNYEGRAMQ

SEQ ID NO: 8729 - protein, 250 aa, Rickettsia typhi str. Wilmington
MEDIDIWQEKFEFCNYSKKLIGRIEYLNTIVDSPIDIIEVKKGIYYTRKYHATQMRQSGEPYYSHPIEVAIMLADFTALEAPKLYKSYMINVALLHDTIEDTILTHADISKIFDKNIADNVERLTRIKPYGKISSGEMLNLLIQEQRYDIALIKVFDRLHNLQTINAKSTEKALETVKETIESFLLIAAYLEIRTVEQQLLNVCNNFIKQHFPSEQKAIFRSVYEISFFNFKIIQNKLKRMQYYFRKKKA

SEQ ID NO: 8730 - protein, 113 aa, Rickettsia typhi str. Wilmington
MTGRIKHPISILYKLYRKGIKLEELTDIFAIRIVVIDEEKCYKALKIVHELYDHEKDKFKNYILNPKPNGYQSLHTIIITEDNYKIEIQIRDYNMHYNAESGDAAHWKYKNSF

SEQ ID NO: 8731 - protein, 411 aa, Xylella fastidiosa 9a5c
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFHGSFHGRTLAAVTATAQPKYQEGYEPLPGGFRYVDFNHIEALEAAMVGGDVAAVMLEPIQGEGGVMPVVSGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAVEHGVLLLQAGPDVLRFVPALNVSDEELADGLVRLRAALGDYVSRFGG

SEQ ID NO: 8732 - protein, 432 aa, Oryza sativa (indica cultivar-group)
MADELDELLGFLSSPQPNVRGAAAGIVRGLTGDADGLRALSARADRALPALLRLLASAGGELGTGGAAADSLVNLSQDGALSARLVSLGAVVAAMDVVAKRGGEQPGLARSLVMLLANLTQVDSGVAALLQVAHCSFSQIKFHRVNTDILNPDYTLKFCCFQKVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQDEGRRAFWSVNGPRILQVGYEDEEDPKVMEAYELIGSLVFPWLKAIKSSPYNYVRTWRNMHKQSNLPTFHRKIRKLVNVHMSPLTGGFASGQRNIQPPVGKTTGFWINVPF

SEQ ID NO: 8733 - protein, 198 aa, Yersinia kristensenii
SIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 8734 - protein, 175 aa, Oryza sativa (indica cultivar-group)
MASSSSAQETGRWSLAGATALVTGGSKGIGRAIVEELASFGATVHTCARNEATQNSCLEEWSAKKLSITSSVCDVSARADREALAGRVAAIFDGKLDILVNNVGFLFLKPAVNVTPEELSRVMAGNLESCFHLSQLMHPLLKTSGKGNVVNISGISTVTGFPSLPICAFCAAKGS

SEQ ID NO: 8735 - protein, 547 aa, Magnaporthe grisea 70-15
MSVRPRPEGLLEPRRPGGNGEYRKTTDAEDVTTAEPLSDGGYRDFSDIDPDSGVKRGLKTRHLSMMALAGIIGPGLLIGSGGALASGGPAALIIGFGVIGIVAFSIMQSLGELTTLYPTGGAFTSLSSRFVDKAFGVAVGWNYYIIWWAVLSNEYNVICSIFNLWGSQVPIWGYFLIFWLLGVESFGEAEFWLALLKLIGLVAYFIFSLVYVGGGIPGAPALGSRYWHDPGAFANGFKGVATVFVFCSTFYAGVESVAVAATETKNPRTAIPLAIRQVFWRIVFVYMGSAIFFGLTCPWDADGLVSGENRALRSPMTVAIQNAGWQSGVHLINAFIFVTCLSAINSSIYIASRTILFMAQSQMAPKFLGWTDRRGVPIPAILFANACGSLSMMNISTGAATAYSYIVNLSGVSTFLVWGSISFTHIRFRTAWQAQGFDPQSLPFRSMLYPWNAYFGLGANVFLALVQGWSTLAPFDAPTFVDAYILIPLFAVIYVAYKFAFKTRFWRAEEIDLLSGRRRDLEEDREIQNRTPSGAPLSAWQRLWKNF

SEQ ID NO: 8736 - protein, 202 aa, Yersinia kristensenii
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGKTA

SEQ ID NO: 8737 - protein, 782 aa, Gibberella zeae PH-1
MDSSEKRDITPQASSEGDVISTDKKDLPRDEKDNYDVEVLKSEPTRPLETAEDIVTHVIQVDDDPTMNPWTVRMFVVGIGLSAFGGVLQEIMYFKPQVVYVSVMFLTVLAETLGTGLSYIIPRKGAIGRFLNPHPWNRKEHTAAVLMASAASVSALSTEALSVQKLWYGGYPNQAAGIFITLSSQLIGYGIAGMMRSVLLYPTKMLYPANLPITTVMETLHKPKSETRKRFQVFWIVFVAIFCWEWFPEIQYIFPLLSAVSIFCLADRNNPVFTNLFGGSQGNEGMGFLSLCFDWNYIAGFGSPLWMPLQTLVNSFIGYFGGILLSIGLYYSNVWRAKDFPFMAQLLYDGSSNSTNYVQYNETSIMNPDFTVNNDAIDKQGLPYLTATYVNYLITSNAGLTATLVHMLLWNYAEVSLGWSWITMSTLKKAFHPQTYIFWRQSGSRTEEEKTKLRDDPTIDPHYKLMLDYDEVPNSWYFLVFAASFIVGMTCLYVMKSTLPWWGFILAVVFLVVFLVFFGAQYAITGFSFNLQPIFQMLAGYMFPGRPLANMYFTSYTYNALSQGFLLLRDLKLAQQNKLSPKATFTTQVIGCCLGALLNYVMMISIIDNQAPILKSAEGTNIWSGAQIQQFNTLAVAWSIAPRMFSIGARYQWVTIAFFIGFLAPLPFYIAHRFFPRMRIWSYLNTAIILWYLGELFVGLNASLTSYYILGAFGQFYLRRYRPQAFVKWNYLVSAALDGGTQVMVFIATFAVFGGSGKAVSFPEWAGNRVNNYDYCKYNAQG

SEQ ID NO: 8738 - protein, 196 aa, Yersinia kristensenii
SIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8739 - protein, 562 aa, Bacillus thuringiensis serovar konkukian str. 97-27
MTTTTTVKSDIEIAQEASMKKIQEIAADLNILEDELEPYGHYKGKLSLDIFKRLQNEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVAYLQEWCNERGYAVSLTEVWEKGGQGGVDLAEKVLKEIEKGENNYAPLYELELPLEEKIRTIAQKVYGAKDIEFAPKARKQLAQYEGEGWSNLPICMAKTQYSLSDDATKLGRPSDFIVTIRELKPSIGAGFIVALTGTMLTMPGLPKQPAALQMDVNEDGKAVGLF

SEQ ID NO: 8740 - protein, 189 aa, Yersinia kristensenii
ESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 8741 - protein, 240 aa, Oryza sativa
ASVGPREFGHYARGIGSGLLVLPPGTDLHNHHLVSEGKVFLQGKASCMVAAALCPEPGWKVIDACAAPGNKTVHLAALMNGEGSITACELNKERTKTLQNTIRRSGANNIETINGDFLDIDSNDPSYAEVRAILLDPSCSGSGISTERLDHLLPSHSRGNQDDASTSSRIRKLSDFQRKALSHDLSFPSVERVGHRSRAKHTTVKQRNKENPTTNRAHKREKQPNPNTTRASEVSRLEDR

SEQ ID NO: 8742 - protein, 287 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8743 - protein, 319 aa, Mycoplasma pneumoniae M129
MEQPLCILGIETTCDDTSIGVITESKVQAHIVLSSAKLHAQTGGVVPEVAARSHEQNLLKALQQSGVVLEQITHIAYAANPGLPGCLHVGATFARSLSFLLDKPLLPINHLYAHIFSALIDQDINQLKLPALGLVVSGGHTAIYLIKSLFDLELIAETSDDAIGEVYDKVGRAMGFPYPAGPQLDSLFQPELVKSHYFFRPSTKWTKFSYSGLKSQCFTKIKQLRERKGFNPQTHDWNEFASNFQATIIDHYINHVKDAIQQHQPQMLLLGGGVSANKYLREQVTQLQLPYLIAPLKYTSDNGAMIGFYANLLINGKNN

SEQ ID NO: 8744 - protein, 114 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGGHHGGGGHGLNEPVQTKPGV

SEQ ID NO: 8745 - protein, 331 aa, Oryza sativa (indica cultivar-group)
MAHKRGRLVGWVLLLLLAVAIAGAAAATPRQLFLVTQAPVTLTNHHGQLLTGNYSVNLLWYGRFTPAQRATVADFLLSMSSPSAAAEAAAVSGGPAAPSVASWWATTARYHPGAARLTLGRQVLDASLSLGRRLSETSLAALAARLSPHRGSIAVVITAPDVLVDGFCLSHCGLHASATSAAAAAATASPAATRGRGRFAYAWVGNAAEQCPGECAWPFHQPAYGPQAPPLVSPNADVGMDGIIINLATLLAGAVTNPYGGGYFQGPTEAPLEAVTACTGMFGAGAYPGYPGQLPVDAATGASYNAVGVAGRRFLLPAMWDPKTSQCSTLV

SEQ ID NO: 8746 - protein, 272 aa, Bacillus anthracis str. Sterne
MEESRMWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFNNVKISDKAFKEWPNCYHELLNEYERDEILNYIQSFTEIRINNIIETNK

SEQ ID NO: 8747 - protein, 575 aa, Medicago truncatula
MVETRILPDDCWESVITFLTGGDSNHPYLKSLSVVSKQFLSITNNLPLSLTVYNQTRPFLPRLFIRFTNLTSLNLTCFGGDLDGLLCVISCFRLNHLTSLNLSNQPFIPTNGLQVFARKFTTLNSLTCSNIDSLCNNDLVCISGCFPFLEELDLSNPKEIIDITDVGVKAMSTALPKLRKVNLSGHYYINDSLLFHLCQSCEFLEEFVMLDHSSRWSPSLTNDGIASAIRVRPSLRSLSIKWPSKGRHDISSHLIDSLMCLKGLTCLDFRSSRISDMLLSSIAMEAIPLRKLVLQNCFGYSYAGISCFLSKCQHIQHLDLQNAVFLTNQHVLDLSLFLGDLEFINLSQCGQLTNLALFALVSNCASLSEIKMELTKIGMESVENSNSFKDFVVSPQLKSLHLAKNSCIRDESIKMFPSMFPNLQLLDLSYCRNISEDSICDVLRRCCKIRHLNLSNCLVVNLFGMNFEVPKLEVVNLSRTIVNDETLYVISKSCCGLLELLLEECFHVTEKGVKHVLENCTKLREINLRACNKVNVNAVASMLFLRPSLRKIIAPSGLDLSKTERIFLHRGDYAC

SEQ ID NO: 8748 - protein, 320 aa, Cuphea lanceolata
MATATAAGCSGAVALKSLGGRRLCIPQQLSPVLAGFGSHAAKSFPILSTRSIATSGIRAQVATAEKVSAGAGQSVESPVVIVTGASRGIGKAIALSLGKAGCKVLVNYARSSKEAEEVSKEIEAFGGQALTFGGDVSKEEDVEAMIKTAVDAWGTVDILVNNAGITRDGLLMRMKKSQWQEVIDLNLTGVFLCTQAAAKIMMKKKKGRIINIASVVGLVGNAGQANYSAAKAGVIGFTKTVAREYASRNINVNAVAPGFISSDMTSKLGDDINKKILETIPLGRYGQPEEVAGLVEFLAINPASSYVTGQVFTIDGGMTM

SEQ ID NO: 8749 - protein, 502 aa, Brassica rapa subsp. pekinensis
MARKMLSDGELNKAAAAGEEATTETHYDFDLFVIGAGSGGVRAARFSANNGAKVGICELPFHPISSEEIGGVGGTCVIRGCVPKKILVYGATYGGELEDARNYGWEINGNVDFNWKKLLQKKTDEILRLNNIYKRLLANAAVKLYEGEGRIVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGINLHPQTSLAELIKTDDGIKVISSHGEEFVADVVLFATGRIPNTKRLNLEAVGVELDQAGAVKVDEYSRTNIPSIWAVGDATNRINLTPVALMEATCFANTVFGGKPAKADYTNVACAVFCIPPLAVVGLSEEEAVEKATGDILVFTSGFNPMKNTISGRQEKSLMKLIVDEKTDKVIGASMCGPDAAEIMQGIAIALKCGATKAQFDSTVGIHPSSAEEFVTMRTVTRRIAYKAKPQTSL

SEQ ID NO: 8750 - protein, 337 aa, Medicago truncatula
MERQTKRRRKTLNSSLQQQIIASSIQTRSKTRSLVIDFYFPDECWEFVFKFLINYGNSDGNNRLYLRCLSFVSKQFLSITNRLRFSLNISNSTRPLLPRLFQRFTNLTSLNLTHFRGDLDALLAEISCFPLNLTSLDLSQKPTIPANGLRAFSQNITTLTSLTCSFTKSINYSDLFLMVDCFPNLQMLDLRYSYDVSEEAVVHVLRTCCNIRHLNLTRCSRVKLRTLNFKVLKLEVLNLSFTRVDDEALNVISKSCSGLLQLLLFYCSDVTDKGVNHVVENCTQLREIDLGGCDKVHANVVASMVHSRTSLRKIGAPPGFDLSDTEKLFLHHGCYVS

SEQ ID NO: 8751 - protein, 470 aa, Myxococcus xanthus DK 1622
MDPITPPLALGQKHVVVLGAGFAGLTAAKALARHSALYVTVLDQRNHHLFQPLLYQVATSGLSPADIAVPIRSQFARKPNVSVHLGRVTWVNLKERWVGGEGDVRLRYDYLVIACGAQHSYFGKSEWEDFAPGLKTLEQATELRRRILSAFEQAENERDAERQRALLSFVVVGAGPTGVELAGAIADISRTVLVRDFRRIKPSRARVFLVEAGPRILPSFSEKLGVRAHRDLAALGVEVRTEARVTAVDAEGVMLGSERLASRTVVWAAGVQAEYLTRGLGVPLDRAGRVQVAADLTLPGHPEVFAAGDVAHVELDGKLVPGVAPAAMQMGRAVARNVLADLRGRPRTPFRYKDKGAMATIGKHRAIAETGRARLTGFVAWVAWLFIHVWYLVGFKNRFGVFVTWVWSYLFSTRGARLITEREWRLSPKVASERAPHAGKVTAGDPTAPTSDARPPDGTTTTAAAALVAD

SEQ ID NO: 8752 - protein, 254 aa, Medicago truncatula
MVVAVLGIFSITISDLTSDCLSQLFQRFPNLTSLNLNPYGNRFCWIPALTSSVRIQFTQTNSLHNSNSSFASPQIKDLHLNTQTWLKDETVQTIASVFPNLKLLDLIYCHKISEKGICHVLRTCSNIRHLTLTDCLGINIPGANFEVANLGVLNLSLTYIDDEALHVISKSCRGLLELYLQFCICVTDKGVKHVLENCTQMREINLRCISKMHGHDLVSLILSRPSLRKLTTPYPCRFSDREMELLLRKGCIGC

SEQ ID NO: 8753 - protein, 229 aa, Xylella fastidiosa 9a5c
MTLRPFIETVVMPPNAQPPQTCDPKQMSSPLECAKYLLSAHTTHQLPADDGSEVAFAGRSNAGKSSVLNTLTRQNALARVSKTPGRTQQLVYFTVTPQRYLVDLPGYGYAKVPKELQIHWQTFIDSYFHQRQALRGLVVVMDIRHPLKEYDLQMLAYARQRGLPAQALLTKADKLGRGQQAQTLQKVRNELTKHFADHINIQTFSSKSRQGVEQLHTVIETWLGLARLA

SEQ ID NO: 8754 - protein, 325 aa, Geobacillus stearothermophilus
MGSSHHHHHHSSGLVPRGSGTENLTPQHMASMALTGTDRVKRGMAEMQKGGVIMDVVNAEQAKIAEAAGAVAVMALERVPADIRAAGGVARMADPTVIEEVMNAVSIPVMAKVRIGHYVEARVLEALGVDYIDESEVLTPADEEFHIDKRQFTVPFVCGCRDLGEAARRIAEGASMLRTKGEPGTGNIVEAVRHMRKVNAQIRKVVNMSEDELVAEAKQLGAPVEVLREIKRLGRLPVVNFAAGGVTTPADAALMMHLGADGVFVGSGIFKSENPEKYARAIVEATTHYEDYELIAHLSKGLGGAMRGIDIATLLPEHRMQERGW

SEQ ID NO: 8755 - protein, 345 aa, Sulfolobus solfataricus P2
MIIKPEPSLKDLSYIIENAGLKASDLLNMYKRMLIIRYFEESIRKIYHEGKNPFNMASGRIRGEMHLSIGQEAVAVGTLYDIRDEDVVVSTHRPHHHAIAKGVDLKGLAAEILGKATGLCKGKGGHMHLFDKSKNFACSGIVGASFPQAAGAAFAFKYLGKDNVAISFAGEGAANHGTFAETLNIASAWELPLIIVIEDNKYADSTPKSFVMSTTFHYQRGLAYNVPSYLVDGMDVIDVYSTSKKAIERARKGFGPTLIEALTYRYVGHFEGDGEEYRTKEEVEFWSSLDPIRRLENRLLRLNYADSDILARLREEARKQVQEAIDFAINSKYPELTDAFGGVFA

SEQ ID NO: 8756 - protein, 332 aa, Sulfolobus solfataricus P2
MKIRGIAQAIAEGIRQEMERNDRIVVLGEDVTYWGAVFGFTMGLFDKFGRKRVIDTPITEQTFMGISVGAASSGLHPVVSLMFVDFLGAGFDQMFNHMAKNYYMSGGQYPMPITVITAIGGGYGDSSQHSQVLYSLFAHLPGFKVIVPSTPYDAKGLTIKALRDNNPVIIFGHKLLTGLPFLPFEGNEEEVPEEPYEIEFGKAAIRKEGTDLTIISAGLMVHRSLKAAEMLQKEGISAEVIDVRTFVPLDEETIIKSARKTGRVLIVDEDYMSYGVTGEIAFRIQSKALKDLKVPISRLAVPDVPIPFSEPLENAVIPNVNTIYSEAKKLIQ

SEQ ID NO: 8757 - protein, 508 aa, Zea mays
MCDCVYIYPRQWAVASSVEGGEGGGQRKQGQRKQSSRAKASVSMMGPLPLRRRRVGVLFLALVLLGGGGADAGTTSSYRRKLEATVEMPLDADVFRVPPGYNAPQQVHITLGDQEGTAMIVSWVTASEPGNSTVAYGEDPARMERRADGAHTRYDYFNYTSGFIHHCTLRNLKHATKYYYAMGFGHTVRTFWFTTPPKPGPDVPFKFGLIGDLGQTFDSNITLSHYESNGGDAVLYVGDLSYADNHPLHDNNRWDTWARFVERSVAYQPWVWTAGNHELDFAPELGETTPFKPFAHRYPTPYRAAGSTEPFWYSVKVASAHVVVLASYSAYGKYTPQWAWLQAELARVDRKTTPWLVVLTHSPWYNSNNYHYMEGETMRVQFERWLVDAKVDLVLAGHVHSYERSHRVSNVAYDIVNGKSTPVRSADAPVYVTIGDGGNIEGIADNFTRPQPGYSAFREASFGHATLDIKNRTHAYYSWHRNHDGAKVVADGVWFTNRYWMPTDDDTN

SEQ ID NO: 8758 - protein, 339 aa, Candida albicans
MAHHHHHHGHHHQLSEDSELIEQVIEQPDSLIISPPSDSSSSSYNHIQPFVYLESTATTQTNHNVLLILNQKITIDLISLWKKCEIIVCADGGANSLYEYFNDNNHHHHHENLQRSDYIPDYIVGDFDSISPDVKTYYESHGSKIIRQSSQYYNDFTKSIHCIQLHYQLNHTKENWFESIDEVDGLAKLWNGLNNSSDVVVDIDITIYVLNAIGGRFDQTVQSINQLYIMNEDYPKVTVFFITTNDIIFLLKKGVNYISYKNRLMFHKDNGSSPTPTCGLLPLSNKTPIILNSYGLKYDMRNWKTEMLGQVSSSNRISGETGFIVECSDDIVMNIEIDV

SEQ ID NO: 8759 - protein, 335 aa, marine gamma proteobacterium HTCC2080
MPRAVNLARHPTGAVRPEDFEVVEAPRPEVPEGWFLIKNRVFSLDAGFRQWMSAGAGDNYLTGMQLNEPVQSIVLGEVVESRHPDFEVGTLVNARTAWEEMSLLDGTDLCSPLLAAEDLPLSEYMSTLGPTGMTAWLGLNHIGQPKPGDVVVVSAAGGAVGTIVGQLAKAAGCRTIGLVSSAAKAQWLTDEVGYDLAISREAHPDLAQALIEAAPEGIDIFFDNVGGSVLNTVMQHLQEGARLVLCGAISQYEAEVEPVSHTWELITKRARMEGFMFSDYTDEFPAVIEAMEKLLRAGELKTFDQCYQGIEQTPTAFCDMMSGASRGKCLVVLED

SEQ ID NO: 8760 - protein, 197 aa, Yersinia kristensenii
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8761 - protein, 357 aa, Nocardioides sp. JS614
MEISTTPSSAAVSDERLAEILANPGFGLHFTDHMLTVEWAPDAGWHAGRIEPYGPLTLDPATAVLHYAQEIFEGMKAYRHADGSIWSFRPEENAARMMRSSRRLALPELDVADYVQAVDALVTADQRWVPDPAGEKSLYVRPFMFASEAFLGVRPAQHVTFMVIASPAGAYFKGGVKPVTLWLTDEYTRAGRGGMGAAKTGGNYASSLVAQQQASAQGCDQVVFLDAQEGQYVEELGGMNMYFVHDDGTIVTPETGTILEGITRSSIIELAGKLGHQVEERRFSIDEWREGVRSGRIVEIFACGTAAVVTPVGELKWDGGSAPAPASTDLTMRVRQALVDIQYGRAEDTFGWMHRIV

SEQ ID NO: 8762 - protein, 478 aa, Nocardioides sp. JS614
MHGLSVHLSRRCLRARPAPAVRRDPHPDGSPSARATHEQTARPAPGHLRLRCIGTARLPIHLKSTRERTDRCTTCTPTGVPPATTPTTRAATRTSPRPSRPRSTCGTTAASARTTTSLGRMTTTHTGTSGSLRLAVIPGDGIGPEVTAEALKVLEVASPAGVKFEQTRYDLGAERYLATGEVLPDSVLEEIREHDAILLGAVGGKPNDPNLPPGILERGLLLRLRFELDHYVNLRPSRIFPGVASPLANPGEVDFVVVREGTEGPYTGNGGALRVGTPHEIATEVSVNTAFGVERVVRDAFARAQRRPRKKLTLVHKTNVLVNAGAVWWRITQQVAAEYPEVSVDYMHIDAAMIFMTTDPARFDVIVTDNLFGDIITDLAAAITGGIGLAASGNVNPDRTAPSMFEPVHGSAPDIAGQQKADPTAAILSASLLLDHLGYADAAAVIETAAIADLAAREPGAARRTADVGEAIAARVAG

SEQ ID NO: 8763 - protein, 159 aa, Yersinia mollaretii
SDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEV

SEQ ID NO: 8764 - protein, 426 aa, Oryza sativa (indica cultivar-group)
MSLGYAEKLSYREDVGNVGMPEIFDSPELLHKKIEELAVMVRESKHLVVFTGAGISTSSGIPDFRGPKGVWTLQVRSGKGVPGASLPFHRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQTADLVLCLGTSLQITPACNMPLLSLKNGGRVAIVNLQATPKDKKASLVIHGLVDKVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRYDTEDSKAAVPMATWMNSNGSLSKRHMDAIGCNPASSKKQKLVATRHRRKGLNPATQKV

SEQ ID NO: 8765 - protein, 245 aa, Ralstonia eutropha JMP134
MRQKLVIGNWKMHGSLAANAALLEGIKAAPARARLAVCAPFPYLAQCQALLNGSQVAWGAQDVSAEARGAFTGEVAASMLGEFGCTYALVGHSERRTYHGESDAVVAAKALRALEFGIIPVICVGETLAQREAGETEVVVGRQLQAALDALSVEQLGRVVLAYEPVWAIGTGKTASSEQAQAVHAFLRAEVRERDAGVADRMAILYGGSVKPDNAAELFSMSDIDGGLIGGASLKSEDFLAIGNA

SEQ ID NO: 8766 - protein, 151 aa, Yersinia mollaretii
LMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAG

SEQ ID NO: 8767 - protein, 406 aa, Arabidopsis thaliana
MSSIIHGAGAATTTLSTFNSVDSKKLFVAPSRTNLSVRSQRYIVAGSDASKKSFGSGLRVRHSQKLIPNAVATKEADTSASTGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKEKIPDEDYVCNLEEAEMVRPGEHITILTYSRMRYHVMQAAKTLVNKGYDPEVIDIRSLKPFDLHTIGNSVKKTHRVLIVEECMRTGGIGASLTAAINENFHDYLDAPVMCLSSQDVPTPYAGTLEEWTVVQPAQIVTAVEQLCQ

SEQ ID NO: 8768 - protein, 196 aa, Yersinia mollaretii
SIGGWKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8769 - protein, 417 aa, Ralstonia eutropha JMP134
MADIKNYTLNFGPQHPAAHGVLRLVLELDGEVIQRADPHIGLLHRATEKLAEQKSWIQNVPYMDRLDYVSMMSNEHAYVMAIERLLGIEVPIRAQYIRVMFDEITRLLNHLMWIGAHALDVGAMAVFLYAFREREDMFDMYEAVSGARMHAAYYRPGGVYRDLPDTMPQYRASKVHNERAIKVMNEARSGSLLDFIEDFTNRFPKYVDEYETLLTDNRIWKQRLVDIGVVSPERALQMGFTGPMLRGSGIAWDLRKKQPYEVYDKMDFDVPVGVGGDCYARYLVRVEEMRQSNRIIKQCIEWLRRNPGPVITDNHKVAPPSRVDMKSNMEELIHHFKLFTEGMHVPEGEAYAAVEHPKGEFGIYAISDGANKPYRLKIRAPGFPHLAALDEMAKGHMIADAVTIIGTQDIVFGEIDR

SEQ ID NO: 8770 - protein, 434 aa, Acidovorax sp. JS42
MTHNTDLNLPLFERAKALIPGGVNSPVRAFRAVGGTPRFITRAQGAYMWDANGQRFIDYIGSWGPMILGHGHPAVLEAVQKAALEGFSFGAPTEREVELAEEIIRHVPSMEMIRLVSSGTEAGMSAIRLARGATRRNKIIKFNGCYHGHADSLLVKAGSGLATFGHATSAGVPQEVVQHTLVLEYNDVAQLEEAFTLHGPDVACVIMEPIAGNMNFVRASVPFMRRARELCTQHGALLVIDEVMTGFRVALGGAQSLYAQAIPGFKPDITVLGKVIGGGMPLAAFGGSRAVMEQLAPLGPVYQAGTLSGNPVATACGLATLREIAKPGFYDALGARTRALIDGLAGAASAAGVPLCGDTQGGMFGFFLLPQLPQNYPEVLNTDGMRFNTLFHGLLDGGVYIAPALYEAGFVSAAHTEQDIADTVAVARDVFQKL

SEQ ID NO: 8771 - protein, 659 aa, Haemophilus influenzae R2866
MFTIYNNSNPIPMGYSQAVENNVQITNFALFSAAASGVELCLFDEQNQETRLPMVRTGNVWHLAVTGVKTGTEYGFRIHGEFANPQKLILDPYAKAVNGKPDLSSEESRSWFLLSDNRDNAHLAPRAVIISEEFDWEDDTSPNTSWAKTIVYELHVKGFSQLNEKIPAALRGTYTGLAHPVNLAYLKELGVTAVELLPVNFHINEPHLQARGLQNYWGYNPLAMFAVEPKYAATNNPLAEFKAMVKAFHNAGIEVILDVVFNHSAESEQTYPTFCQRGIDDQTYYWRNDQGRYINWTGCGNMLNLSSDVGRKWVVDCLRYWVEQCHIDGFRFDLATVLGRDTPDFNSSAQLFTDIKNEPSLQNIKLIAEPWDIGHYGYQVGNFPSYFAEWNDRFRDDLCRFWLWKSGEIGAFAERFAGSSDLFKKNDRLPHTTLNFITAHDGFTLKDLVSYNQKHNETNGEENRDGRNENYSYNHGVEGSTESLSEPQKSAVENNRTFAQSGLLMSLLLANGTPILLAGDEFGNTQYGNNNAYCQDNEITWLKWANFNEELFELTKQTIALRQQIGSLNKDQWWSDENVQWLNIVGEPMTVEDWQNQQTKALQVVLDNRWLLLINAKAEGQMFHLPNRKWKPQIGTHNVTLEAQQAELSSMGFCMLNDE

SEQ ID NO: 8772 - protein, 781 aa, Pseudomonas putida GB-1
MAKPISRASSARLANSLIAWHPVAWRGGRVEGAGDIVLHLWPIGLPQAIEHTDRVCIGPVDAQVHQWPGQFASNLQRRRVHRPGFATGGHRRVHGRQQAVGQVPTRLLESQHHGLYYLGRRQQVARRCAVFAGHRIVCTQRFAPREQRHLPLAVDHRDLAILTPAVGTQHPVQGRGGWQLALLHGIENLRAQCRQGDVLGRDRAYTGAHPRATGAYGDARRADGDADLAGFLAAANDGEGHGEAPVVLCDAGHSGCNLLPHETNIFLCLEQEKTKPAKVRQTPHENPLKVCYRPCNSRPSPFYRQAPAKYYFRHSCRIPSLAPDNGGPPNRPDNNRLNKGSDMTLNNLEIDTLVVGAGQAGVAMSEHLSKLGVPHLVLERNRIAEAWRTGRWDSLVANGPVWHDRFPGLEFNLDADAFAGKDQVADYFEQYVRKYNLPVRTGIEVKRVVRNSDRPGFTIETNEGVIRANRVVAATGPFQKPVIPAIAPKDSNLHQIHSAAYFNPEQLPEGAVLVVGAGSSGVQIAEELMRAGRQVYLSVGAHDRPPRAYRNRDFCWWLGVLGEWDAEIAKPGREHVTIAVSGARGGHTVDFRALAHQGMTLVGLTQSFENGVAHFQDNLVENINRGDENYLALLDAADAYIECNGLDLPEEPEARTRLADPACMSNPLQQLDLAKAGVSSIIWATGYGVDFSWLQVDTFDANGKPQHQRGVAREPGVYFLGLPWLSRRGSSFIWGVWHDAKHVAGHIATQRTYLAYRDREQREADEQQTNMISNVSTLGAH

SEQ ID NO: 8773 - protein, 294 aa, Clostridium tetani E88
MSIFKGSGVAIVTPFCENGVNFKKLEELIEWHIENSTDAIVICGTTGEASTMTEAEIKETIKFTVDKVQGRIPVIAGTGSNNTRKAIELSKWAKSIGVDGLLLITPYYNKTTQKGIVEHFKAINDDVDVPIILYNVPGRTGLNILPKTLVKICDTCSNVVAIKEASGDLSQIIEMKALLKDRIDIYSGNDDQIIPILSIGGIGVISVLANIMPKEVHDMCELYLKGKTKKALEIQLNTLSLTNSLFIETNPIPVKTAMNIMGIDVGELRLPLCNMDESNLNLLKKELSNHALIK

SEQ ID NO: 8774 - protein, 268 aa, Anaplasma marginale str. St. Maries
MVEHLTCNQGVVGSSPAAGSLVLSVELMSFLVVANWKMNGDTALVRDFLAAIDTSFASDLLNKGSLELVICPPFTLMSAFDSRCPSVRLGAQNCFSGVSKGCTGEISAAMLKECGCDYVILGHSDRRGTFAEENSDIRLKAESAIEEGITPIICVGETLQERNSGISSDILVEQCSKCCPKYGEFIIAYEPVWAIGGSTIPDLEIIRESFDTIRSHGSARTILYGGSVNQGNIRALKSQIDGLSGVLVGSAGTKVDEFCGIISNVLEL

SEQ ID NO: 8775 - protein, 453 aa, Medicago truncatula
MEWGLTEISSFPLNITSLNLANSALIPLNGLRAFSQNITTLTSLNCSYKDSISTTDLLLISDCFPLLEELHLSKPAIFRGDFLSGMETLSLALPKLRKVNLSRHTYLNDQLLFQLFNNWKLLEEVIIFESTGITDAGIASALRVRPTLRSLSFHNFFKSDNISTLFALIKSCTSLSDIKMESPSDVTMKHTCMKEKNAENSNSLVDLAVCPQLKSLSLAHNTWLSDENIIIMFASIFPNLQLLDLSYCNQVSNSLTREKIVENTNSSMEFVVNHQLKSLFLTRNTWLSDENILMFASIFPNLQILDLSYCNQISDSICQVLRCCKLRHLNLAHCSKVKLRGLNFEVLKLEVLNLSYTGVDNEELYLISKSCRGLLQLLLEHCYYVTKRGVNHVVENCTQLREINLKNCYKVHKNIVDSMILSRPSLRKITVPPRYRFNNNKRELFLGHVCLLG

SEQ ID NO: 8776 - protein, 155 aa, Brassica napus
YDQNGRPNGSAEVVYMRRSDAFQAMKRYNNVLLDGRSMKLEILGGNNEVAPVAARVNVTGLNGRMKRTVSIGQGIRGGRGRGRSAAPSMRRLPIGNQQGGGVRSGRGGFRGRGRGQAGGGRGNKGGRGGKKAVEKSAEELDKDLETYHAEAMNIS

SEQ ID NO: 8777 - protein, 137 aa, Streptococcus pneumoniae TIGR4
MEQTFFIIKPDGVKRGLVGEVLKRIEQRGFTIEKLEFRSQVSEELIDQHYQDLVGQSFYPPIREFMTSGPVLVGVISGPKVIETWRTMMGATRPEEALPGTIRGDFAKAAGENEIIQNVVHGSDSEESAKREIALWF

SEQ ID NO: 8778 - protein, 496 aa, Thlaspi arvense
MDLLYIVAALVIFASLLIAKSKRKPKKNLPPGPPRLPIIGNLHQLGEKPHRAMVELSKTYGPLMSLKLGSVTTVVATSVETVRDVLKTYDLECCSRPYMTYPARITYNLKDLVFSPYDKYWRQVRKLTVVELYTAKRVQSFRHIREEEVASFVRFNKQAASSEETVNLSQKILKMSGSVICRIGFGINLEGSKLENTYQEIIVQAFEVLGSLAAVDYFPVIGTIIDRITGLHAKCEKVFHGIDSFFDQAIQRHIDDPSIKDDIIDLLLKMERGEGSLGEYELTREHTKGILMNILTAGIDTSAQTMTWAMTHLLANPRVMKKLQAEIREKIKNIDEITDDDVEQLDYFKLVLKETFRISPIVPVLVPRVAAKDLKIAGYDVPEKTWIHVNMWAVHMSPSIWKDPETFNPERFIDNQTDFKGLNFELLPFGSGRRMCPGMGMGLAVVHLTLINLLYRFDWKLPNGMKAEELSIEENYGLICVKKLPLEAIPVLTQWT

SEQ ID NO: 8779 - protein, 506 aa, Petunia x hybrida
MMLLTELGAATSIFLIAHIIISTLISKTTGRHLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTYERKGKPDFLDVVMENGDNSEGERLSTTNIKALLLNLFTAGTDTSSSAIEWALAEMMKNPAILKKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLVHSFDWKLPSEVIELNMEEAFGLALQKAVPLEAMVTPRLQLDVYVP

SEQ ID NO: 8780 - protein, 508 aa, Petunia x hybrida
MVLLSELAAATLIFLTTHIFISTLLSITNGRRLPPGPRGWPVIGALPLLGAMPHVSLAKMAKKYGAIMYLKVGTCGMVVASTPDAAKAFLKTLDLNFSNRPPNAGATHLAYGAQDMVFAHYGPRWKLLRKLSNLHMLGGKALENWANVRANELGHMLKSMFDMSREGERVVVAEMLTFAMANMIGQVILSKRVFVNKGVEVNEFKDMVVELMTTAGYFNIGDFIPCLAWMDLQGIEKGMKRLHKKFDALLTKMFDEHKATSYERKGKPDFLDCVMENRDNSEGERLSTTNIKALLLNLFTAGTDTSSSAIEWALAEMMKNPAILKKAQGEMDQVIGNNRRLLESDIPNLPYLRAICKETFRKHPSTPLNLPRISNEPCIVDGYYIPKNTRLSVNIWAIGRDPEVWENPLEFYPERFLSGRNSKIDPRGNDFELIPFGAGRRICAGTRMGIVMVEYILGTLVHSFDWKLPSEVIELNMEEAFGLALQKAVPLEAMVTPRLPIDVYAPLA

SEQ ID NO: 8781 - protein, 333 aa, marine gamma proteobacterium HTCC2080
MTKQQWTLKARPQGIPDRSEVDIETRTIDHVPDEHLLIECLYFSMDPAIRGWMSDVPNYLPPIPLGDSVRSSVVGKVLQSEADGFSTGDLVVGTGGWETHGVVPAAYFSVIPPDSPFPAHYYLSALGAVGLTPYFGLLRAGKAAAGQTLLMSAAAGAVGSIGGQIGKILGQRVVGIAGSDEKCRWVTDELGFDSCINYKTCGDMEQAIRGACPEGVDLFFDNVGGEILDAALMNLNKDANIVFCGSISNYNATEPVPGPYNWWQVLARSVTVQGYLISDYLSEFPEGQAQISEWINSGQLKFKEHIVDGFENTLDAYNLLFEGKNDGKLMVKV

SEQ ID NO: 8782 - protein, 571 aa, Legionella pneumophila str. Paris
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAAAKRFSHEYRQPRGLYIAHSDKNQLEEIINNRSNPDIDLVVVTDGEGVLGIGDQGIGGMDIPVAKLMVYSLCGGIDPTRTLPIFLDVGTNNQELLNDPMYLGCRHPRIKSSEYDDFIKTFVNEIHKQFPNAFLHWEDFGRGNARRILDQFQDELCTFNDDIQGTGAVTLAAILAACDVTGLPLHEHRIVVFGAGSAGTGISDQIVDAMVKSGLSLTDAYDRFWLIDKQGLLLATDQELTDAQKPYAWNPIDIQSWEINNKQHPSFTDTIRHVKPTILIGCSAQTGAFSQDIVETMSTACERPIIFPLSNPDEKCEAQPSDILAWSKGRALIATGTAFAPIEYQNRMVQIAQCNNALVFPGIGLGVLAVSASRLTKDMILAAAQTLSKFAPSKKDSFLPLLPSLDNAQIVAKEIAIAVAQCAIDSGYAQKNQDKDLPRLIDELFWEPRYLPFRKRG

SEQ ID NO: 8783 - protein, 159 aa, Yersinia mollaretii
VLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATR

SEQ ID NO: 8784 - protein, 634 aa, Xanthomonas campestris pv. campestris str. ATCC 33913
MSTATNPLDLDVCAREPIHIPGLIQPYGVLLVIDPADGRIVQASTTAADLLGVPMAALLGMPYTQVLTLPEAQPFAVDDQPQHLMHAEVRFPQRATPPDSAWVAAWHLYPQQWLVEMEPRDARLLDVTLREAMPLLRSVERDPGIAEAAVRVAKGLRSLIGFDRVMIYRFDEEWNGDIIAEARKPELEAYLGLHYPASDIPAQARALYLRNRVRQIADVGYQPSPIQPTVHPQLGTPVDLSDVSLRSVSPVHLEYLANMGVTATLVASIVVNDALWGLISCHHYSPHFTNHAMRDVTDAVARTLAGRIGALQAVARARLESVLLTVREKLITDFNDAEHMTVELLDDMAPDLMDVVDADGVAIFHGNDISRHGTTPDVAALRRIRDHIESEHHDALREDAVGALHVDAIGEVFPELADLAPLAAGFIFVPLMPQSRSALLWTRREQIQQIKWAGNPQLAKLEDIPNSRLSPRKSFDLWQQTVRGRARRWSPLHLESARSLRVLIELMERKRFQQDFTLLEASLSRLRDGVAIIERGTANAAHRLLFVNTAFADVCGSDVAELIGRELQTLYASDAPRANVELLQDALRNGRAAYVTLPLQVSDGAPVYRQFHLEPLPSPSGVTAHWLLQLRDPE

SEQ ID NO: 8785 - protein, 337 aa, Oryza sativa (japonica cultivar-group)
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 8786 - protein, 122 aa, Yersinia mollaretii
WKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGG

SEQ ID NO: 8787 - protein, 719 aa, Xanthomonas campestris pv. campestris str. ATCC 33913
MTPLWRALPLLLGLAPFAAWADPAFDRCLAGLQTQAAAKGVDAASFQRFTAGLAADPSVLPLLDAQPEFTTPIWDYLASLVDSQRVSDGQAMLVTHRELLTRLSEQTGVDPATIVAVWGVESDYGRITGKRPLLVSLATLSCAGRRQPFFRGEFLALLGLLQQGDLAPEGLTGSWAGAFGQTQFMPSTYARIAIDGDGDGRRDLVASIPDALASTANYLVKAGWERARPWGMEVRLPAGFDANKAGRTRRQPLQAWQAAGLLGTDGKPLAPTGLPAETAAALLLPAGPTGPAFLVFRNYDAIYAYNAAESYALSIALLADRLRGGAGLVASWPTDDPGLGRPERRQLQQLLLARGHQIGEADGMVGTATRRAIQVEQTRLGLQPADGRAGQRILTALRTAPPVTGAAVRGTAFTLPAAYPAFVQSPIVQKASPMSDVTGLRTGDFHGFPSLLIDTPYSTAAISLFGGQLLSFVPKGGQDVMWLSPTAKQPPTPIRGGAPVCWPYFGRQDQTGDVPAHGFVRTVPWQLTESRREDDGTLVLTLTPPTFDDLALRLHMTLRIGRTLEQRLVTENVSKAPVRFTQALHNYFRVGDALKVSVQGLDGLDYLDKYENYAIAHRQQGDWSLRDPRDPGRSDRIYTNAGGHYTLTDPVLGRRIDIRTEGSRSLVAWNPGEDAASKMADVGTGWRDYVCLEAANAGPDVIELAPGASHTLGQTISVE

SEQ ID NO: 8788 - protein, 199 aa, Yersinia mollaretii
SSIGGWKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 8789 - protein, 160 aa, Yersinia mollaretii
LMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFT

SEQ ID NO: 8790 - protein, 474 aa, Oryza sativa (japonica cultivar-group)
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPERQKVLPTAVKDGEPLPEGLLWLLLTGKVPTKEQVDALSKELASRSSVPGHVYEAIDALPVTAHPMTQFTTGVMALQVESEFQKSPMTKGMSKSKFWEPTYERLLKFDSSPSSSGLSYVYRRIFKGGKTIAADNALDYAANFSHMLGFDDPKMLELMRLYITIHTDHEGGNVSAHTGHLVGSALSDPYLSFAAALNGLAGPLHGLANQEVLLWIKSVIGETGSDVTTDQLKEYVWKTLKGGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 8791 - protein, 163 aa, Ralstonia eutropha JMP134
MLLAIKDFFNSLLLKELFKGMALTGRYLFARKVTVQFPEEKTPISPRFRGLHALRRYPNGEERCIACKLCEAVCPALAITIESDVRADGTRRTTRYDIDLTKCIFCGFCEEACPVDAVVETPILEYHGEKRGDLYFTKDMLLAVGDRYEPQIAAAKAADAKYR

SEQ ID NO: 8792 - protein, 357 aa, Synechococcus sp. WH 8102
MAQHRVVLLPGDGIGPEITAVARQLLEAVSQRHGFELCFDGQLIGGSAIDACGEPLPASTLDACKAADAVLLAAIGSPRFDNLPRDKRPETGLLGLRSGMALFANLRPVKIVPALIGASSLRPEVIEGVDLMVVRELTGGIYFGQPKGRIQADGEERGFNTMTYSSSEVDRIARVAFDLARERRGNLCSVDKANVLDVSQLWRDRVDAMAPAYSDVEVSHMYVDNAAMQLVRSPRQFDVLLTGNLFGDILSDEAAMLTGSIGMLPSASLGSDCPGLFEPVHGSAPDIAGQDKANPMAMVLSAAMMLRIGLKQTEAAADLEAAVDKVLAAGFRTGDLMAEGCTALGCRAMGDALLKAL

SEQ ID NO: 8793 - protein, 411 aa, Pseudomonas sp. JR1
MIKSIVIIGAGLAGATATRYLRAQGYQGKIHLVGEELHVAYDRPSLSKVALSGKVVEPPAILDPCWYASADIDLHLGVRVTGIDVVNHQVLFESGDILAYDRLLLATGARARRMAITGSELAGIHTLRDRADSQALRQALEPGQSLVIVGGGLIGCEVATTAINAGAHVTVLEAGDELLLRVLGRSTGAWCRNELERLGVRVELNAQAAHFEGEGHVHAVVCADGRRIAAGTVLVSIGVEPADELARAAGFACERGVVVDATGASSCPAVFAAGDVAAWPLRSGELRSLETYLNSHMQAETAAAAMLGKSIPALQVPTSWTEIAGHRIQMVGDIEGPGEVVLRGNVENGQPLVQFRVLDGRVEAATAINAPKDFSVATRLVADHIPVSATKLQDASSNLRDFMKAKAERCE

SEQ ID NO: 8794 - protein, 199 aa, Yersinia rohdei
SSIGGWKGINESDMVLMPDASTAVMDPFFEDSTLIIRCDILEPGTMQGYDRDPRSISKRAEDFLRSSGIADTVLFGPEPEFFLFDDVRFGSSIRGSHVSIDDIEGAWNSSTKYDGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 8795 - protein, 177 aa, Oryza sativa (indica cultivar-group)
MSHFGRSGPPDIRDTFSLLVLNISFRTTADDLFPLFDRYGKVVDVFIPRDRRTGDSRGFAFVRYKYAEEAQKAIDRLDGRNVDGRNIMVQFAKYGPNAEPIRKGRIIEEVEKSRDSSPWDLWYLLFQSGTEMTTEIENAGAEVAAEAEKGMAVTGIGIIVVTAEAEAEAEAEAEAEA

SEQ ID NO: 8796 - protein, 287 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLSIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8797 - protein, 194 aa, Glycine max
GRSIAMMACSSSTMQSVYPRVSGANFHVPLSSPSLVPIYNNNLSFSKLRNSIHLAAVPLPPLTKASAGNGGPTDEGVSLGTMKLPLDTDLQRFDSLLFQWANSLCQGANLPLPVPLKVDKIPGGARLGFITIGDGKTEVLVHIDCLVFPPTENSAPIFRAIRNGPLKDKAPPGEPRIMRSLLQALQKSVEIARL

SEQ ID NO: 8798 - protein, 781 aa, Magnaporthe grisea 70-15
MAPKKKIAVMTSGGDAPGMNAAVRAIVRMSIHLGCDAFCVYEGYEGLVQGGNFIRQMQAEDVRGWLSEGGTLIGTARCMAFYERPGRLTAAKNMVLNGIDALIICGGDGSLTGADKFRAEWPSLLEELVSKGELKEEQIAPYKHLNIVGLVGSIDNDLSGTDATIGCYSALSRICEMVDYIEATAASHSRAFVIEVMGRHCGWLALLAGVATGADFIFIPEHPQEGNWKEGMYAVVEKHRKLGKRKTIVIIAEGANDRNGKKITPEEVKDLLADKNGLALDTRITTLGHVQRGGRAVAYDRIIATQMGVEAVRAVIEATPETETCFIAVNENKIVRKPLMQAVKDTKKVATAIEAQDFDQAMSLRDSEFAEQYQSFQIMTTPEPALLLPKEKRMKIAFINVGAPAGGMNAAIRAGVLWCQSRGHEAIAIHNGFAGFARHHGDKPLGAVRPFDRLEVDGWASRGGSEIGTNREVPSQSGMELIAKLIGQYGFDALFVIGGFEAFQAVSELRRAQEEYPSLRIPMALLPATISNNVPGTEYSLGSDTALNALVDYSDMIKQSAAATRRRVFVIETQGGKCGYLATLAGMACGASAVYTPEEGISLDMLAADVAHLKEIFAHDKGQSRAGRLVLVNEKASNVYNAKLIADILREEAHGRFEARDSIPGHVQQGGVPSPMDRSRAVRLAIKCIQHLEQYGPKPHEKVKADPRSAGVIGIRGADVVMTPMKEVEDTETDWPNRRPLNAFWTEMKESVDILGSRGPYPRPEPTLKGLKAKDVKRGLE

SEQ ID NO: 8799 - protein, 287 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGTVVMDSEMFRLDLFPEMDLGSYYMSLAEALLMDPPPTATIIHAYEDNGDGGADVRLWSYSVDM

SEQ ID NO: 8800 - protein, 545 aa, Pseudomonas putida GB-1
MTLSPLAGKPAPASVLVDIPRLLTAYYTGRPDAAVAAQRVAFGTSGHRGTSLELSFNEYHVLAITQAICLYRQEKGIDGPLFIGADTHALSAPATASALEVLAANGVQVMLSKDDEYTPTPAVSHAILCYNRGRQQGLADGIVITPSHNPPQSGGFKYNPPNGGPADSDVTKWVEAKANELLAANLAGVKRMDHGQALQAPTTQRHDYVSNYVADLENVIDFDVIRGAKLRLGVDPLGGAGVRYWSAIAEHYQLDLEVVNTEVDPTFRFMTVDWDGQIRMDPSSPYAMQGLIGLRERFDVAFACDPDHDRHGIVTADGLLQPNNYLAVAIDYLYRHRPQWRSDAAVGKTVVSSGLIDRVTERLGRELYEVPVGFKYFAQGLFDGSLGFGGEESAGASFLRRDGSVWATDKDGLIPALLAAEMTARTGRNPSQAYADLTEALGKPFATRVEAKADARQKALLSKLAPEQVKSTELAGEPIVQILSHAPGNGQAIGGLKVMTANGWFAARPSGTEDIYKIYAESFIDEAHLQRLVQEAQVLVDAAIA

SEQ ID NO: 8801 - protein, 130 aa, Brassica napus
MEFTEAYKQTGPCCFSPNSRYVAVANDYRLVIRDTFSFQVVQLFSCLDKISYIEWALDSEYILCGLYKKPMIQAWSLTQPEWTCKIDEGPAGVSYARWSPDSRHILTTSEFQLRLTVWSLLNTACVHVQW

SEQ ID NO: 8802 - protein, 293 aa, Hordeum vulgare subsp. spontaneum
MSPTLSLKLKKSSHTPQSSVSSSTKLRLFKKEAACQSPSTLPVAMGMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGEFEGPVVMDSEMFRLDLFPEMDLGSYYMSLAEALLMDPPPTATIIHAYEDNGDGGADVRLWSYSVDM

SEQ ID NO: 8803 - protein, 348 aa, Arabidopsis thaliana
MSSSPEKKRRKKLSPESNSLPNDLIVTILARLSQSYYPKLSLVSKTFRAILASPELYQTRILLSRTETFLYVCLSFPGEPNPGWFTLYRKPNQTLTTKKKKNSVHLLAPILNSPPVEFPSLIAVGSYLYAFRAAIEEGTSDSLNCVEVYNTDTQTWIPVPPNKRIFKLQHMKGMLYMKVSKLLSFVAQDAEELAPLFPKLRSLLSTEVVAFKPKVSEGYEVLGFSVNTDLGRGSFCMIEEITYHYDPSVKFRWRRRQGGVWRSLVGLEGLPKFARYSSVKLADCGGKLVVLWHKYVPASGYEEKMVWCAEISLEKRSKKEIWGKIEWFDAVLRVPKYYQFVGAKSATV

SEQ ID NO: 8804 - protein, 337 aa, Shewanella oneidensis MR-1
MAIKIGINGFGRMGRLALRAAWDWDEVEFVQINDPAGDAHTLAHLLEFDSVHGRWRYPVTANADAIQIQDKTIRTTRNKAIADTDWSGCDVVIEASGVMKTKALLQAYLDQGVKRVVVTAPVKEDGVLNVVMGVNHQLYDPAMHPIVTAASCTTNCLAPVVKVIHEQIGIKHGSMTTIHDITNTQTILDAPHKDLRRARACGLSLIPTTTGSATAITHIFPELKGKLNGHAVRVPLANASLTDCVFELERAVTEAEVNALLKTAAEGELKGILGYEERPLVSVDYKTDPRSSIVDALSTMVINGTQLKLYVWYDNEWGYANRTAELARLVGQLDLPR

SEQ ID NO: 8805 - protein, 296 aa, Zea mays
MRAAPTDPPTAPAKSMLRRLFDRQLLRISPAERLPSAGAGEKDEAEPSSVCLDGMVRSFMEDDVGSEKAAHGGRYCNCFHGGDNSDDEEDDEAAAAASDVAETIKGLVHCATLRERNLLADVCAHLERHREAGARRRDLLRLVASSLRGAGHDASVCVSRWDKSPSHPVGEHAYIDVLLPAASDRGARERVLVDVDFRSAFEVARPTKAYRALLQRLPAVFVGKDDRLRLLVAAAADAARASLKKRGLHLPPWRKPEYMRAKWLSPYHREAPVAEEAASASADEDDGDGPGTGTAA

SEQ ID NO: 8806 - protein, 505 aa, Parvularcula bermudensis HTCC2503
MLRRIADLMRLARAGWVLSRHDALVPKEYADQVPMPVRLFGSLSRIGAEGRGLRPGQRLAKALAGQGPAYVKLGQLLATRPDIVGFEVANDLTALQDRMEAVPHAVAIAEVEKALGAPIDTLFSTFSEAVAAASVAQVHKARLPSGEEVAVKLLRPGIEKRAAQDFRAFLMGAKIVQRLVPPARRMEPVKFVRTLQSAAEIELDLRIEAGAASELKENLQETEGVRIPDIVWDRTARRVLTLEWVEGVSVSNQEAIMARGVDPSALARLVMRCFLTQALNFGFFHADMHQGNMFVDEQGRLVLIDFGIMGRLDEEARSVFAEILYGFIRRDYRAAAQAHFDAGYVPSHYSVAAFSTALRSVGEPIFGRNAEAVDMSRVLQQLFDVTEVFDMHLRPELVLLQRTMVVVEGVARIIDPRINLWETAEPVVRDYVAERVGPRSLLKSAKRNGEAARRLFEAFPDFAAAAERAAEQILDSGVELSDDTVDRLAAALKGRKRTKREVNAA

SEQ ID NO: 8807 - protein, 457 aa, Hevea brasiliensis
MVSLLSVPSMIDLIISINKAKKSTSNPELKSTSQRCSEPTCLLVLSSLPIHTWSSCLMGRAFLFFSTYLRSKRKIFFTGTYMPSTELTGGYRILSYLDPSEPKHTQLKNFLFYLLKSRRDHVIPEFSSTYTGLFESLENDLASKGKVSFNNPGEQAAFSFLGRSYFGVNPVDTKIGTDGPTLIAKWVLFQLAPILTLGLPAFLEEPTIHTFRLPAFLVKKDYKRLYDYFYSSAGSLLDEAEKMGISREEACHNILFATCFNTFGGLKIFFPNILKWIGRAGVKLHTQLAQEIRSVIKSNGGEITMAALEQMPLMKSAVYEAFRIEPPVPAQYGKAKRDLIIESHDAAYDVKEGEMIFGYQPFATKDPKIFDTPDEYVPDRFVGEGEKLLQHVLWSNGPETEHPTVGNKQCAGKDFVVFISRLFVVELFRRYDSFEIEVGSSALGSSITITSLKRASF

SEQ ID NO: 8808 - protein, 197 aa, Yersinia rohdei
SSIGGWKGINESDMVLMPDASTAVMDPFFEDSTLIIRCDILEPGTMQGYDRDPRSISKRAEDFLRSSGIADTVLFGPEPEFFLFDDVRFGSSIRGSHVSIDDIEGAWNSSTKYDGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 8809 - protein, 622 aa, Oryza sativa (japonica cultivar-group)
MPPSPPPLLLLLAVLLAAAPAAAQSATPREDDVRCLKEVKAELRDPDGRLSAWSFGNTSAGALCLLSGVSCWNPQESRIIGLSLSGFGLQGGIPSALQFCSAATTLDLSNNALVGVIPPALCDWIPFVVNLDLSGNQLSGQLPSELANCRFLNSLKLSGNSFSGQIPDSLGRLDRLKSLDLSDNRLDGQIPPQLATFGKDSFAGNKGLCGRPVSSRCGRALSGAGLGIVIAAGVFGAAASLLLAFFFWRCTGKSKGGRRRRRGGSESGGGSAEDGSWWAERLRAAHNRLAPVSLFQKPIVKVKLADLMAATQDFSTSHIVVAGSSRAGTAYRAVLRDGSALTVKRLHSCPLSEKAFRAEMGRVGQLRHPNIVPLLGFCVVEDERLLVYKHMESGALSSVMKEPGEAPLDWATRLRIAVGAARGLAWLHHGFQVPQIHQNLSSSAVLLDEDYEARFTDVGLTRLVRMAPGEGGDTSPFLNGDFGEYGYVAPECASNPVATMKGDVYAFGVILLELVSGQEAATVTGDAAGEGFKGTLVDWVNQLKASGRIGDAVHKSLRGNGHDSEIDEFVKIAFACIMVHPRERFSMYRVYHSLKSIGQGRDVSEQFDEFPLAYNKDESDTM

SEQ ID NO: 8810 - protein, 253 aa, marine gamma proteobacterium HTCC2080
MDLELNGKVALITGSTKGIGRGIAERLAAEGCHVGICARNEAEVTAAIGELEAHGVKVAGAAVDVASADSMQAWVDHCVATLGGVDIFVSNVSAGGADASEDGWRANFEVDMLATWRGVQQVTPHLEKSEAGNIVVISSTAALEAFAGAVPYSAVKAALLNYAGNLAQDMAPKGIRVNSVSPGPVFIDGGAWDNIKQAMPEIYEGTVAAIPMGRMGSAAEVADAVAFLASPRSGFTTGTNMVLDGGFTKRLQF

SEQ ID NO: 8811 - protein, 446 aa, Glycine max
  misc_feature (119)..(119): Xaa can be any naturally occurring amino acid
MYGGDEVSAIVIDLGSHTCKAGYAGEDAPKAVFPSVVGAIDQMDVDEADNGEKNPGSAPESNNNNVRNADSDKTKGKRKLYVGSQSLGYRRDHMGVLTPFKDGIGADWDTGDRIWGYAXRECLLIDPKEHPMLLAEPSSNSQQQRERTAELMFEKYKAPALFLAKNAVLTSFASGRATSLVVDGGGGSITVAPVHDGYVLQKAVATSPIGGEFLTDCLMKSLESKGITIKPRYSFRRKEIRPGEFQTVDLEFPNTTESYKLYCQRVIASDIKECVCRAPDTPYDESAYSNIPMTSYELPDGQTIEIGADRFKIPDVLFNPSLVQSIPGTESFAEIAPSVRGLPQMVIESINKCDVDIRRELFSSILLAGGTASMQQLKERLEKDLLEESPQAARVKVLASGNATERRFSVWIGGSILASLGSFQQMWFSKSEYEEHGASYIQRKCP

SEQ ID NO: 8812 - protein, 165 aa, Yersinia rohdei
NESDMVLMPDASTAVMDPFFEDSTLIIRCDILEPGTMQGYDRDPRSISKRAEDFLRSSGIADTVLFGPEPEFFLFDDVRFGSSIRGSHVSIDDIEGAWNSSTKYDGGNKGHRPAVKGGYFPVPPVDSSQDLRSTMCLTMEEMGLVVEAHHHEVATAGQNEVATRF

SEQ ID NO: 8813 - protein, 465 aa, Comamonas testosteroni
MTSQTSKQNTDPTVVNVQTVLNESPFSGFQWGIFFLCFLIVLLDGFDTAAIGFIAPSLLGEWGIDKSHLGPVLSAALFGLAFGALGAGPLADRVGRKTVLIIAAVVMGGASIASGLVHDLQGLTIWRFITGLGLGAAMPNAITLMNEYCPDSKRSFITNCMFCGFPIGSAFGGFIAAWMIPHFGWRSLLIVGGVVPLILAVLMIVMLPESVRFMVLKNYSADRVRKVMVRIAAGTRNAARFVLNDGGEAAAQAQQGPQGLRLVFSQKYLVGTLALWVTYFMGLVIVYGLVNWMPVLFKEAGVPASQAAVIAALFQLGGVGAIFVGLLMDRWNANLIIATGYFLTSLGVAFIGQVLGGGVGMLVASVFIAGLLMNAAQSSMQALAAEYYPTECRASGVSWMLGIGRFGGIAGSFLVAELSRRHLELPLVFMVVAIPGVIAALALLVKNRYAGGAPRTSMLGLGGAH

SEQ ID NO: 8814 - protein, 321 aa, Synechococcus elongatus PCC 7942
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFSSLYPGCVADTPLFRNTPKLFQKIFPWFQKNITGGYVTQELAGERVAQVVADPEFKTSGVHWSWGNRQQKDRQSFVQELSDKASDDRTAQRLWDLSAKLVGL

SEQ ID NO: 8815 - protein, 1047 aa, Anaplasma marginale str. St. Maries
MMISPLQSPDELRKRMQGLYNADEKSYVRYLTERTEVSQESKVRIYSLAKQIIEKVRANKNTTIIDAFMQQYGLSTEEGLALMCLAESLLRIPDDCTIDDMIRDKIARTTWNKHIGRSTSIFVNVSTLALSIGAHMLREVDDSRWYGILGNLLKDMGEPVIRKAALQAMQVLGKHYVCGRTIEEAIARSYDAGHVCSFDVLGEAAKTRADADKYFAAYMGALETLGSNAQAVDDLGSRHGISVKLSSLHPRYEFGQADYVLKDISSKLLELCQVAKKYNVKLTVDAEEARRLELSLMILDTVFSDSSLNGWEGLGFVIQAYQKRALAAIDFVEDIAIRANRKMIIRLVKGAYWDYEIRNAQEMGLDGYPVFTRKVYTDVSYFACVQKLLSKPGTFYPVFGTHNAHSVSFILEMTDKDHPGFEFQRLHGMAQDLYDYVTKEVAPNVCCRVYTPIGQHQELLPYLMRRLIENGANVSFVNMINDSDIPAECLCADPLEKAQSFEYAPHPYIPLPADMFPDGRVNSAGVNTSDSLTMLALSEEVSAFNDTHWKAYPIIGGQDITEGELYEVFFPASLSTKVGEVLFATAEHAAQSIEAARSSFYRWSNTPVGERAAILEHAADLLEKERGKFFSLLVREGGKVISDVIAEIREAVDFLRYYAMLARDQLTDPIKLPGPAGEENYLYFESRGTFVCISPWNFPLAIFLGPIAAALVTGNTVIAKPAEQTSLVAYEAVKLLYEAGVPTDVLHFVPGRGEVLGNALLSSANIAGVAFTGSTETANIINQAIAGRGRDIIPLIAETGGINAMVVDSSALPEQVVEDVITSAFKSAGQRCSSLRVLFLQEEIADKTIEMLLGAVAELRLGNPMALSTDIGPVIDQQSFDMLTSYVEEMRKKKIKLLCKADISYLSGEEEGYFFPPHIFELESMSQLSREVFGPVLHVIRYKKSDLPSILDDINSTGYGLTFAIQSRIQSSIDDITDRIGAGNVYVNRNQVGAVVGVQPFGGRGLSGTGPKAGGPHYLHRFLTEKTVTVNTAALGGSVSLTCLEDE

SEQ ID NO: 8816 - protein, 227 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQHGTDTGEKKGIMDKIKEKLPGQH

SEQ ID NO: 8817 - protein, 222 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGTGGTYGQQGHTGMTGTGATGGTYGQQGHTGMTGTGAHGTTATGGTYGQQGHTGMTGTGMHGAGGTYGQHGTDTGEKKGIMDKIKEKLPGQH

SEQ ID NO: 8818 - protein, 355 aa, Botryotinia fuckeliana
MTARAPNPASGSRKISFNVSEQYDIQDVVGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKKLIYDEIMR

SEQ ID NO: 8819 - protein, 149 aa, Malus x domestica
MADQLTDDQISEFKEAFSLFDKDGDGCITTKELGTVMRSLGQNPTEAELQDMINEVDADGNGTIDFPEPLNLMARKMKDTDSEEELKEAFRVFDKDQNGFISAAELRHVMTNLGEKLTDEEVDEMIREADVDGDGQINYEEFVKVMMAK

SEQ ID NO: 8820 - protein, 149 aa, Brassica napus
MHGYEQDLDEEAGYDDYYSDDNGLDEYEDDEEEELEVPPKEELEYLELRQKIKESIRKKQGKGSVPPQSSQDRRKKLPYNDFGSFFGPSRPVISSRVIQESKSLLENEIKNSNQPKKRPAPTSSSGDRNVSQEKRPKPVSAVRRKVETL

SEQ ID NO: 8821 - protein, 125 aa, Zea mays
  misc_feature (63)..(63): Xaa can be any naturally occurring amino acid
  misc_feature (77)..(77): Xaa can be any naturally occurring amino acid
SALAAHGVHYLYRPCPTLHDLGYMILTQLDIEWGYISETLLTFGFMISDSCTLHPFILITTRXYTVLIWRIQLRYLXPLTLLQLISLYAHHAFAPTHHCNEGSPMALLQQCANAIEDVTLTVAAP

SEQ ID NO: 8822 - protein, 339 aa, Xylella fastidiosa 9a5c
MLVTSMIPNPTRDAPNIPSFVAADVGGTHVRVSVVAAAPTCASPPQLLDVRTYRCADYPSLSTILNDFLGTRSAVRDCVIASAGFQRSDGTVITTNLPWPLSPHRLRADLDLAEVSLVNDFEALAYATEDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 8823 - protein, 485 aa, Pyrococcus abyssi GE5
MGKFAKKLERAIRGYTFDDVLLIPQATEVEPKDVDVSTQITPNVKLNIPILSAAMDTVTEWEMAVAMAREGGLGVIHRNMSIEEQVEQVKRVKKAERFIVEDVITISPEETVDFALFLMEKHDIDGLPVVENEKVVGIISKKDIAAREGKLVKELMTKDVITVPENIEVEEALKIMIENRIDRLPVVDKEGRLIGLITMSDLVARKKYKNAVRDENGELLVAAAVSPFDIRRAIELDRAGADVIVVDTAHAHNLKAIKAMKEMRQKVDADFIVGNIANPKAVDDLTFADAVKVGIGPGSICTTRIVAGVGVPQITAIAMVADRAQEYGLYVIADGGIKYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIKELKEKGEFVIITSAGLRESHPHDIIITNEAPNYPLEK

SEQ ID NO: 8824 - protein, 449 aa, Burkholderia thailandensis E264
MSNHSALERIPIMLSSTTMSQSAGDFAPAGDVTSRTIRAARDALEGRRKGVAAALPFVGPAVIASIGYMDPGNFATNIQAGAAYGYELLWVVLAANVIAMMFQAMSAKLGIVTGRNLAELCREHFPQPVVWGMWVASEIAAMATDLAEFLGGALAFGLLFHLPLIVGMGATAVLTCAILTLEKRGFRPLEAAIAALVGVIGASYLGELLIAPQDWHAAAYHLVAPQLRDGAALTLAVGIIGATIMPHTLYLHSGLTQRRTAPRDERERRLLLRFSNREVAVALGVAGFVNIAMVMMASSAFHETMPGMADIGDAYHTLIPLLGPAAGALFLVALFASGVSSSVVGTLAGQVVMQGFLRRQVPIWVRRLATIAPAFAIVALGCDVTRAMVLSQVALSLVLPLPMAALLLLSSRRAVLGDHALRMPMRVVASAAAAAIVALNGYLIWAAFH

SEQ ID NO: 8825 - protein, 338 aa, marine gamma proteobacterium HTCC2080
MSNRQVVLAAHPQGVPAASDFRLVEAHVPKAGPGQMVVRNLYLSLEAAIRSWLDGTANYFEPIALGGAIRGPSIARVETSQLMDFEPGDLVFGLHHWEDYSLSDGNTVLLRKLTPNPTLPLSWYAGALGGSGQTAYVGLHRIGGIKPGETVLVSAAAGATGSMACQIAALEGCRVVGIVGADDKAEVVLEELGAHAVVNYRKEPDLAAALARTCPEGVDVYFDNVGGVTLDAALMTMAQGGRIVGCGMISDYNSAATPTPLYNLWQVVERQLKMQGFLLYSYLDDLPAASAALEAWLLSGKLKAMENITQGLSEAGAAYSAMMAGTTKGKNLVAVGER

SEQ ID NO: 8826 - protein, 106 aa, Arabidopsis thaliana
  misc_feature (28)..(28): Xaa can be any naturally occurring amino acid
  misc_feature (45)..(45): Xaa can be any naturally occurring amino acid
RTRGIRTTATYTLSSATRAACPTQATLXAPINGLKNSGALPSHTXMANHYFTSITSNEGRDNCMHVRPPIGENKFETLSYLPDHIHFECSNAVDYLIRIMRVSRDQ

SEQ ID NO: 8827 - protein, 516 aa, Oryza sativa
MGGALLSFLLSYPEFILAAACFLAFAAIRRARDARRRAAPVPVSWPVVGMLPFVVAHLGRLLDAAAAALPELGCTFMFRGPWLVGADFLVTCDPAVFRHCLVANFAGYDKGRDFAEMFDVVGDGLLVADAASWAAKRHLAASVFTSAAFRGFVLSTVERQTRRLLVPFLDHAGGVVELEDVFMRYSLDVSYTVAFAADLDSLSVASAAEPFPPFGEATRVTGEAVLLRHIAPAGWWKLMRWLNVGVERRLADAKAVLDEFVYREIANRRSRPAPAVAGGDDLLCMYMASPIDPAMSDQTLRDAAVGFMFAAKDLIAAALTWLFYMICTHPHVEAKILDELRSLHTTTTAGAVVFDADELRAATYLHAAVLETLRLYPSAPFEEKEAVGDDVLPGGTAVRKGTRVVFCLYAMGRVEGIWGSDCREFRPERWLSTGDGDGGAGKVRQEPSYKFAAFNAGPRSCLGKDLGLSNIKIAAAAIVYNFTVELVAGHVVEPKDSVVLHTKNGLMVRVKRRETA

SEQ ID NO: 8828 - protein, 407 aa, Rickettsia typhi str. Wilmington
MKNFNLSEELIIALETMNITEPTEIQKQSIPVAMSGADILASSQTGSGKTLAYLLPLIDAFIKNKTTALILVPTRELATQIHSTLNKVTIAYKINSAVLIGGEPMFKQFMQLKKNPKVIIGTPGRIIEHLNRRSLKIEHIGIIVLDEMDRMLDMGMKEQLEDINKFLPEKRQVLMFSATMPKHIIAVSQKYLNNPVRIMVGATNKAAAEIKQELMHVSNKEKFSELTKQLGNRVGSVIIFVKTKRSADQLAKMLKYENHKAEAIHGDLSQSQRARVILSFRKLNHRIMVATDVAARGLDIPHTQHVINYDLPMCPEDYLHRIGRTGRAGAIGHALSFISPDDVVRWRAIDRLVNKGESTPRSTFRSDKKKRKRSFDKRTSIGDNKKFNSFDNNCRRTFDCNRYRSTI

SEQ ID NO: 8829 - protein, 198 aa, Yersinia ruckeri
GSSIGGWKGINESDMVLMPDASTAVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTMTKKADEIQIYKYVVHNVAHA

SEQ ID NO: 8830 - protein, 138 aa, Parvularcula bermudensis HTCC2503
MNIIEQLEAEHAAELKAEIPAFAPGDTVRVQVRVREGTRERLQAYEGVCIARNGRGLNESFTVRKISFGEGVERVFPVYSPLVEAIEVVRRGKVRRAKLYYLRSRRGKSARITEKVDHRAKAEGKKGKGKAKGKASKA

SEQ ID NO: 8831 - protein, 427 aa, Burkholderia thailandensis E264
MNNADLHARKNAATPRGVGVMCDFYAARAENAELWDVEGRRFIDFAAGIAVLNTGHRHPKIVKAIAEQLEQFTHTAYQIVPYASYVELAEKINARAPIAQPKKTAFFTTGAEAVENAVKIARAYTGRPGVIAFAGGFHGRTMMGMALTGKVAPYKIGFGPFPGDVFHAPYPNALRGVTSADSIAAVETLFKADIDPKRVAAIIFEPVQGEGGFNPAPAEFVRALRKLCDAHGILLIADEVQTGFARTGKLFAMEHYDVSADLMTIAKSLAGGMPLSGVVGRADVMDAAAPGGLGGTYAGNPLAVAAAHAVLDVIDEEKLAERAAVLGDKLKAKLAALRADVPQIADVRGPGAMVAAEFVDPDTRASDAAFTKRVQTLALERGLLLLICGVDANVIRFLFPLTIQDAVFDEALGILESVLKEAVGVPA

SEQ ID NO: 8832 - protein, 538 aa, marine gamma proteobacterium HTCC2080
MLSTMMHTPLGVGTLFEFGARHFASSRVADYDGESLHWWSYKEVELLAGRLANGLAALGVGSGDRVGTFLWNGVNHLGIYLAAPGMGAVLHTLNCRLAADQIAYIINHANDRCIFVDGRLEAQFRPVLDHIPGVRHIIVCNPQGGLDDERIVSLDGLLEHQECHYDWPETPETQAAGICYTSGTTGNPKGVVYSHKTTYLHALASRSVDSFGVQERDTILMLPAMFHANAWGFPYSGWMSGADMIMPGPHTQLEHLKTMILASQPTLTAMVPTILGDLLRDESLTEEHMGSFRALVCGGSAVPSSMIEGARDRWGVPVIQGWGMTETSPMCVLSHPPKDLVDTPETQWRMKSGRPVPGMSVRVVDESDQRLPEDGQTVGELQLRGAWVTGSYLDIESDAFTSDGWLRTGDVGHINPQGYVQLTDRMKDVIKSGGEWISSVDLEDAILQTPGVAEVGVIGIADERWQERPLAVVVLTADQPATAIQIRRFLQDRVAKFWVPEYWSFVSGLPKTSVGKLDKKQLRSEHSDNQLTIEVCRD

SEQ ID NO: 8833 - protein, 1027 aa, Arabidopsis thaliana
MPDSIGLPPDDAIFVTIIRGFGRARLIKRVISVVDLVSKFGIKPSLKVFNSILDVLVKEDIDIAREFFTRKMMASGIHGDVYTYGILMKGLSLTNRIGDGFKLLQIMKTSGVAPNAVVYNTLLHALCKNGKVGRARSLMSEMKEPNDVTFNILISAYCNEQKLIQSMVLLEKCFSLGFVPDVVTVTKVMEVLCNEGRVSEALEVLERVESKGGKVDVVACNTLVKGYCALGKMRVAQRFFIEMERKGYLPNVETYNLLIAGYCDVGMLDSALDTFNDMKTDAIRWNFATFNTLIRGLSIGGRTDDGLKILEMMQDSDTVHGARIDPYNCVIYGFYKENRWEDALEFLLKMEKLFPRAVDRSFKLISLCEKGGMDDLKTAYDQMIGEGGVPSIIVSHCLIHRYSQHGKIEESLELINDMVTRGYLPRSSTFNAVIIGFCKQDKVMNGIKFVEDMAERGCVPDTESYNPLLEELCVKGDIQKAWLLFSRMVEKSIVPDPSMWSSLMFCLSQKTAIHVNSSLQDIIQNRDMSCSSSSGSEEDDEGFDAYRKGGYHAVRIGDQFAGGRYIAQRKLGWGQFSTVWLAYDTRTSNYVALKIQKSALQFAQAALHEIELLQAAADGDPENTKCVIRLIDDFKHAGPNGQHLCMVLEFLGDSLLRLIKYNRYKGMELSKVREICKCILTGLDYLHRELGMIHSDLKPENILLCSTIDPAKDPIRSGLTPILEKPEGNQNGTSTMNLIEKKLKRRAKKAAAKISGRRVSIVGLSETPKKNKRNLDGIDMRCKVVDFGNGCWADNKFAEEIQTRQYRAPEVILQSGYSYSVDMWSFACTAFELATGDMLFAPKEGNGYGEDEDHLALMMELLGKMPRKIAIGGARSKDYFDRHGDLKRIRRLKYWPLDRLLIDKYKLPEAEAREFADFLCPIMDFAPEKRPTAQQCLQHPWLNLRTQNNEDDIEGQMSNMQIKESFHIDNIDEGGEANWPRLDFSVVIVTQHMVKPERWKYYQIKNTEWEFLDVVEAKFVFQQHQPS

SEQ ID NO: 8834 - protein, 198 aa, Yersinia ruckeri
SSIGGWKGINESDMVLMPDASTAVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTMTKKADEIQIYKYVVHNVAHAY

SEQ ID NO: 8835 - protein, 248 aa, marine gamma proteobacterium HTCC2080
MSGDPSNQPVWLITGASRGIGAAIAARAHEQGCRVVVIARGEEAISTAGRLGLGAIAIQADVSDVAAAQSAVDETIATFGRIDVVVNNAGVHRGGKVERLSPEDWQTVLNVNLTGALNMIRAAKPHMGSGSSIINIGAVVGFRGFPGDVAYASSKAGLSGMTNALAIEMAKQGITVNLVIPGLVLTDMTSGLTDAAMDNMKAKIPMGRLGQDREVAEVVYWVTQSRYMTGATVPVDGGLMCSFGVVSP

SEQ ID NO: 8836 - protein, 155 aa, Yersinia ruckeri
AVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTM

SEQ ID NO: 8837 - protein, 332 aa, Erythrobacter sp. NAP1
MELPMIRSEGEQAGEGAQSRDRCEVNWIVDTPGADSSKGEVQWDPVHSAWNGGMLLASLALIPFFTTPAAVVVGLGLTGAMVLLGHSVGFHRLLIHGSFETTPFLRRFLIWCGAVAGMSGPIWIVKTHDLRDWAQRQDDCHDYLAHRRPMLQDAWWQLHCTLNLDNPPRYNVARLEESRFIRWLERTWMLQQLPIAALLYWLGGWPFVVWGVFVRVTLTVHGHWFVGHLAHRRGPQSWEVRGAGVQAHDVPWAGVPTMGEAWHNNHHAYPGSARIGLKPGQSDWGYRFIQVLEKLGLAWNICLPEHMAGRAAKLVEVDPPVKAPVPQSAQPR

SEQ ID NO: 8838 - protein, 86 aa, Triticum aestivum
MAKKRKRSSDAPAPAAVEKPDDSAPERPERTLFGFKDSAAEPASKDAGPFFRNKEKVLITCSRRIIYRYRHLMQNVVSLLPHAKKD

SEQ ID NO: 8839 - protein, 65 aa, Glycine max
  misc_feature (29)..(29): Xaa can be any naturally occurring amino acid
  misc_feature (46)..(46): Xaa can be any naturally occurring amino acid
KQNALMRFKKVVHGKQKVVSGTLDTITLXTKVCGQKKVYEAKVWDXSWLNFKQAQEFKLVAHALG

SEQ ID NO: 8840 - protein, 195 aa, Yersinia ruckeri
SIGGWKGINESDMVLMPDASTAVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTMTKKADEIQIYKYVVHNVAH

SEQ ID NO: 8841 - protein, 1511 aa, Trichophyton rubrum
MDDRYEHEHDDYESGAMYETVRTWSPQSRPELVRIASVFSRIDSHPDVAPTTEDGGQLNRRDTLAGVKIGDPVLDPTKPEFDFYKWARMFTHVMEKEGIKRNRTGVMFRNLTVLGSGSAVQYQDTFLSPFAAPFRPGELCGKGRNPEKVILHDFNGAIREGELLMVLGRPGSGCSTFLKAICGELHGLQKKKESIIHYNGVSQHTFKKELRGEAVYSAEDEHHFPHLTVGQTLEFAAAARTPSKRVLGLSRKDFSTHLARVMMSVFGLSHTYNTKVGDDYVRGVSGGERKRVSIAEIALSGAPICCWDNSTRGLDSATALEFTKALKIGSQVGGITQCLAIYQASQAIYDIFDKVIVLYEGRQIFFGPTRIAKQYFEEMGWYCPPRQTTADFLTSVTNPKERIAKEGYENRVPRTAVEFERYWKQSQNNKLLLANMDRFEAEYPPEEGHLEKLRETHGQAQAKHTASKSPYRISVPMQVKLCTVRAYQRLWGDKSSTIATNISQIMMALIIGSLFFDTPQTTDGFFAKGSVIFFAILLNGLMSITEINGLDAQRPIVVKHVNFAFYHAYSEALAGIVADIPIKFLLALVFNIIIYFLGGLERSAAKFFIFFLFTFITILTMSAIFRTLAAATKTIPQALALAGVMILALVIYTGFTLQPSYMHPWFKWILYINPIAYAYEALLVNEVHGNRYRCATPIPPYGSGKNFACAVAGAVPGEMSVSGDAWVESSYDYSYAHIWRNLGILLGFLAFFYFVYLMVSELNLSSASSAEFLVFRRGHLPKNFQGSKDEEAAAGGVMHPNDPARLPPTNTNGAAGETAPGGSTVAVIPPQKDIFTWRNVTYDITIKGEPRRLLDNISGWVRPGTLTALMGVSGAGKTTLLDALAQRTTMGVITGDMLVNGRPLDSSFQRKTGYVQQQDLHLETTTVREALRFSADLRQPKSVSRKEKYEYVEDVIKMLSMEDFSEAVVGNPGEGLNVEQRKLLTIGVELAAKPQLLLFLDEPTSGLDSQSSWSIVTFLRKLADNGQAVLSTIHQPSGILFEQFDRLLFLAKGGRTVYFGDIGKNSETLLNYFETHGAEPCGPSENPAEYMLNIVGAGPSGKSNIDWPVVWKESEESRHVQQELDRIQSETSKRNEGHGQSAEKEPGEFAMPFTSQLYCVTTRVFQQYWRTPSYIWGKLLLGLASALFIGFSFFLQNSSMAGLQNSLFSIFMLTTIFSSLVQQIMPRFVTQRDLFEVRERPSRAYSWKVFLLANIIVEIPYQILLGIIAWASLFYPTFGAHLSSERQGILLLYCVQFFIFASTFAQMIIAGLPDAETAGGIATTMFGLMVTFNGVLQKPNALPGFWRFMWRVSPITYTVGGLAATSLHSREVKCAQNELAIFDPPSGATCAQYLQKLVEAGAPGKLYNPMSTSQCQYCPLSSGDQFLGGSEIHWSDRWRNFGIGWAYIVFNIFATVALYYLIRVRKSSGRPNRIISVITYHLSQFGTYCRAFITGRKEKCPRKREQIGKIY

SEQ ID NO: 8842 - protein, 196 aa, Yersinia pseudotuberculosis
SIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHA

SEQ ID NO: 8843 - protein, 222 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHAAGTYGYGQQGTGMAGTGGTYGQQGHTGMTGTGGTYGQQGHTGMTGTGATGGTYGQQGHTGMTGAGAHGTTATGGTYGQQGHTGMTGTGMHGAGGTYGQHGTDTGEKKGIMDKIKEKLPGQH

SEQ ID NO: 8844 - protein, 380 aa, Photobacterium profundum SS9
MSKRDFYEVLGVGRDAGERDIKKAYKRLAMKFHPDRNQEADATEKFKEVKTAYEILTDPQKKAAYDQYGHAAFEQGSGGGGYGGGGGADFGDIFGDVFGDIFGGAGGGRRQQQRAQRGSDLRYNMELTLEEAVRGCSKEIRVPTLVGCDSCDGSGAKRGSSATTCGTCHGQGQVQMRQGFFAVQQACPHCHGRGKIIKDPCNSCHGQGRVEKTKTLSVKIPAGVDTGDRIRLSGEGEAGEFGAPAGDLYVQVHVAEHSIFERDGNNLYCEVPVSFTMAAVGGEVEVPTLNGRVNLKVPSETQTGRMFRMRGKGVKSVRGGAVGDLICKLVVETPVNLSSHQKELLKELEESFGGKAAGKHKPKSEGFFNGVKKFFDDLTG

SEQ ID NO: 8845 - protein, 121 aa, Symbiobacterium thermophilum IAM 14863
MSDIIREIEREYMRSDIPAFRPGDTVRVNVKVVEGNRERIQAFEGVVIKRQGSGINETFTVRRVSYGVGVERTFPVHSPRLASIEVIRRGVVRRAKLYYLRERTGKAARIRERRLARPEEA

SEQ ID NO: 8846 - protein, 431 aa, Anaplasma marginale str. St. Maries
MGVRAVVLSARSVAKINRVVARQILDSRGRPTVEVEVLLSDGAVGRVSVPSGASVGKFEAVELRDGDQAKYAGHGVLKPVQRVNTTVADSLAGVSPFDQRAVDEILLSLDGTKNKSKLGANATIGVSLAVAKAAADSVGIPLYKYLGGAVAREMPLPLVNVINGGLHADNLLDFQEFMIVPVGAKTFADAAQICAEVFYKLKEVLKKMGHSTNTGDEGGFAPNLENNTDVLDVLVEAIEKSGYRASSDVALAMDVAASTFYDGTSYKFSGKCLTSGELIACYEDMVSRYPIISIEDAMAESDIEGWKAVTKRLGDKIQLVGDDLFVTNPALIANGVENKLANAVLVKPNQIGTLTETIDAIRSAQRNNYNVIISHRSGETEDVTIAHIAVAANCGQIKSGSFSRSERLAKYNELLRIEEDLGKSALLYNVI

SEQ ID NO: 8847 - protein, 478 aa, Rhodococcus sp. RHA1
MTHPASPPSTVAAHLPPNEPGPHSKRLGMIAVVATFGGLLFGYDTGVVNGALKPMKEDLGLTPFTEGFVVSALVIGAAFGALIGGRLSDRFGRRNNILMLAGVFAFGTLGCVFSPTWEVLGAFRFILGLAVGGASVTVPVYLAEVAPFEKRGSLVTRNEVMIVSGQFAAFVINAIIFNVWGEHSAVWRFMLLIAVLPAFALFIGMLRMPESPRWLSSQGRDDDALAVLHQVRSPRRAEAEMAEVHQLAEEEEKAQTGGWTDLAVPWIRRLVFIGIGLGIVQQVTGINSIMYYGTQLLEDSGFSANGAIVANTLNGLFSVLGITVGIMLINRVNRRTMLLVGYGLITTFHILIGLSALLIPDGSVIKPYLILAFVVCFVFSMQGTLGPLAWLMLAEIFPLKIRSLAMGVCVFVLWMTNAGVAFGFPPVVASLGIAPTFFIFAGLGVLSWIFIVRYVPETRGKTLEEFEEEYSAAYSARR

SEQ ID NO: 8848 - protein, 328 aa, Zea mays
  misc_feature (19)..(19): Xaa can be any naturally occurring amino acid
  misc_feature (57)..(57): Xaa can be any naturally occurring amino acid
  misc_feature (226)..(226): Xaa can be any naturally occurring amino acid
LREDKPHGSAGGLYIFRNXLMEDSPSHIGLLNCDGWSSFPLPDMLEAHKKYGGMGTXLVNKVSAESSNQFGELVGDPETNELLHYTEKPETFVRDLINCGVYIYTPNIFSAIEDVLKQKKDRADLRRVSSFEALHSATKALPPDFVRLDQHILSPRAGKKELYTYQTLDSWEQIKTPGMPLRCSGLYLSQVRRTSPHLLASGDGKRTATIVGDVYIHPSAKVHPTXKIGPNVSISANARVGAGARLINCIILDGVEIMENTVVIHSIVGWESSIGKWSRVQAEGDQNANLGINILGDAVVVEDEVVIVISFVLPNKTLNVRVQEEILL

SEQ ID NO: 8849 - protein, 98 aa, Brassica napus
PTRPVIFADVAQPDQARIVGLNASFFLKAGGHYMISIKAKCIDATMPAETVFSNEVKKLQADELKPAEQITLEPYERDHACVVGGYRMPKKQKTATAS

SEQ ID NO: 8850 - protein, 322 aa, Triticum aestivum
  misc_feature (240)..(240): Xaa can be any naturally occurring amino acid
  misc_feature (249)..(249): Xaa can be any naturally occurring amino acid
  misc_feature (287)..(287): Xaa can be any naturally occurring amino acid
SALPIPRLAVIPALLLPLLPVGGSSEPAKKRQRTSSSSQAEASSSSQPPPQQPGDAREVPGLGDDVICEVLRRVEARTLAAAACVSRGWRTLAQDERLWEAPCVREWAGLGFSEQLLRDVVLSFGGFRRLHAVSIRSRRRFGVGCGNWHGVRTPGQGRRRGAPWTDDEHRLFLLGLKTYGKGDWRNISRNFVRTRTPTQVASHAQKYFIRLSSGAARRSSIHDITTVHLTDDQPPSPSQXLMINQSSAXLSAATGQFSLPADTKQHGAASAPFSLPNRALGMPNYGXGLQDQGLQCGPLHDQLAANRSTEYAVLEDASASDV

SEQ ID NO: 8851 - protein, 241 aa, Zea mays
  misc_feature (171)..(171): Xaa can be any naturally occurring amino acid
  misc_feature (213)..(213): Xaa can be any naturally occurring amino acid
  misc_feature (223)..(223): Xaa can be any naturally occurring amino acid
MASFARQEHQFLAELGLAPRNPGSFACGAWGGSGPVVSTTNPSNNEVIAEVVEASMDDYEKGMSACFDAAKTWMAVPAPKRGEIVRQIGDALRAKLHHLGRLLSLEMGKILPEGIGEVQEIIDMCDYAVGLSRQLNGSIIPSERPNHMMMEVWNPLGVVGVITAFNFPCAXVLGWNACIALVCGNCVVWKGAPTTPLITIAMTKIVASVFEKXNLPSAIFTAXFCGGAEIGQAIALDTGIP

SEQ ID NO: 8852 - protein, 203 aa, Brassica napus
MFSLMHGLWSYMFSKTEFHVLILGIDKAGKTTFLEKLKTIYSISEGLPHDRIVPTVGLNIGRTEVSNAKIVFWDLGGQPGLRSIWEKYYEEAHALIYLIDAACPSRFEESKSALALRHEDLQGAPLLILANKQDLSNAVSAEELDRYLDLKKLDERVYMFEPVSGYDGRGIKESVEWLVGVMERSKRTETLRARTGYVPVPSS

SEQ ID NO: 8853 - protein, 570 aa, Shewanella oneidensis MR-1
MLTDMEISRRAHLKDIAQLGAEFGLLPEEMQLFGNTKAKVDLQVQQRLAGQPKGKLIIVTAVTPTPHGEGKTVTTIGLTQSLKALGNKVCACIRQPSMGPVFGVKGGAAGGGYAQVVPMQELNLHLTGDIHAVSSAHNLGAAAIASRLYHEMRLGKAEFERQSGLSYLDIDPKGIRWHRVVDHNDRCLREIEVGLGENNGPAYTSGFDITAASELMAILALSRNLTDMRVRIGKLVLALNRQGEAVSADELGVAGAMTAIMADAVKPTLMQTLNGAPCLIHAGPFANIAHGNSSVIADDIALKLADFVVTEGGFGSDMGFEKFCNIKARQSGLIPSAAVLVTTLKALKANSGLASDTDINAPDQARLEAGFANLNWHINNVVQYGLPVVVAINRFASDTDAELNWLMEAVRGTAAFGCELSEAFSQGEDGAMALAQTVIRACEQPSEFRLLYPDNMELEAKLSTLAELGYGAAGINLSAVAKQQLQELSALGYAHLPVCMAKTPLSISHDPQLKGVPQGFIVPVRELVLNAGAGFITALVGNVMTMPGLGLTPGYLKIDIDVDGEIIGLG

SEQ ID NO: 8854 - protein, 448 aa, Burkholderia thailandensis E264
MTTVFHRAPRASLPVAVAGDGIEIIDSTGKRYIDACGGAAVSCLGHSNPRVIDAIKRQAQQLPYAHTSFFTTQPAEELADRLVAAAPAGLEHVYFVSGGSEAVEAALKLARQYFVEKGEPARRHFIARRQSYHGNTLGALAIGGNAWRREPFLPLLIEAHHVSPCYAYREQRADETEEAFAQRLADELESRILELGPDTVAAFVAETVVGATAGAVPPVREYFRKIRTVCDKYGVLLILDEIMSGMGRTGYLFACEEDGVAPDILTIAKGLGAGYQPIGATLVSDAIYRTIVGGSGFFQHGHTYIGHAIACAAALEVQRVIDEDRLLENVKARGEQLRASLAARSAEHPHIGDVRGRGLFVGVELVRDRVTKAPFDPKLKLNAIVKREAMQRGLMVYPMGGTVDGQLGDHVLLAPPFICTAPQIDAIAERLGDAIDAALASIGAAASR

SEQ ID NO: 8855 - protein, 483 aa, Rickettsia typhi str. Wilmington
MISNFLNLIRIFRIISKRQILIDSRSPKYFRFIGYILALFFAPSSLIKKSREDYGKRLTACLTDLGPIYIKFGQTLSTRADLVGAEIACYLRLLQDKLPPFDGVVARKLIYKSFTPYCKEQQSANAVILSHKQKVETHSTNTCNAALPFRHFDNNPIAAASISQVHKAQLITGGYVALKILRPDIRKKYNRDIRLLYFFAKIISKFSKAKRLKPITVIDKFHETMKFELDLRLEAAAASELKDNMRNDINVIIPKIYWDLTSENILTTEWLDGISIYDIPLLKGMNLEPKKIAQDFAVMFFNQAYRDGFFHADLHAGNILVNNQGKIILLDFGIMGRLKEKDRLSVAEILFAFLKRDYKLVAKVHLRAGYIPANTDLDLFARSCRAVTEPIVGIPTKNISIGKLLTHLFKITEDFGMEVQPDLLILQKTLIMVEGIGRQLDSNVNMWQLAEPWIKKWAVKNLSPEAKLLRLIKHYFNSINDIT

SEQ ID NO: 8856 - protein, 725 aa, Fusobacterium nucleatum
MNNYWEQLLDKARANHLNLDFDKIKLALGFAEESHQGQYRKSGDDYIIHPVEVAKILMDMKMDTDTIVAGLLHDVVEDTLIPIADIKYNFGDTVATLVDGVTKLKALPNGTKNQAENIRKMILAMAENIRVILIKLADRLHNMRTLKFMKPEKQQSISKETLDIYAPLAHRLGMAKIKSELEDIAFSYLHHDEFLEIKRLVDNTKEERKDYIENFIRTIIRTLSDLGIKAEVKGRFKHFYSIYKKMYQKGKEFDDIYDLMGVRVIVEDKATCYHVLGIVHSQYTPVPGRFKDYIAVPKSNNYQSIHTTIVGPLGKFIEIQIRTKDMDDIAEEGIAAHWNYKENKKSSKDDNIYGWLRHIIEFQNESDSTEDFIEGVTGDIDRGTVFTFSPKGDIIELPVGATALDFAFMVHTQVGCKCVGAKVNGRMVTIDHKLKSGDKVEIITSKNSKGPSIDWLDIVVTHGAKGKIRKFLKDENKETVTKIGKDNLEKEASKLGMTLKEIENDPTLKKHMEKNNIPNLDEFYFYIGEKRSRLDILITKIKTSLEKERAASTLTIEEVLKKKEEKKKEGKNDFGIVIDGINNTLIRFAKCCTPLPGDEIGGFVTKLTGITVHRKDCANFHAMVEKDPSREIMVKWDENLIETKMNKYNFTFTVVLNDRPNILMEIVNLIANHKINITSVNSYEVKKDGDRVVKVKISIEIKGKTEYDYLINNILKLKDVISVER

SEQ ID NO: 8857 - protein, 172 aa, Synechococcus sp. WH 8102
MDLQTYIRSIPDFPKPGILFRDINPLLRNPAAMVEVMRRLGAICDAVQPDLIVGIESRGFIVGTPLALQRSLGFVPVRKPGKLPGAVIGVDYALEYGTDRLEIQSDALTGNPRVLVVDDLLATGGTAAATGSLVRAAGGELVGFAFVIELEPLGGRSALPDEVLAESLIRYP

SEQ ID NO: 8858 - protein, 499 aa, Zea mays
MSRSERRLASAVVRLPGRSRVSASPSPRRRSQSPSPRRDRRRRDRSPIPYRDRSPSPYRARRRDRSPSPYRDRRDRSPSPYRDRRRQWSPYHNDRGRDRDRVLPVRSGGGAWSDDDDDDKELQGLSYFEYRRLKRQKLRKSKKRCIWNITPSPPRVEGDEENYGYSDVEEEKVSPKASPEASEEESKDASESESGESDSLSESSGSEASMRKKKGRNKSRRSSKRSRQRHRHRSYSSEIEDESKSDDDSVGSYDSEESRDRSKKRSRRHNRSKKRSRSSRRKKRRSQDTASEQSSEEEEEEDSKKKNKGLKRKRSKRSDSEESVPSDATPDDVKEIEETKVPEIDPEAIKFKEILEAQKKASLENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 8859 - protein, 247 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQQGHTGMTGTGMHGTGGTYGQHGTDTGEKKGIMDKIKEKLPGQH

SEQ ID NO: 8860 - protein, 227 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHSDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQHGTDTGEKKGIMDKIKEKLPGQH

SEQ ID NO: 8861 - protein, 515 aa, Rhodococcus sp. RHA1
MYLTQSLHRAVQQRPNQLMTVCGDRVHTSAETGDRVARLAGALLGLGLGVGDRVGMLSLNSDRYHEYFFATWWIGGVVNPLNTRWSAAEIAFALEDSQTTVLLVDDTFVPLLDEMRTLFPSLRAVVHCGDRPTPDGLLGYEDLIATTEAVEDLRMGGDTLAGIFYTGGTSGRPKGVMLTHANLMTASLGSLAANRTAVAGGRALVSAPMFHLAALASWNGQNIAGGILVTLPSFEPAAALRLIEEQRINSMLLVPTMIQMLLRHPDREIRDLSSITGIQYGASPISETLLREAQRTFPRADFVQGYGMTEAGPGLTSLSADDHHAATRLNSAGRPMGHVEVRVVDDGGVELPRGEVGEIIARGGNIMAGYWNRPEETATALRDGWLYTGDGGYMDEDGYLLVVDRLKDMIISGGENVYSTEVENALASHPDVVHCAVIGVPDDRFGERVHAFLVMKPGTSLTCEDVRAHTKRLIAGYKAPRSVTIVEQMPVSPAGKILERELRRQFSDLADRPAN

SEQ ID NO: 8862 - protein, 308 aa, Erwinia amylovora
MKKRIWVLGDAVVDLLPGQDNLLLKCPGGAPANVAVGIARLGGNSAFIGCVGDDPFGEFMQTTLQREGVDIGKMFRIDGQRTSTVLVSLDTEGERHFTFMVRPSADLFLRTDCLPSFAQGEGLHLCSIALSAEPSRGAALHAMHAIRQAGGWVSFDPNLRADLWPDADEMARSVAQAFELADIIKLSEDELVFLTGLAILEQGIDQFTARYQPALLLVTRGSQGVSVWQAGRLQHFAAPQVEVTDTTGAGDAFVAGLLAALVQETNPLQPQRLDFAVQQAQHSGAAATTAKGAMTALPYAKDLVRFSQ

SEQ ID NO: 8863 - protein, 267 aa, Shewanella sp. MR-7
MDGLTGKVVIITGASEGIGRALAIAMARVGCQLVLSARNETRLASLALEIANYGPTPFVFAADVSSASQCEALIQATIAHYGRLDILVNNAGMTMWSRFDELNQLSVLEDIMRVNYLGPAYLTHAALPYLKSSQGQVVVVASVAGLTGVPTRSGYAASKHAVIGFFDSLRIELTDDNVAVTVICPDFVVSQIHKRALDGEGKPLGKSPMQEAKIITAEQCANMMLPVIATRGRLLITSLRGRLGRWLKLIAPGLIDKIARKAIASGR

SEQ ID NO: 8864 - protein, 398 aa, Anaplasma marginale str. St. Maries
MLPMSDTRSSRIKPMTLNFGPQHPAAHGVMRLILEMSGEVIERIDPHIGLLHRGTEKLIEYKTYLQALPYFDRLDYVSPMSQEHAYSLCVEKLLQCVVPPRAKYIRVIFCELTRVLNHLLNVSSQALDTGATTPLLWMFEERERLLSFYERASGARFHAAYIRPGGIAADVPDGLLDDIHAFTESFPKLLDDVDGLLTENSIWKQRNVDIGVVSKAQALDWGFSGPMLRACGIPWDLRKSQPYEIYETLDFKVPVGSNGDCYDRYLVRMAEMRESISIIRQCLNGIPEGPVKTDDRKIAPPRREELKYSMEALIHHFKLFSEGYKVPEGEAYVAVEAPKGEFGVYIVSDGTNRPYRCRIRAPGFAHLQAIDAMARGHMLADLTAIIGSLDIVFGEIDR

SEQ ID NO: 8865 - protein, 469 aa, Agrobacterium tumefaciens str. C58
MRRPMGAEHGHDRSRRTWKEKREAEAAELGYAEQPYVVIIGGGQGGIALGARLRQLGVPTIIIEKNERPGDSWRKRYKSLCLHDPVWYDHLPYIPFPENWPVFTPKDKVGDWLEMYTRVMELNYWGSTTCKSAQYDETTGEWTVVVDRAGKEVVLRPKQLVLATGMSGKANVPKFPGQDVFKGEQQHSSQHPGPDAYAGKKVVVIGSNNSAHDICAALWEAGADVTMLQRSSTHIVKSDSLMEIGLGDLYSERAVANGMTTRKADLIFASLPYRIMHEFQVPIYDRIREQDAEFYAALEKAGFMLDFGDDESGLFMKYLRRGSGYYIDVGACDLVIDGSIKLKSGVDVSHLTENAVVLKDGTELPADLVVYATGYGSMNGWAADLISRDVADKVGKCWGLGSDTTKDPGPWEGEQRNMWKPTRQDALWFHGGNLHQSRHYSQYLSLQLKARQAGLKTPVYGLQKPHHLS

SEQ ID NO: 8866 - protein, 156 aa, Brassica napus
IFISCSSKAALVMDWSPEEQYVLENGLAKLKDDPKVSKYVKIAAALPDKTVRDVALRCRWMTRKRRNRADTSAGKNISNIKVVDTSPELNMLANVPQQNAVYVMNNMRHSTHIPFEGPSDEVMDLLQQKAQAFSQISYNLSAYKLQDNISLFYQAR

SEQ ID NO: 8867 - protein, 485 aa, Aspergillus nidulans FGSC A4
MDTSQVSVSSQAAQRQVRVQLTSKQEDIALPDNTGPILVPTGLKRYALSTLVNNLLGNDKPIPFEFLINGSFLRTSIDEYLTANGISAETTLEIEYVRALIPPLHIASFEHDDWVSSIDVLSTSSPASAGSDAIARGQERILSGSYDGFLRVWNMSSQVIATSPSPTDGGHISSIKAAKFISPSSIASAGLDRTVRLWKYTEAEDGFSGKIVPQVELYGHKSGINSLAVHASTNRILSASADHNVGFWSTKKSDAPAAPESLLPSAASRTSKRRKLNASVSVSQRGPLALLSGHTAPVSDAIFDARDSTVGYSVSWDHSLRTWDLVTAALVDTRTTSHSLLSLQHLPDHNLLATGTSARHITLIDPRASAATISAMTLRGHTNAVVSLARDPHSIYGLISGSHDGTCRIWDLRATKTDKGGAVGESVYSISRKSLEEEGKANSKRVGGEGVKVFSVCWDREVGIVSAGEDKRIQINRGEGVLSSS

SEQ ID NO: 8868 - protein, 104 aa, Oryza sativa
TFIHSFWDFVGLSFYTTEEELKNVFSPFGAVEEARLVRDNQTGRPKGFGFVKYSSQADAEKAVKAMDGRVFALLIPYLAYDPQFTFLMLVLILLYLRRVLKICI

SEQ ID NO: 8869 - protein, 1131 aa, Solanum lycopersicum
MASGSRTKHSYHNSSQGQAQSSGTSNMNYKDSISKAIAQYTADARLHAVFEQSGESGKSFDYSQSVKTTTQSVPERQITAYLTKIQRGGHIQPFGCMIAVDEASFRIIAYSENACEMLSLTPQSVPSLDKSEILTVGTDVRTLFTPSSSVLLERAFGAREITLLNPIWIHSKNSGKPFYAILHRVDVGIVIDLEPARTEDPALSIAGAVQSQKLAVRAISHLQSLPGGDIKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQRKYYPLGVTPTEAQIKDIVEWLLAYHGDSTGLSTDSLADAGYPGAASLGDAVCGMAVAYITSKDFLFWFRSHTAKEIKWGGAKHHPEDKDDGQRMHPRSSFKAFLEVVKSRSSPWENAEMDAIHSLQLILRDSFKDAEASNSKAIVHALGEMELQGIDELSSVAREMVRLIETATAPIFGVDVNGRINGWNEKVVELTGLSAEEAKGKSLVHDLLYKESQESAEKLLYNALRGVEGKNVEIKLRTFGAEQVEKAVFLVVNACSSRDYTNSIVGVSFVGQDVTGEKIVMDKFIHIQGDYKAIVHSPNPLIPPIFASDENTSCSEWNTAMEKLSGWSREEIVGKMLVGEIFGSCCRLKGPDAMTKFMIVLHNAIGGQDTDKFPFSFFDRNGKYVQALLTANKRVNMEGDTIGAFCFIQIASPELQQALRVQRQQEKKCYSQMKELAYICQEVKSPLNGIRFTNSLLEATNLTEYQKQYLETSAACERQMSKIIRDVDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGATVVHIELRIICPGEGLPPELVQDMFHSSRWVTQEGLGLSMCRKMLKLMNGEIQYIRESERCYFMIILDLPMTRKGPKSVG

SEQ ID NO: 8870 - protein, 507 aa, Rickettsia typhi str. Wilmington
MKNTYYITTPIYYVNDVSHIGHAYTSVASDVIARFMRCCGKDVMFLTGTDEHGQKVEKAAINKNIDPQSFTDKTSQNFRDLMVAMNISNDDFIRTTENRHKKAVAVFWQKLLDNGAIYEGFYEGWYSVRDEAFYDESEITEDKLAPTGAPVEWVKEPSYFFNLAKWQDKLLEFYELNPDFVRPISRRNEVISFVKSGLKDLSISRTTFNWGIKVPNNEKHVIYVWLDALVNYISALGYPDQQSNYSKFWPANLQVVGKDILRFHAVYWPAFLMAAEISPPKSIMVHGWWTNAGQKISKSLGNTIDPITLIDEFGVDQVRYFLMREVIFGADANFTRNNLITRINSELSNKIGNLLHRIVSFVYNNNDAKVPLIKSGVIDKIYELPILKTAMKFAQENILLMDKIEINKILENIINLAEDANIYIANEAPWNLKKTDYDKMLEVLYTLLEVLRYVAIMLQPFVPSSANKMLDQLGVAKEERLFKHLVRDHALKAGSNILEPSIIFPKI

SEQ ID NO: 8871 - protein, 1034 aa, Parvularcula bermudensis HTCC2503
MEATKMSLPVFNADYAPDDFAFARSLLARNAIPDPQKAKIKKRALRYVEAIRHAPKGAGLEDFMQEYSLSTKEGLALMVLAEALLRIPDEETQDKLIADKLGTGDWEAPDGDESWLLMAASWGIGLSARIVRPGDTPGGVIQGLIRRVGGPAVRVGTRQAMNYLGRNFVLGQTIEDALDRARKQEKKGYRYSYDMLGEAARTYDDAERYRESYAGAIAAIGQRAKANMPPADRPGISVKLSALTPRYFLKNSEELYEKLLPMVLALAEQAKAEDLNFTMDAEEADRLEVSLDIFRALTEAPSLAGWDGLGLAVQAYQKRAPEVIQYVDTLAKESGRRFTVRLVKGAYWDTEIKRAQERGIENFPVFTRKTVTDLCYLDCARLLLDARPRLFPQFATHNAVTMAAIVEMGGNDGYEFQRLHGMGEVLYDAQVHDDGIPVRIYAPVGGYKDLLAYLVRRMLENAANSSFVAQISDERISNDDLLELPQDELRESVDLGEAPIHPLIRLPHKLYPLRPNSAGRELGHRPHLAELSEAIEQFRGPYEPLPALINAEAYRHEGALHPIRNPASTEKPIGEWRVSGTAVVDHAMSVAHDAFPKWNARPVEERGQLLRDFADRMEAQLPYLVSIIAHEAGRTVDDGIAEVREAVDFCRYYAQRAEELMVDQEMPGPVGELNMYHLEGRGVWAAISPWNFPLAIFVGQIAAAVATGNTVVAKPAPQTPYIAWRVIEMWHEVGLPAGVVNLVLGAGETGQAMINHPALAGVVFTGSVPTAKAINRALAEREGPIVPLIAETGGINAMIVDSTALPEQVADDVVGSAFRSAGQRCSALRILYVQEDVADHMLEMIQGAAEALKIGPPKDLSVDMGPVIDTDAVERLDAHWNEISAKGKVRYKGQAPEGGTFFAPRIVELENFRDLQSEAFGPILHVCRWKPSQLDEVIASIHETGFGLTFGIHSRLESRQRQLAAAAPTGNVYINRNMVGAIVGVQPFGGRGLSGTGPKAGGPLYLTRFCEEKHVCENTTAAGGNASLIALSDE

SEQ ID NO: 8872 - protein, 311 aa, Zea mays
MSSLVFKLFLFVSLFQISISARKLAQDEPNQFQSLKYHKGALLSGKISINLFWYGKFKPAQRAIISDFITSLSHSSSDQPSVATWWKTTEKYYKLAAGDKTPSPSLSLTLKSQILDETYSLGKSLTDRDIRKLASKGDQYDAVNVVLTSADVAVTGFGMSRCGTHGHARGNAGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGNLLVDATTGGSFNAYGANGRKFLLPALYDPTTSDCSTMV

SEQ ID NO: 8873 - protein, 95 aa, Theobroma cacao
DAQILEAIGIDYVDESEVLTPADEENHINKHNFRIPFVCGCRNLGEALRRIREGAAMIRTKGEAGTGNIIEAVRHVRSVMGDIRVLRNMDDDEVS

SEQ ID NO: 8874 - protein, 243 aa, Synechococcus sp. WH 8102
MRRPVIAGNWKMHMTCAQARDYMAAFLPQIERAPQDREIVLAPPFTALSTMAAAAEHSVVGLASQNVHWQDHGAFTAEISAEMLLEHGVAYTIVGHSEPRKYFSESDEQINHRARCSQAKGLIPIVCVGESDEQRERGEAERVIRRQIEQGLEGLDANKLVVAYEPIWAIGTGKTCEAAEANRICGLIRSWVGATDLIIQYGGSVKPTNIDELMAMSDIDGVLVGGASLKPDSFARIANYQAI

SEQ ID NO: 8875 - protein, 598 aa, Lolium perenne
MEAPPFSLQQQLAAAVLLAVVSSPFTAALLSPKGVNNEVQALIGIKSLLKDPHGVLRNWDQDSVDPCSFAMVTCSTDNFVTGLEAPSQNLSGILAPAIGNLTSLETVVQLFICDWELFGCSLLQNNVISGPIPAEIGNLASLKTLDLSSNRFYGEIPASVGHLQSLQYLIVGNPLICDANMEKDCYGTAPMPISYNLNGSQGAPPAKTKSHKFAVAFGVVTGCMTFLFLAAGFLFWWRQRRNRQILFDMDDQHLENVSLGNAKRFQFKELQVATDKFSSKNILGKGGFGHVYMGQLPDGTLVAVKRLKDGNAAGGELQFKTEVEMISLAVHRNLLRVLGFCMTATERLLVYPYMSNGSVASRLKGKPPLDWITRKRIALGAARGLLYLHEQCDPKIIHRDVKAANVLLDDCCEAIVGDFGLAKLLDHQDSHVTTDGAGHRWTHRGLSTSPLGSRLRKRTFFGFGILLLELITGQTAVEFGKASNQKGAMLDWVKKMHQEKKLDVLVDKGLRSSYDRIELQEMVQVALLCTQYLPGHRPKMSEVVRMLEGDGLAERWQASQRADSHKFTVPEFTFSRCYSDLTDDSSMLVQAVELSGPR

SEQ ID NO: 8876 - protein, 423 aa, Zea mays
  misc_feature (94)..(94): Xaa can be any naturally occurring amino acid
MAGYEQRVVAVIMVGGPTKGTRFRPLSLNVPKPLFPIAGQPMVHHPISACSRIPNLAQIYLIGFYDEREFALYVSSISNELRIPVRVSGQFKFXYLREDKPHGSAGGLYIFRDYIMEDSPSHIVLLNCDVCSSFPLPDMLEAHKKYGGMGTLLVNKVSAESANQFGELVADPETNELLHYTEKPETFVSDLINCGVYIFTPNIFSAIEDVLKQKKDRANLRRVSSFEALHSATKALPPDFVRLDQDILSPRAGKKELYTYQTLDFWEQIKTPGMSLRCSGLYLSRFRRTSPHLLASGDGKRTATIVGDVYIHPSAKVHPTSKIGPNVSISANARVGAGARLINCIILDGVEIMENAVVIHSIVGWKSSIGKWSRVQGEGDQNAKLGITILGEAVDVEDEVVIVNSIVLPNKTLNVSVQEEIIL

SEQ ID NO: 8877 - protein, 475 aa, Shewanella sp. MR-7
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFTGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 8878 - protein, 325 aa, Oryza sativa (japonica cultivar-group)
MATASWPPTPRSPRPQAPSVERAKGPSGLDKVVLREARGFSAEVHLYGGQVTSWKNDRGDELLFVSSKATFKPPKAIRGGIPICFPQFGTHGILEKHGFARNRFWAIDDNPPPFPTSTAAKAFVDLILKTSEEDLKIWPHSFEFRLRVALGPGGDLALTSRIRNTNTDGRPFSFTFAYHTYFSVSDISEVRIEGLETLDYIDCLRGKERSTEQGDAIVFESEVDKIYLDAPAKIAIIDHEKKRTFVLRKDGLPDAVLWNPWDKRTKNMQDFGDEEYKHMLCVEPAAVEKPITLKPGEEWKGKMDLSAVPSSYCSGQLDPNKVLQG

SEQ ID NO: 8879 - protein, 544 aa, Olea europaea
MQVSTHAVKGNLCLGLQNLRPLPSSRELRENNLGFAVSELRMTKRSSCFGIGLDSIAMGARGNWPKSVYGSLAKARSVRAQAYEGDVEDVAPAKIQVKSSGTVLPYVGVACLGAILFGYHLGVVNGALEYLAKDLGIAENAVLQGWVVSTLLAGATVGSFTGGSLADKFGRTKTFLLDAIPLAVGAFLCATAQNIETMIIGRLLAGIGIGISSAIVPLYISEISPTEIRGTLGSVNQLFICIGILAALVAGLPLAGNPLWWRTMFGVAIIPSILLALGMAFSPESPRWLYQQGKISEAEVSIRKLNGKERVAEVMSDLDAAAQGSSEPEAGWFDLFSSRYWKVVSVGAALFLFQQLAGINAVVYYSTSVFRSAGITSDVAASALVGAANVFGTTIASSLMDKQGRKSLLLTSFAGMAVSMLLLSLTFTWKTLAPYAGTLAVLGTVLYVLSFSLGAGPVPALLLPEIFASRIRAKAVALSLGMHWISNFVIGLYFLSVVTKFGISTVYLGFASVCLLAVMYIAGNVVETKGRSLEEIERALTAAP

SEQ ID NO: 8880 - protein, 141 aa, Triticum aestivum
  misc_feature (114)..(114): Xaa can be any naturally occurring amino acid
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSSPGYYDGRYWXTMWKLPMFGCTDATQVLNEVEESRRST

SEQ ID NO: 8881 - protein, 548 aa, Oryza sativa (japonica cultivar-group)
MADHRSKLVSHLLDSGMADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVLRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICV

SEQ ID NO: 8882 - protein, 120 aa, Triticum monococcum
TNADGDSQICRQVNAYINRPLDGDAISIEAEMSHEDTADDDISSRAGNLVDQSMTADMAGEVTSAAGPVRLSDLQRILSSIQPSDAMADPDAGLRLGDILKPELILPLIETLPIGQLASH

SEQ ID NO: 8883 - protein, 73 aa, Triticum monococcum
MSLEGTRVIPDTRKGLVRIGRGEEGLIHFQWLDRGQNIVEDDQIVFPDEAVFEKVTESSGRVYILKFRHDNRK

SEQ ID NO: 8884 - protein, 649 aa, Haloarcula marismortui ATCC 43049
MSDELSDRVAQYLRWQVSDKVALLAQRYPDDTSLTLDWTDLARWDPTLAEDILDAPDSMLEYVERGIRDTPLPVDTSLGQATPRFENLPESHTTAPGEFSPSDRRGQLLALEGQVAKRTQVQPRLVEAAFECQRCGTLTRIPFEPGQFIEPFECVGCETKGPFRINPDQSRYEDYQKLLLENPSSAALGGDTSDIIAHLQGDLAGHGAIANCQDVVLVGELQFRGGGPIPEPQVVVNSVQAAGQTYQDAEFTADQRDLFERLRERPESFDVDIEDPSTADVLMAAAAPKFVSGSHPRDRQVVRGLVLQLVSASTFDGPDGSHYRGDVHVLLPGDPGTGKSVLAKWAAAVAPRSAFASGERVSGPGLTAAAVKDDFSDGGFSIEPGVLVRAHEGIAVVDELDKAGDDAIEKMHSALADQILPLSLGGQSMTLPAECGLLGVCNPLGGHFAGDESLVDALGINSPLLSRFDLIMQMRSKQDREHVRELAESMIRTWSASLKDATGQALDTADADTIDPVLSMDQYRAVLLRARQLHPTPANDRVIEALAAWFEEQKMALPERYRDALADADGQYHGPPVPVTARKLGAARRVAQAAARANLREEITMADVEVAKELVSRSLADLDIPIVHNAGLGGGDVNRREPADLSGVS

SEQ ID NO: 8885 - protein, 320 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKL

SEQ ID NO: 8886 - protein, 1107 aa, Synechococcus sp. WH 8102
MPRRTDLRRILLLGSGPIVIGQACEFDYSGTQACKALRSEGYEVILVNSNPASIMTDPEMADRTYIEPLTPDVVTRVIERERPDALLPTMGGQTALNLAVTLAENGTLERYGVELIGADLQAIQKAEDRLLFKQAMERIGVQVCPSGIASTLEEAEAVGAAIGSFPRIIRPAFTLGGSGGGIAYNPEEYAAICKSGLEASPVSQILIEQSLLGWKEFELEVMRDQADNVVILCSIENLDPMGVHTGDSITVAPAQTLTDREYQRLRDQSIAIIREIGVATGGSNIQFAINPDNGDVVVIEMNPRVSRSSALASKATGFPIAKIAARLAIGFTLDEILNDITGKTPACFEPTIDYVVTKIPRFAFEKFRGSPAVLTTSMKSVGEAMAIGRSFEESFQKAMRSLETGYSGWGGDRPEPELSEADIDRLLRTPSPERILCVRSAMLRGRSDAEIHRISSIDPWFLAKLRSIVDAEQQLLRGRQLGDLSAPKLLELKQLGFSDRQIAWQTDSDELSVRRHRHDHGIRAVFKTVDTCAAEFASTTPYHYSTYERSIQQLNSDGSLTTLSPASEVSNSSSGRKVMILGGGPNRIGQGIEFDYCCCHASFAAQDAGITSVMVNSNPETVSTDYDTSDSLYFEPLTLEDVLNVIEVEQPDGVVVQFGGQTPLKLAIPLLNWLNSEEGRATGTQIWGTSPESIDRAEDREQFEAILSQLEIRQPRHGLARSETEARDVATRVGYPVVVRPSYVLGGRAMEVVFDEQELNRYMLEAVQVEPDHPVLIDQYLENAVEVDVDALCDHEGNVVIGGLMEHIEPAGIHSGDSACCLPAVSLGEGALGTIREWSRGLALALKVQGLINLQFAVQRNAEGEEVVYIIEANPRASRTVPFVAKATGQPLARIATRLMAGETLQQVGLTTEPQPPLQTIKEAVLPFRRFPGADTVLGPEMRSTGEVMGSADSFGMAYAKAELGAGEALPTTGTVFLSTHNRDKPALVPVAERLAKLGFDLIATSGTADVLTKAGLTVNAVLKVHEGRPNIEDMIRSNQVQLVINTPIGRQAAHDDKYLRRAALDYAVPTVTTLAGARAAVEAIATLQSQPTLSINALQDVHGTRR

SEQ ID NO: 8887 - protein, 292 aa, Yarrowia lipolytica CLIB122
MGLAGVSKKIKYGKDPRNLGWSNNTERFGHKHMSKLGWKDGEGLGHEDRKAQSITQNIKIVLKDDNVGLGAGLAKADKDEAFGLMDFQKLLGKLNGRAQEIEAEVERQQKDVLRGKFGMVFVSGGLLQGTIEEFNKKRGSEAVEESDSDSEESESESDDDKKSRKSSKKEKKDKKSKKRKADDDSDEEEKKSKKSKKDKKEKKEKKEKKEKKEKKEKKEKKEKKDKKEKKDKKEKKDKKSESPTPHDGMEKPSASSTSALRGRMAGRAKFIRSKRMAVMDEKSLNEIFMVKN

SEQ ID NO: 8888 - protein, 827 aa, Aspergillus nidulans FGSC A4
MSDGPTENSSVHPRLLQPHLSVYLGAFFHPSTTSRSCSTVVPVAQRFQARVSFRLFHSIFVSYRPRLLPSVWWSCTFPSVRPDKTSLTPPDLKRFLASFPFPADIVKNPCTSSRSHPVHPVLPPRAQGRSRAERADWNIVDLADAPPFHSPSSAAADLPNASIPSDPILSRPNAGSPVDSIPPSPQRDTLSSDRRSGLAERSSASTRRRRHSPSDTLDSYTYGTGGRAGGHTAASEISSQDQPSQFGPSVEGHPPFSKRRRLANMRPDGISSTNNFSQLSKGGAASPAQKAALSRALNGQASYSGSNGEMKVDGFQKPSKTSSYFNHDREEVTRILIQSLYELGYSNSAALLSKESGYQLESPAVAIFRNAVLEGRWAEAERILVQSFQEQGQEETASKEKLALVENAEKSEMLFYLRQQKFLELLDARDLGAALMVLRHELTPLNYDVGRLHALSSTPVYLCVLRNIFMTKPAGTVPSASRGKDCYLSCQSPSLYSDHMCDRDDFPLGTKLELNKHTDEVWHCQFSHDGTKLVTAGRDSNVIIYDTSTFSVLYILGEHKNGVAHAVWSPDDTKLITCSRDSTARVWSTETGRCLLTINKHQEPVTAAVWAPDGESFVTASLDVNSQLCHWNMRGESLYMWHGGFRVYDCAITPDGRRLIAVDVERKIRVYNFHTHEEEYILPLKSKATSVVVSRDSRHMLVNLTECQIQLIDIETSEVIRRFQGQKQSTFIIRSTFGGAAENFVVSGSEENGTLVETLEGHLEGCVNAISWNPADPGMFASAGDDCLVKIWTRERDAHPNSVPGKRRAVSGNGYARTSALRSTSGF

SEQ ID NO: 8889 - protein, 950 aa, Azoarcus sp. EbN1
MNAPTNPVRFELDGREIDAQPGETILLAARRAGVDIPHLCYTDGMRADGNCRACVVEIDGERVLAPSCCRAPKPGMKVKATSERARASQRLVLELLRADVPAAAEKPDSELAHWCDELGVTDSRFAPRAQPQPDRSHPGIAVDLAACIQCTRCVRACREVQVNDVIGLARRGADTAIVFDFDDAMGTSSCVGCGECVQACPTGALLPAALADFPGTSADAAVPRPGGPFAAKPEAGALPVEPAAPLAKPAMRAIDSLCPYCGVGCQMTYHVAGDGPAAKIVHVEGRDGPANAGRLCVKGRYGFGYPRHAHRLTTPLIRKPGIPKAVDLDPSNPLAAFREATWDEALDFAAAGLARIKAAHGPHALAGFGSAKGSNEEAYLFQKLVRVGFGTHNVDHCTRLCHASSVAALLEGIGSGAVSNPVRDVEFADVIVVIGANPASNHPVAASFMKNAVERGAKLVLMDPRETPLARHAHRFLQFRPDADVTLLLSLACVIIDEGLTDDAFIAARTTGFDAFRTAALAFPPERVEAITGIPAETVREVARLYARSPNSMIFWGMGISQHIHGTDNSRCLIALALMTGQIGRRGTGLHPLRGQNNVQGASDAGLIPMMFPDYQHVADPAVRAKFETLWGTKLSDRPGLTVVEIMDAALAGDIRGMYIEGENPAMSDPDLAHARAALAGLDHLVVQDLFLTETAMLADVILPASSLMEKTGSFTNTDRLVQLSQPVLPLPGDARPDWWIIQSIAQRLGLAWDYAGPAEIFDELRRALPSYAGITWAALETEGAVVAPKFAEDEPSQPVLFEADFPTPSGRARFVAVGPLPAAELPDADYPMVLTTGRVLEHWHTGSMTRRADVLDALEPLPWCSVHPDDLAAQAIESGARVRLETRRGAIVLEARADEAVQRGSVFMPFCYVEAAANLLTQPALDPFGKIPEFKYCAVKLSAESRAQA

SEQ ID NO: 8890 - protein, 515 aa, Penicillium italicum
MDLVPLVTGQILGIAYYTTGLFLVSIVLNVIKQLIFYNRKEPPVVFHWIPFIGSTIAYGMDPYQFFFASRAKYGDIFTFILLGKKTTVYLGVEGNEFILNGKLKDVNAEEVYGKLTTPVFGSDVVYDCPNSKLMEQKKFIKYGLSQEALESYVPLIADETNAYIKSSPNFKGQSGTIDLAAAMAEITIFTAARTLQGEEVRSKLTSEFADLFHDLDLGFSPINFMLPWAPLPHNASAIKHTTYARDLSGNYPSATGSWRRRQRRRQDKSKGTDMISNLMRCVYRDGTPIPDKEIAHMMITLLMAGQHSSSAISCWILLRLASQPEMAEKLHAEQIKNLGADLPPLQYKDMDKLPLLRNVIKETLRLHSSIHTLMRKVKNPMPVPGTDFVVPPSHTLLSSPGVTARDERHFRDPLRWDPHRWESRVEVEDSSDTVDYGYGAVSKGTRSPYLPFGAGRHRCIGEKFAYLNLEVIVATLVREFRFFNPEGMEGVPDTDYSSLFSRPVQPATVRWEVRS

SEQ ID NO: 8891 - protein, 137 aa, Synechococcus elongatus PCC 7942
MTINFAKLVDCEFYSGSMGAQEIIRSIEAEYTKSDLPTIYVGDTVKVGVRIQEGGKERVQPYEGVVIANSGGGINESITVRRIFQGVGVERVFLLHSPAVASVQVLRRGRVRRAKLYYLRDRVGKATRVKQRFDRSI

SEQ ID NO: 8892 - protein, 247 aa, Wolbachia pipientis
GAYKVTKGLLKEFGENRIVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSKGIEAEVIDLRTLRPLDTQTVINSIQKTNRLVSVEEGWPFAGIGAELSAVVM

SEQ ID NO: 8893 - protein, 357 aa, Helicobacter hepaticus
MQKRIAVIYGDGIGKEVITQALKILKAVAKKYEHTFIFEEVLAGGAAIDECGECLPMKSLQICKQSDSVLLGAVGGPKWDNEPSHNRPEKALLTLRKELGLFANIRPATLLPQLSKASPLKDEILNRGIDFIIVRELIGGVYFGEHKLEEINGEKVASDAMTYSASQIESIAKVAFNIARNRKKEIVCVDKANVLSSSRLWREVVDKVAQNYKDVHLSYMYVDNAAMQICRAPSQFDVILTENMFGDILSDEASIITGTIGVIPSASLSNGTLGMYEPIHGSAPDIAGQDKANPIGTILSAAMMLELSFGLTKESEVIQKAVQNALDKGYRTGDMMSEGMQLVGCEQMGDVILESVI

SEQ ID NO: 8894 - protein, 247 aa, Wolbachia pipientis
GAYKVTKGLLKEFGENRIVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSKGIEAEVIDLRTLRPLDTQTVINSIQKTNRLVSVEEGWPFAGIGGELSAVVM

SEQ ID NO: 8895 - protein, 247 aa, Wolbachia pipientis
GAYKVTKGLLKEFGENRIVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSKGIEAEVIDLRTLRPLDTQTVINSIQKTNRLVSVEEGWPFAGIGADLSAVVM

SEQ ID NO: 8896 - protein, 351 aa, Ralstonia solanacearum GMI1000
MSIGLHEVGVGSMDDVTAYPRLVGDVGGTNARFALEMAPMRLAHIGVLAGDDYPSLEAAMRAYLAALPPEIAAAGVRHAAIGIANPVLGDQIRMTNRDWAFSTEAMRQSLGFDTFVVLNDFAALAHALPYLGADELEQVGGSTCVADAPRALLGPGTGLGVASLLPTQAGRFIAVAGEGGHVAFAPMNDEEVVIWRFARERFGHVSAERLISGMGLELIYEALGACFDLWQQGPAVRRAADITAIALGEMEDTAGDHARCRYAVDTFCAMLGTVAANLAVTLGARGGVYIGGGIVPRLGAAFANSPFRRRFEDKGRFSGYVAAMPVYVIHAPYPGLIGLCAAMDHAVASGH

SEQ ID NO: 8897 - protein, 483 aa, Arabidopsis lyrata
LEKLVLERCNLLVKVPRSVGNLRKLLQLDLRRCSNLSEFLVDVSGLKCLEKLFLSGCSNLSVLPENIGSMPCLKELLLDGTAISNLPDSIFRLQKLEKLSLMGCRSIQELPTCIGKLTSLEDLYLDDTALRNLPNSIGDLKNLQKLHLMRCTSLSKIPDSINELISLKKLFITGSAVEELPLKPSSLPSLTDFSAGGCKFLKQVPSSIGGLNSLLQLQLNTTLIEALPKEIGALHFIRKLELMNCEFLKFLPKSIGDMDTLCSLNLEGSNIEELPEEFGKLENLVELRMSNCTMLKRLPESFGDLKSLHHLYMKETLVSELPESFGNLSKLMVLEMLKNPLFRISESNAPGTSEEPRFVEVPNSFSNLTSLEELDARSWRISGKIPDDLEKLSSLMKLNLGNNYFHSLPSSLVGLSNLQELSLRDCRELKRLPPLPCKLEHLNMANCFSLESVSDLSELTILEDLNLTNCGKVVDIPGLEHLM

SEQ ID NO: 8898 - protein, 569 aa, Coprinopsis cinerea okayama7#130
MASSNSRSSTALSLPTVFAKELLAPLFGTLSKIDIAKSALFYYVIAIYSLKAYRHLRARGVTTTGKEVFNYVSQFVVRLILRVPSTKRKVAAQMDKAKLDVENKLVPKGPDVTRHLALPEEGKSIEWILAEMDKMDAELDGKSNVWREGKLSGAVYHGGDDLQRIIVAAYERYCVSNPLHPDVFPAVRKMEAEIVAMVLKLYHAPDGAAGVMTSGGTESIVMAVKTYRDWARKVKGITEPEIIIPASAHAAFDKGAAYLKIKVHTIPVNPYSRKVDIKRVRRAINANTILLVGSCVNFPDGNQDDIAALSDLAVRYNIGLHVDCCLGSFIVPFLEPTGLSGGNGKGKYKLEPFDFKLPGVTSISCDTHKYGFAPKGTSVIMYRSSELRAYQYYINPTWTGGVYASPSLAGSRPGALIAGAWAVMQAVGTKGYLESCRAIVLGARQIADAITSSIPELYVLGDPPASVVAFGSKHPNVNVLEVGDAMSKKGWHLNGLSGPPAVHIAVTRLTVPLVDQFIADLKDAVREAKVSPSGQGTMVALYGLGNSSAVGPDMVGELATAFLDALYKA

SEQ ID NO: 8899 - protein, 541 aa, Oryza sativa (japonica cultivar-group)
MGRMGGGGGGGGFGGPRRWDREPNPFGNDGDAAAGAGDEPEVFDAHQNTGINFDAYEDIPVETSGREVPPPVGTFAEIDLGQALNDNIRRCKYVRPTPVQRYAIPISLAGRDLMACAQTGSGKTAAFCFPIISGIMRGPPAQRPQRGGMRTACPLALILSPTRELSMQIHEEARKFSYQTGVRVVVAYGGAPINQQLRDLERGVDILVATPGRLVDLLERARVSLQSIRYLALDEADRMLDMGFEPQVRRIVEQMDMPPPGARQTMLFSATFPKEIQRMASDFLENYIFLAVGRVGSSTDLIVQRVEFVQEADKRSHLMDLLHAQRDSATPGKPTLTLVFVETKRGADSLEHWLCMNGFPATSIHGDRNQQEREYALRSFKSGHTPILVATDVAARGLDIPHVAHVVNFDLPNDIDDYVHRIGRTGRAGKSGLATAFFNENNSSMARSLAELMQESNQEVPAWLSRYAARPSYGGGGGRNRRSGGGSRFGGRDFRRDSSSGRGGGDYYGGGSSGGAGGYGGSSAYGGGGYGGGAGAPSAWD

SEQ ID NO: 8900 - protein, 424 aa, Rickettsia typhi str. Wilmington
MTTILVIVIIIMISLSALFAATETAITASSPGKIHKLKITGNKRAKTVLGLLKKKEKVIGTLLIGNSLINTICTTIATTLFISLLGNNGTIVASGVMAFIIIVFAEVVPKAIAVAKPEQLALKMASTIVIFLKLFKPINIALDYITKIFCFIFRINLNPQISSTEEVRGVIEHYHQEGGVYKSERNMLGGILDIRNMSVSEIMTHRSNIIALNIDLPHELIIKTLLSGAHTRIPLWKDNRDNIIGILNLKDLLKALYENNNDDKKVDINTLLTPPWFIPDNALVVDQLHAFRERNNHFACVVDEYGTLLGIITLEDVIEEIVGPITDEHDRLNNEIIKKSNTEFIIKGTTTIRDINRELDWNLSDEDANTIAGLIIHKIARIPNQGEVIEIFNLKIIILKKIANKIDSVKITVLPMTEGTINSE

SEQ ID NO: 8901 - protein, 155 aa, Candida albicans SC5314
MLTTILIILIILYFARNIYNEFINNPSSPLDVSTEKESTIVEGKFTPISLTKYNGKDSPKIFIAVKNRVFDVTQGGAFYGPGGPYENFAGRDASRGLAKNSFDPDVLTDINEPIDTLTDLTAVEKESLDGWEEHFENRYKVVGTLHENGTVEEKS

SEQ ID NO: 8902 - protein, 464 aa, Triticum aestivum
  misc_feature (318)..(318): Xaa can be any naturally occurring amino acid
  misc_feature (332)..(332): Xaa can be any naturally occurring amino acid
  misc_feature (339)..(339): Xaa can be any naturally occurring amino acid
MAGKKRKSAEKQPKGSRLPLGADADAVADAGKRRRSGAAKRHQAEEEESVPSSISAKILREALKQQQEEGLADSRDLVAAAATPAAAAVSAPSTSLPFPVPAADGGDDDDEDVDEFDGFDALSEYDGGVPEIDEEDEKALAAFMSKDTSSKQSLGDIILQKIREKDATVSTEARPAVKLDSRIIELYKEVGQLLSRYTSGKIPKAFKRIPSLECWADVLQLTEPQNWSPNAVYQATRLFSSNMNAKNAVRFYEAILLPRLRHDIKTNKRLHFALYQSMKKSLYKPAAFFKGILLPLCQEGNCTLREAVIIGSIIQKVXIPPLHASAALMKLXDLEYCGXTSYFIKLFLDKKYALPYRVLDAVFAHFMRFLDDERSMPVIWHQSLLAFVERYKNELEKKDKEQLLRLLDNQKHYLVTPEIRRELRSSANRGEKPTDMSICSPVSMITKPIEEDRWNVPEVPMEED

SEQ ID NO: 8903 - protein, 460 aa, Coprinopsis cinerea okayama7#130
MNDHEAARGHPEETIHVQGRRGEVVAGIGTGTTGSGMTRDTTGGTGHRTEDMNDEGAPDTTTTEGHHRLAWSLLDQTCIRTGEITDHTVEALATVNGSKAQREAMTVDIWPPSPKEPERSRSPKRKKSKKSKRARSYSTDSSSEDERERRRRKKEKKKSRKDKKRRRRSYSRSRSRSSSPERSRERRRSYRADSEDEERRRRSRSRTRSRSKSVRIRSPSHSPTRHPPRTASPSSSKDMQIEKSRPISRSPSSAPSTSDRSKSKSKSRGSSRAVESDSDDEVGPKPIFSTNTGKKLNERAYGGALLRGEGSAMAAFLQEDTSVRIPRRGEIGLTSEQIAQYENVGYVMSGSRHKRMNAVRMRKENQVISAEEKRSILKLQKEERERREAILREEFNEMVNEKLKAANVDVDLASAPKPSTYYYFCKARNTLGGLEVTNPTSICGPSQIGCVAANHAITHA

SEQ ID NO: 8904 - protein, 191 aa, Rickettsia typhi str. Wilmington
MWHEVDVICDIMNLLSKDLDKADIEHEIYMRLKEPYSVLKKMKRKEVHIYSLKDLIACRIIVKSKDLCYNALDVVKNSPYLDCLYTKDYINRPKSNGYQSLHNIMQLLHSKRTVEIQIRSRDMNQYAEFGSAAHLNYKEEQDRHFKKAFDITNDTMLSKARQMLKQFAGLEEQIVEYEKEIMCIWLNTMKW

SEQ ID NO: 8905 - protein, 783 aa, Parvularcula bermudensis HTCC2503
MTDDTTTKFTDAEALDFHSRGKPGKLEIMPTKPMATQRDLSLAYSPGVAVPVKKIAEDPESAYDLTTKGNMVAVISNGTAILGLGNLGALASKPVMEGKSVLFKRFADIDSVDLEIDTEDPEEFINAVKYLGPSFGGINLEDISAPESFYIEQRLKELMDIPVFHDDQHGTAIISAAGLINALDIVGKRIDEVKVAVSGAGSSALSVVGLIKAMGIKHENVILCDRQGTLYEGRTERMDQWRSAHAVPTDKRTLAEVMDGADVAIGLSAGGAFTKEMVKSMAKNPIIFAMANPTPEITPEEVAEVRGDAIMATGRSDYPNQVNNVLGFPYIFRGALDVRARTINEEMKIACAKALAELAREDVPDEVALAYGKRLQFGPGYIIPTPFDPRLLSKIPPAVAKAACETGVARRPLDDVAAYEGRLATRLDPSASFLQKIHANVKASETPKRIVFAEGEEEVIIRAAYAFQQQGLGQAILIGRDDLVNREFNRLGLSQTHNIEIWNARHSANGPAYTQYLYNRLQRDGYLERDCRRLVNQDRNVFAACMLALGHADGMVTGITRHYSAALNNVQLALDSRPSERVIGMSVLLARGRTVFMADTTIADLPQPEELADIAIQSAHAVRQMGFTPRVAFVSHSNFGNPNTEGVNRIAAAVRLLDESDQMADFEYEGEMTPRMALDHNRLKALYPFARLTGPANLLICPGLHSGGIASKLMAEIGGATVLGPLLIGLSRPVQILQTGAQSGDIVTMAAIAAYELDRDHRVWAEGSSGADQLRKTSRLLPL

SEQ ID NO: 8906 - protein, 499 aa, Shewanella oneidensis MR-1
MAQDLSSLPTALFTQEQVRDAELLAVSEGKTTLYQLVERAGRAAFDCLATQIARQPRLESMPLLVLAGSGNNGADALVCARLALEAGHKVMVFLLKTKGTPEFEQALSAYLNQGGIADSPNIDAILQAPMLIDGLLGTGVHGGVREEVAALIQAINQSDAWVLSLDLPSGIVADTGVVAQAAVMADLTLCFGGLKQGLLTSKARHYCGDLDFADLGLTPFFKTPNATRVGGEILKSYFAARARDSHKGQSGKVTLIGGDFGMAGAIRLASEACLRAGAGLVTVISRPEHQLTVNVSRPELMFWGCELVDMEVYLRLGWAQVVVLGPGLGKHDWGYNLFKAAGLSDKPCVLDADALNLLSNEPRRQTNWVLTPHPGEAARLLGCNVAEIEQDRFAAVRALQQKYGGVVLLKGAGTVIFDGKQMVVAPVGNPGLASGGCGDVLSGIIGALMAQGMDNMQATVVGVVVHGCAADLAAVQGERGMLASDLMPFIRQLVNSDLL

SEQ ID NO: 8907 - protein, 131 aa, Pisum sativum
MGRKEEEEVAVGVPVYERNGIPPNALIGDPKGIPIQQTIYRDTPAPFNCPHCGHTSLTSVRSKISLAAFVGCLMPMMLGVCFLCPSMDCLWHKYHYCPDCHQKVADFEKSDICAVMDPRNWTQESFALARY

SEQ ID NO: 8908 - protein, 318 aa, Pseudomonas putida
MSLNPDLAAYLQLVEAGRSAGKVLPMHALEADEARRQFEESSALIAGKADEPDCISDLSLTTRDGHTLPVRLYRPPQDDPALAGAALLYLHGGGYVVGSLDSHDTLCWNLAQDAGVPVIAVGYRLAPQWRFPTASDDALDAWRWLVEQAEALGIDAQRLAVVGDSVGGSLATILANQLAAQRELAAPRLQVMIYPVTDASCRRPSVQRYGSGYLLEAQTLEWFYQQYATVPADRLDPRFSPLLGSVASNSAPALMLIAECDPLHDQGVAYARHLEQAGVAVQLAVIPGVTHDFMRMGSIIEEADEGLVMVVEALQQHL

SEQ ID NO: 8909 - protein, 359 aa, Arabidopsis thaliana
AISGKDNGVFEHRSFARIGFLGNPSDVYFGRTISFTIGNFWAWAKLEPSDHLLIKPHPFHDLVQFDSLDNLVYRLENDGYYGGVRLLMAICKVFRNYCKENGIQLHDKNFTLSYDTNIPRQTGLSGSSAIVSAALSCLLDFYNVRQSIRIEVRPNLILNAEKELGIVAGLQDRVAQVYGGGLVHMDFSKEHMDKVGYGIYTIMDINLLPPLHLIYAENPSDSGKVHSTVRRRWLDGDEFIISSMAEIAKLAEEGRTALLKKDYSNLKELMNRNFDLRRSMFGDECLGAMNIEMVEVARKIGAAAKFTGSGGAVVVFCPEGPSQVKLLEEECRKSGFIVEPVKLVPTRLSSSDIKTLSKT

SEQ ID NO: 8910 - protein, 428 aa, Arabidopsis thaliana
LTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 8911 - protein, 247 aa, Wolbachia pipientis
GAYKVTKGLLKEFWRNRVVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSEGIEAEVIDLRTLRPLDTQTVINSIQKTNRLVSVEEGWPFAGIGAELSAVVM

SEQ ID NO: 8912 - protein, 247 aa, Wolbachia pipientis
GAYKVTKGLLKEFGENRVVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSEGIEAEVIDLRTLRPLDTQTVINSIQKTNRLVSVEEGWPFAGIGAELSAVVM

SEQ ID NO: 8913 - protein, 467 aa, Agrobacterium tumefaciens str. C58
MTIDIKNIAEMDRNAVLHPFTQLKDFASGKLGEPTIVETGKGIRIQDAHGKQLIDGFAGLYCVNVGYGRTEVAEAISRQAYRLAYYHSYAAHTTDELAILSDRLVRMAPGKMSKVFYGMSGSDANETQAKLVWYYNNLRGKPQKKKIISRERGYHGCSVVAGSMTGMSFYHDHMDLPRVGILHTGVPHHYWGAEAGETELEFSKRRAAELEALILREGPDTIGAFIAEPVLGTGGITPPPEGYWPAIQEVLKKYDVLLIADEVITGFGRTGSMFGSQHYGIEPDLITVAKGLTSAYFPLSGAIVGEKVYTVMEDGADRVGAFSHGYTYSGHPIGAAAANAVLDIVEKEDLPGNAQAVGSYFQEQLKAKFAQLPIVGEVRGVGLMGAIEFVADREKKTRFAPHLTVGARVSKAARNGGLIARAMPHGDILGFAPPLVTTKAEVDEIIAIAEAAVRTVMDDLVQAGEKI

SEQ ID NO: 8914 - protein, 247 aa, Wolbachia pipientis
GAYKVTKGLLKEFGENRVVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSKGIEAEVIDLRTLRPLDTQTVINSIQKTNRLVSVEEGWPFAGIGAELSAVVM

SEQ ID NO: 8915 - protein, 492 aa, Agrobacterium tumefaciens str. C58
MKGIASAALKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 8916 - protein, 111 aa, Picea abies
MGPSDSPYAGGVFLVTIHFPPDYPFKPPKVAFRTKVFHPNINNNGSICLDILKEQWSPALTISKVLLSICSLLTDPNPDDPLVPEIAHMYKTDRGKYESTARSWTQKYAMG

SEQ ID NO: 8917 - protein, 247 aa, Wolbachia pipientis
GAYKVTKGLLKEFGENRVVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKVRDALNAADLLSSEGIEAEVIDLRTLRPLDTQTVINSIQKTNRLVSVEEGWPFAGIGAELSAVVM

SEQ ID NO: 8918 - protein, 419 aa, Sulfolobus solfataricus P2
MEELLTSNLLVQQVKKLYKVGELLGLDSETIDVLSQPERVMQVKIQIRSSDGKLRTFIGWRSQHNSALGPYKGGVRYGPNVTQDEVIALSMIMTWKNSLLLLPYGGGKGGIRVDPKKLTLKELEDLSRKYVQLIHKYLGSDVDIPAPDINTNPQTMAWFLDEYIKITGKVDFAVFTGKPSELGGIGVRLYSTGLGVATIARDAANKFIGGIEGSRVIIQGFGNVGFFTAKFLSEMGAKIIGVSDIGGGVINENGIDVNRALEVVQSTGSVVNYLEGKKVTNEELLISDCDILIPAAVENVINKFNAPKVRAKLIVEGANGPLTADADEIMKQRGVIVIPDILANAGGVVGSYVEWANNRSGGIISDEEAKKLIVDRMINAFNTLYDFHKRKFADQDLRTVAMALAVDRVVGAMKARGLL

SEQ ID NO: 8919 - protein, 124 aa, Arabidopsis thaliana
  misc_feature (23)..(23): Xaa can be any naturally occurring amino acid
  misc_feature (119)..(119): Xaa can be any naturally occurring amino acid
RGFPGRTTPVRATMVVQLTGLKXSVFFPVTGRANTAITSITGNGGGVSCLKGWPPIGKKKLETFFNLPALRDVKWVKEVDSLFRTRGIPGVESKWEHGFGSRGHGTTPGYYDGRSWTLXKLPLF

SEQ ID NO: 8920 - protein, 548 aa, Litchi chinensis
MLRNRTTTPQSPKASDALPLPLYLTNAIFFTLFFSVAYFLLHRWRDKIRSSTPLHVVTLSEIAAIVSLIASFIYLLGFFGIDFVQSFISRASNDAWDLDDEAATVIAARPPPTSMPKLAAPPEPIVSAFSSVEDEEIVKSVVDGSIPSYSLESKLGDCKRAALIRREALQTVTGRSLQGLPLDGFDYESILGQCCEMPVGYVQIPVGIAGPLLLDGFEYWVPMATTEGCLVASTNRGCKAIYASGGAATVLLKDGMTRAPVVRFSTAKRAAELKFFLEDPNNFDTLAVVFNRSSRFARLQSIQCSIAGKNLYTRFCCSTGDAMGMNMVSKGVQNVLDFLKNDFPDMDVIGISGNFCSDKKPAAVNWIEGRGKSVVCEAIIKEEVVKKVLKTNVASLVELNMLKNLTGSAVAGALGGFNAQAANIVSAIYIATGQDPAQNVESSHCITMMEAVNDRRDLHVSVTMPSIEVGTVGGGTQLASQSACLNLLGVKGASKESPGSNARLLASIVAGSVLAGELSLMSAIAAGQLVRSHMKYNRSSRDMTEVAS

SEQ ID NO: 8921 - protein, 36 aa, Triticum aestivum
KADQYKPSDQVTLEPFERDHACVVGGHRKPKKQKCS

SEQ ID NO: 8922 - protein, 247 aa, Wolbachia pipientis
GAYKVTKGLLKEFGENRVVDTPITEHGFAGLAVGAAFAGLKPIVEFMTFNFSMQAIDQIVNSAAKTNYMSGGQLGCPIVFRGPNGTAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSKGIEAEVIDLRTLRPLDTQTVINSIQKTNRLVSVEEGWPFAGIGAELSAVVM

SEQ ID NO: 8923 - protein, 148 aa, Glycine max
MEQTFIMIKPDGVQRGLVGQIICRFEQKGFTLKGLKLITVDRPFAEKHYQDLSAKPFFSGLVDYIISGPVVAMIWEGKNVVLTGRKIIGATNPAASEPGTIRGDFAIDIGRNIIHGSDSVESANKECALWFPDGPVNWQSSLHSWIYE

SEQ ID NO: 8924 - protein, 363 aa, Yersinia pseudotuberculosis
MTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLILLLRFSLGKDDAADAIERAINQALEQGYRTADLAGDGHAIGTHEMGDIIAKFVVEGV

SEQ ID NO: 8925 - protein, 409 aa, Mycobacterium avium 104
MVTNTDALRRRWEAVMMHNYGTPPVALASGEGAVVTDVDGNTYLDLLGGIAVNVLGHRHPAIIEAVTKQLSTLGHTSNLYATEPSLALAEELVALLGAGHEPAGHESGGTESAGTARVFFCNSGTEANEVAFKLSRLTGRTKLVAAQEAFHGRTMGSLALTGQPSKQAPFAPLPGDVTHVPYGDTEALAAAVDDGTAAVFLEPIMGESGVVVPPEGYLAAARDITARHGALLVLDEVQTGMGRTGTFFAHQHDGITPDVVTLAKGLGGGLPIGACLAVGPAADLLTPGLHGSTFGGNPVCAAAALAVLRVLASENLVRHAEVLGKSLHQGIEGLGHPLVDHVRGRGLLCGVVLTAPRAKDAEAAAREAGFLVNAAAPGVIRLAPPLIVTEAQIDGFIAALPGILDRAAA

SEQ ID NO: 8926 - protein, 142 aa, Photobacterium profundum SS9
MTIEKTFSIIKPDAVKRNLIGAIYQRFENAGLKIVASKMVHLDATKAQGFYAEHEEKPFFNELVEFMTSGPVMVQVLEGEDAIHRYRELMGTTNPENAACGTIRSDFALSMRYNSVHGSDSPESAAREIAYFFTEDEICPRD

SEQ ID NO: 8927 - protein, 373 aa, Photobacterium profundum SS9
MTTVKTNLLDLDRKGLRTYFAEELNEKAFRADQIMKWIYQFGCDDFDQMTNINKKLREKLKRVAEIRAPYVSQAQHSVDGTIKWAMRVGDQDVETVYIPDGDRATLCVSSQVGCALACTFCSTAQQGFNRNLRVSEIIGQVWRAAKEIGIEKDTGRRPITNVVMMGMGEPLLNMKNLIPALEIMLDDIGFGLSKRRVTVSTSGVVSGLDQMTGNIDVALAISLHAPTDELRSQIMPINDRFNIATFLESVSRYIEQSNANRGRVTVEYILLDHVNDDMEHARQLAVLLKDTPAKINLIPFNPYPGSPYRKPSNSRIDRFMKTLMEYDFTVTVRKTRGDDIDAACGQLVGDVIDRTKRTQVKQHDGEQIPVKTV

SEQ ID NO: 8928 - protein, 417 aa, Sulfolobus solfataricus P2
MSEKKLLTFWQALFIGLGNIIGAGIFVMAGSTISVAGPGAIIAFIFTAIFAMSIGLNSAELSSIFTDVEGGVYSFTLKTLGEMSGFLVGWFRVISYVIGGAATALGFSGYLLLFGLPKTLYYTLAVILIVILLVLDYFGIGTVAEVDTIFVIINISSLILFSLTIPIIVGIKVHNFVPLFPHGIQGVLTTSNLAFFSYSGFNTIVTLTPSTKNGEKVIPRAIVMSLIITSIIYISVIFSMVDAMPWYYYGQTSAPLSLALSQIHAPTWLFLITSISAILATISVTLSIIVASERTLRQLSRDFQLPVKHELLVVGGIMLASLLLGNVEAIALASNFGIIFSYMLTGLEVIIVRRKGLRGSFRSPAFPVIQVFAIILSALFMISLGLNSLEIGVVTLFIGILVYETLREVKAHENRKK

SEQ ID NO: 8929 - protein, 556 aa, Parvularcula bermudensis HTCC2503
MYQYDKIDRQVVQARVDEFRDQVARRIDGQLTEDQFKPLRLMNGLYLQLHAYMLRVAIPYGTLSSDQLRALGRLAREYDRGYGHVTTRQNMQFNWIRLADMPDILQLLADHDMHGIQTSGNCIRNTTCDPFAGATSDEIEDPRVWCEIIRQWSTFHPEFSFLPRKFKIAVSAASSDRAAVQVHDIGLYLHRNEAGESGFRVLAGGGLGRTPYIGSVIRDFLPKEQLLGYLEAILRVYNLHGRRDNIYKARIKILVNALGEDEFRRQVEEEWTALLAEGPGGSVDLPEAERARIAAFFTGPSLVPDPDGQAHLDAASAEDGVLKRFVRNNLSAHKVEGYGIVTVSLKPVGSPPGDITSAQMSALADLADEYGCGEIRTTHEQNLVLPYIRLRDVPSLHGALVDIGLGTANAGQITDIIACPGLDYCNLANTRSIPLANRIQERFADPERGEIIGGLKIKISGCINACGHHHVGHIGILGVDKKGEEFYQVTLGGTADEQAAIGSIVGKGLSADEVVDAVDRVVETYLSIRSAAEESFIDVYRRVGDTPFKEALYAEA

SEQ ID NO: 8930 - protein, 157 aa, Oryza sativa
  misc_feature (69)..(69): Xaa can be any naturally occurring amino acid
  misc_feature (88)..(88): Xaa can be any naturally occurring amino acid
  misc_feature (141)..(141): Xaa can be any naturally occurring amino acid
SLWWALGVHWLPWAFLRSFVVCGCGGVVCPVYVCLFFLLRSVGPCCSCLYVEPSAGELVEWIYSGYGLXAVECAEYVQEVIDITLFWXLMSIWSEKFWWTYLVIPAYGGYKISGLLRGAFFGGSSEVEEEDEKTRKLREKXMEKKASRGKIIETRTR

SEQ ID NO: 8931 - protein, 131 aa, Pisum sativum
MGRKEEEEVAVGVPVYERNGIPPNALIGDPKGIPIQQTIYRDTPAPFNCPHCGHTSLTSVRSKISLAAFVGCLMPMMLGVCFLCPSMDCLWHKYHYCPDCHQKVADFEKSDICAVMDPPNWTQESFALARY

SEQ ID NO: 8932 - protein, 464 aa, Debaryomyces hansenii CBS767
MQLQGSKTGSEAKYGPPTHVRRKPYNLMLELLESQANRKLVSEYQADGTKVLAQLEASRGVNPAMIELQPEIQWFMRPFLLDFLIELHSSFKLQPQTLFLCLNIIDRYCAKRIVFKRHYQLVGCTALWIAGKYEDKKSRVPTLRELSIMCRNAYDEEMFIQMEMHILATLEWSLSHANLEECLQLAISSCDITTHGTPCKYNNIDDKSNTMNNTSKVSAVTAVGRFLCELSLYDKFFLSLPPSLIAVTANLMACSMLQIPNASASLRAIFKKYTSESEIPGFDFNEYDENSENRQPEVEGPFLSGFDSSSLNTIRKICLMLIVQLGKITDVLSKKYDDLGVIQVVKNFNNRYSFAVSAIYENQNIVQEASMIELTNSKLYNLADIVLQLPNLNLETRNENHVPLTPPSATSQYSVFSNKSLVSVCTPIHSTYLPSSERMDDFSPMQDPGNNGWSSPASSAKIHI

SEQ ID NO: 8933 - protein, 593 aa, Frankia sp. EAN1pec
MCGLSGELRFDGREADVAAVGRMTAAMEARGPDGVGLWATGPVAFGHRRLKIIDLSERGAQPMVDTALGLTAVFNGCIYNYQELRDRLVDAGYRFFSTSDTEVILKAYHHWGPRCVDHFAGMFAFAVYERDTGRLVLVRDRLGIKPLYVTRDPHRLRFASTLPALLAGGGVSSDIDLVAFHHYLSFHSVVPPPHTILTGVRKLPQATIRTVEADGTTRDEVYWRPDSTRQEEHASWTADDWRDAIGERLRTAVRRRMVADVPVGVLLSGGLDSSLIVALLAEAGQRDLATFSVGFEAAGGESGDEFHYSDIIARRFGTDHHQIRVPGDRLLPAIDAAVAAMSEPMVSHDCVAFYLLSQEVARHVKVVQSGQGADEVFAGYSWYPPLATVPRGDAVDAYLRVFADRPHAELPAMVESHHLIEGDASRHFVAERFAEPGAETSVDAALRIDSTVMLVDDPVKRVDNMTMAAGLEARTPFLDHELVELAAACPPELKLASGGKGVLKDLSRPLMPVDVIDRPKGYFPVPAIRHLGGPFLARVADALTDPVARGRGLFRKDWVDEMLADPNSNRTTLGANALWQAALLEMWLQTQGV

SEQ ID NO: 8934 - protein, 1217 aa, Aspergillus nidulans FGSC A4
MSGARNFSIALRRARMPKPRLSGRPLVSQLSVPATRCFSQASARQATKEVKYTSDAYPTLKRSPEFAEITAEDVKYFKDLLGSESAVIDGVTTDATDDIEPFNGDWMRKYRGHTKLVLKPQSKEEVSKVLKYCNEKKLAVVPQGGNTGLVGGSVPVFDEIVINTSRMNKIRSFDEASGVLVVDAGVILEVADQYLAERHHLFPLDLGAKGSCHIGGNVATNAGGLRLLRYGSLHGTVLGVEAVLPDGTIMDGLSTLRKNNTGYDLKQLFIGSEGTIGIITGVSILCPPRPKAVNVAYFGLESYDKVRQAFGEAKKQLSEILSAFELMDGRSQKLVHASTGNKFPLEEEYPFYCLIETSGSNAEHDMEKLETFLESVMGEGIVADGVLAQDETQFQSIWRWREGITEALSHLGGTYKYDVSIPLPELYQLVDDCRERLTKMGFVGDDDSFPVRAVVGYGHMGDSNLHLNIAVRQYNKDVEKAIEPWVYEWIQKRNGSISAEHGLGLAKKEFIGYSQNDTNLKLMKQLKELYDPTRGCVAYSAMPRLPLGPLPCTTGLCCAATDRWSESLSIGCDGLAAPQYSRLKNIELLRNPDFAAEVITFILRLDFGLFSSATASPWAGISFHPKLQFQKNSGSADMSRTMADNMASQYQMMEELGSGSFGTVYKAIDKSTGEIVAIKHIDLESSEDDIQEIQQEISVLATCASPYVTRYHASFLRGHKLWIVMEYLGGGSCLDLLLLGLDYLHSEGKIHRDVKAANVLLSHTGKVKLGDFGVAAQLTNIKSQRNTFVGTPFWMAPEVIQQSGYDYKADIWSLGITAMEMINGEPPHAAIHPMKVLFLIPKEPAPRLQGDGYSSALKDFIAQCLTKDPERRPSAKELLRHKFIRNAGKTEALQELIHRKQDWDSGRGVSRNVKYYAESLNTITHFTDDAGWVFDTVKAPTMVIREDSDVSDSGSIIHDPLYDESAEMVENLRISSPPTQKYANGTAVRRIPAPDRSPSLRRPKRRSSGVKQPLGVDLTFGNSPSTVRQFRRVSDKSPSEDPFSSYQLTGDENASPKSIYSETNSKEAQLGRRAYSKAVGHACQEVLGTTGDQEKREAISRLAEAWSDLEMVDPEGLYHILRATNEKLLSDPKLSSLVPQGPPPESPQRPRLVLAQNNPHLKSHRRRQSAAVAEPNPQPQLANLPGQSVPGMEHVKQLSDVLYQRWSEGLRNRWPGI

SEQ ID NO: 8935 - protein, 247 aa, Wolbachia pipientis
GAYKVTKGLLKEFGENRVVDTPITEHGFAGLAVGAAFAGLKPIVEFMTFNFSMQAIDQIVNSATKTNYMSGGQLGCPIVFRGPNGAAARVAAQHSQCFASWYSHVPGLKVIAPYFASDCRGLLKAAIRDPNPVIFLENEIAYGHEHEIPDSELSNKDYLLEIGKAAVIREGKDVTITAFSLKLMDALNSADLLSSEGIEAEVIDLRTLRPLDTETVINSIKKTNRLVSIEEGWPFAGIGAELSAMVM

SEQ ID NO: 8936 - protein, 247 aa, Wolbachia pipientis
GAYKVTKGLLKEFGENRVVDTPITEHGFAGLAVGAAFAGLKPIVEFMTFNFSMQAIDQIVNSATKTNYMSGGQLGCPIVFRGPNGAAARVAAQHSQCFASWYSHVPGLKVIAPYFASDCRGLLKAAIRDPNPVIFLENEIAYGHEHEIPDSELSNKDYLLEIGKAAVIREGKDVTITAFSLKLMDALNAADLLSSEGIEAEVIDLRTLRPLDTETVINSIKKTNRLVSIEEGWPFAGIGAELSAMVM

SEQ ID NO: 8937 - protein, 382 aa, uncultured proteobacterium
MSKRDYYETLGISKGATAEEIKKAYRRKAKELHPDRNADNPASEGLFKEANEAYEVLKDSNKKAAYDRYGHAAFEGGMGGGGGGRPGGQGDFSSAFSDVFDDLFGDFMGGRGGGGRQRAARGADLRYNMHVTLEEAFRGLQKTINVPTAVSCANCSGTGAASGSAPATCGTCSGMGKVRAQQGFFTVERTCPSCSGAGQVIKNPCSSCHGAGRVEKDRALSVNIPAGVETGTRIRLSGEGEAGARGGPQGDLYIFIEVADHQIFEREGNNLFCNVPVSMTSAALGGDIEVPNIDGGRSRVKIPSGSQSGRQMRLRSKGMPSVRGGGVGDMFIELQVETPVNLTARQKEILKEFEALSSDNSPESQGFFKKVKRFWDGVKGQE

SEQ ID NO: 8938 - protein, 555 aa, Mycobacterium avium 104
MTAARPVKTRNEGQWALGDREPLNDTEKIKLADGPLNVRERIINVYAKQGFGSIDKSDLRGRFRWMGLYTQREQGYDGSWTGDDNTDKIEAKYFMMRVRSDGKAMSAHTMRTLGQISTEFARDTADISDRENLQLHWIRIEDVPEIWRRLESVGLQTTEACGDCPRGIHGSPLAGDSLDEVLDPSPAIEEIVRRSLNNPEYANLPRKYKTAVSGLQDVSHETHDVAFVGVDHPEHGPGLDLWVGGGLSTNPMLAQRLGVWVPLDEVPDVWEAVTQLFRDYGYRRLRAKARLKFLVKDWGIEKFREILEQEYLNRRLIDGPAPAPVKHTIDHVGVQKIKNGLNAVGVAPIAGRVSGTTLSAVADLMEQVGSDRARWTPFQKLVILDVPDDKVDELVAGLDALGLPSRPSSWRKNTMACTGIEFCKLSFAETRVRTQTLVPELERRLADVDAQLDAPISLHLNGCPNSCARIQVADIGFKGQWIDNGDGTSVEGFQVHLGGGLGEQSGFGRKLRQHKVTSEELGDYIDRVTRRYLEGRNDGETFASWALRADEEELR

SEQ ID NO: 8939 - protein, 96 aa, Triticum aestivum
YHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 8940 - protein, 770 aa, Oryza sativa (japonica cultivar-group)
MDVNEEAMAAHKRAFLDFLDQDVGKGVYMQAVRDMVQNKRHRLIIGMDDLRNHSLDLARRVIRSPAEYMQPASDAVTEVARNLDPKFLKEGQRVLVGFSGPFGFHRVTPRDLMSSFIGTMVCVEGIVTKCSLVRPKVVKSVHYCPATGGTLSREYRDITSFVGLPTGSVYPTRDENGNLLVTEYGMCEYKDHQTLSMQEVPENSAPGQLPRTVDIIVEDDLVDSCKPGDRVSIVGVYKALPGKSKGSVSGVFRTVLIANNVSLMNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGARSLDKTGYAEEDDGDVNAAIFVKYDRMLHGQDRRRGKKSKQDRLTVKFLKKYIHYAKNLIQPRLTDEASDHIATSYAELRDGGANAKSGGGTLPITARTLETIIRLSTAHAKMKLRHEVLKTDVEAALQVLNFAIYHKELTEMEEREQREMEMKQQADHDAGASGGNADEHRSSGNDPMDVDVGNASNDQDVPAERIEAFEAILGQHVLANHLDQISIDEIEQTVNREAAAPYNRRQVEFILERMQDANRIMIRDGIVRII

SEQ ID NO: 8941 - protein, 803 aa, Escherichia coli B
MTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQFDENGYAKRDETLTHPRCVWNLLKAHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATRPDQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQAEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 8942 - protein, 453 aa, Arabidopsis thaliana
MIKGRLNLALVLGMDCEKITKKKKMVRSDENSLGLIGSMSLQRGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 8943 - protein, 412 aa, Zea mays
MNRGEFQTSLVQQMIWSGGGGGNTTAAGSSNIMSSGFKQSCHEDQQEASRNLQLLPSLSSPSSLLFSNAQQFPHTTSSGQQLAHTNAGGAAAGSLPSLDDDGGSGQDSHMPESWSQMLLGEFAGERYAATACLLSKGVEDWGDHAAAAASACMVGGGGGVEEEGSAAMPLYSLYGGGSHSHSHLAAAGDHEMPPAPAAAAAGANKSQLSQMLLASSPRSCVTTSLGSNMLDFSNNGVPPAPDQLKSHHHHQSDNSSEVRKERLGDRITALHQIVSPFGKTDTASVLQETIGYIRFLLGQIEALSYPYMGHGNGTSIQNGPTTGERNHAGLLPDQYPGQLLNHNNNTGARQPAAVGQPDEQQQQQGGANNNDETKKDLRSRGLCLVPVSCTSHFGGDNAADYWAPAPLGGILR

SEQ ID NO: 8944 - protein, 1453 aa, Coprinopsis cinerea okayama7#130
MKIFHSNGSWRHVAISLDCTVAQLNKELFAKAKWDSDRKDRLYLSEGGRERLLGPTERPAKIVKRRLTLAGYLPIDGLDTLGLEDLPFLFRFSYKSQLLGPPEEDLNFESFDFIDLTGRSLRTIPVLLHQNADSIVSLKLSRNPMLEIPLDFIQSCSLLRDLRLSNMAMKKVPQSVQYSSTLHRLDLSSNRIADLTDAYLDHIPNLLELNVMNNKLEKLPWHFGRLRCLVTLNISNNRFTEFPKEVFQMKNLRTLDVSFNTIKVIPEELGQLAELEHFLLVGNQISKFPDQARELHNLSMLDCRRNSVSDLTIVLMLPKIQQVYADHNAISSLDLSIGPNMKGLDVSHNDITQLSLIPGPVGRSPYSLTSLDLSYTKLSSLDDLALGTLTSLKTLKLDHNTIRSIPDTLGELSWLETLTVSDNRLDSLPDSIGRLQKLETLDAHNNSLSELPQSLWNCASLTRINVTSNFLGSWHDPPVSSDVGIDDASSLYLARKGSTASTTSTSGLPPLVHSLERLYLGENRLTEESIHPLMIFKELRVLNLSFNELQELPPIFFRNMTQLEELYLSGNKLTSIPTEDLHRMTRLSTLFLNGNRLQTLPQELGKLKDLSILDVGSNMLKYNINNWEFDWNWNFNKKLKYLNLSGNNRLQIKSESSRNSASHNRTSRLDFASLGRQTLAGFKELASLRVLGLMDVTIATTGTDASVDIPDETDIRRVRTSPSTVNGMAYGIADSLGRNDVLNMLDLVREFPASPGEPKPNKAIFAMFGRCQPPKGLLPGTSPNKLSKFLHDHFTEVFIRQMNELPEKKGGVSDALRRTFLELNQKLWEHIHQLKRKNSQATPMPAPNGTLVNSGFDPGLLNIGATSVVLYVVDKRIYVANVGDAVAVLSRAGVAHRLSHRHHPYDREETAHIRSAEGWVSPNGLINDQVEVSRSFGHFNLVPVVRAAPDIFSQPLGDRDEFIIIANRGLWEFVPHQTAVDIARTVAHIDPMIAAQKLRDFAISYGADGSTMIMVIMVSDLFKDPRSRQPTLDNIVLPAKVPKRKKEERIPGNRHLPPEVDAPTGHIAIAFTDIRNSTHLWEVNPGMPTAMHLHNHLLRYHLRRCGGYEVKTEGDSFMVSFPTALAAVWWCVTVQKELLNVSWPLEILECEDGKEIRDEAGNIIARGLSVRMGIHCGVPVCETDWITNRMDYFGSMVNRSARVNSHAQGGQIMVSADVLREINARIYDKVEEQTEYSRNQPQDAIDGIREIGISLIPVGEVKLKGFEFTEMLTAVYPKGLEHRHGMKDANVSGAASRIQFSVPQTKELGILCLRLEALSGGYLFKTPPPARKGSIASQTASLLPGAGPHPGSSSNTTEEATSNEAEAEPQGPPVIVADPETLLPPINDQISDADLMRIIDWFAMRIENAVNMLAHRYCPPNMDRVNFINALIEGEQLDARTLEYISGILKRIS

SEQ ID NO: 8945 - protein, 394 aa, Synechococcus sp. PCC 7002
MTRIETRTEPMVINMGPHHPSMHGVLRLIVTLDGEDVVDCEPVIGYLHRGMEKIAENRTNVMYVPYVSRWDYAAGMFNEAITVNAPEKLADIEVPKRAQYIRVIMLELNRIANHLLWLGPFLADVGAQTPFFYIFREREMIYDLWEAATGMRLINNNYFRIGGVAVDLPYGWNDKCLDFCDYFDPKVDEYEKLITNNPIFRRRVEGVGTITRDEAINWSLSGPMLRASGVKWDLRKVDHYECYDDFDWDVQWETAGDCFARYLVRIREMRESVKIIRQALKGMPGGAYENLEAKRMLEGKKSEWNDFDYQYIAKKVAPTFKIPDGEHYVRLESGKGEVGIFIQGNNNVFPWRWKIRSADFNNLQILPHLLKGVKVADIMAILGSIDVIMGSVDR

SEQ ID NO: 8946 - protein, 333 aa, Bradyrhizobium japonicum USDA 110
MADVKYDVLGIGNALFDVLVRTDEAFLAKHGMTKGSMSLIDEARAAAIYQDMGPATEVSGGSAANTIVGIGSLGARAAYVGKVKDDQIGKLYVHDIRAAGVAFNTPAAKDGPATGCSYILVTGDGERTMNTYLGAAQDLSPADIDPAEIASAGIVYLEGYLWDPKNAKEAFVKAAKIAHDARRKVALTLSDSFCVDRYRDEFLSLMRNGTVDIVFANESELHSLYMTSDFDTALKQLRNDVNLGVVTRSEKGCMVVSAEDAVAAPAAPIAKLVDTTGAGDLFAAGFLYGLARNLPYKQCGELGALAAAEVIQHIGARPQVSLKELAEQRGLTA

SEQ ID NO: 8947 - protein, 306 aa, Vibrio cholerae O1 biovar eltor str. N16961
MNKLVVLGSVNADHVLQVPSFPRPGETLHGRNYQVIPGGKGANQAVAAARMQADVGFIACVGDDSFGINIRESFKLDGINTAGVKLQPNCPTGIAMIQVSDSGENSICISAEANAKLTAAAIEPDLAAIRDARYLLMQLETPLDGILKAAQEAKTAKTNVILNPAPARELPDELLKCVDLITPNETEAEVLTGITVYDDSSAQQAADALHCKGIEIVIITLGSKGVWLSQNGRGQRIPGFVVKATDTTAAGDTFNGALVTGLLQEMPLESAIKFAHAAAAISVTRFGAQTSIPTRAEVEAFLAEHS

SEQ ID NO: 8948 - protein, 520 aa, Triticum aestivum
  misc_feature (161)..(161): Xaa can be any naturally occurring amino acid
  misc_feature (196)..(196): Xaa can be any naturally occurring amino acid
MAGSMAPLGVKKERAAEYKGHMTFAVAMACIVAAIGGSIFGYDIGISGVNTMDPFLERFFPAVFRRKNLVTLNNYCKYDNQALSAFTSILYLSGQVSTLAAAPVTRNYGRRASIICGGISFLIGAALNAAAADLTTLILGRVMLGVGIGFGNQAVPLYLSXEMAPAHLRGGLNMMFQLATTLGIFSANMINYGTQXIKRGGWRLSLGLVAAPALLMTVGGFLLPETPNSLIERGHVEEGRRVLELIRGTTDVDAEFTDMAEASELANTIKHPFRNILERRNRPQLVMAVCMPAFQILTGINSILFYAPVLFQSMGFGASWSLYSSMLTGAGLLFSTLISIATGDRLGRRKLLISGGIQMIVCQQVIVAVILGVKFGTDKQLSRSYSIVVVVVICLFVMAFGWSWGPLGWTVPSEIFPLETRSAGQSITVAVNLFFTFVIAQAFLSMLCAFKFGIFLFFAAWITVMTVFVYVFLPETKGVPIEEMVLLWRKHWFWKKVMPDMPLEDGWGEGGGERADNKGH

SEQ ID NO: 8949 - protein, 136 aa, Candida glabrata
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKNDIKLARRLRGERS

SEQ ID NO: 8950 - protein, 256 aa, Heterocapsa triquetra
IVGILRLVRVLPSLTSTMLNCCTAPAPVTAEDFEVREVYEARTTKSPAVPPEEALRLLQEGNARYTKANNTVVRKGLAEQRKQLVEYGQKPMAVVFGCADSRAPIDTIFDALPGDLFILRNAGNTCTRAEGSMVGSIEYAISHLDSKLILVLGHTKCGAIAGATKTMLAQKEKKDCSCLAKGSSALDILLDGLVPVAKQAADENPGAAEAEIATKAVHVNVFHTICRLFSYSKALRDMVSSGEVQVHGGIYDLESG

SEQ ID NO: 8951 - protein, 497 aa, Bradyrhizobium japonicum USDA 110
MTPTAAARAQHATATLRDRLKDPSLLKEACYIDGAWVGTPVFAVNNPATGVELAKVPQLGADDTTKAVEAAERAFPAWAKHTAKQRSNILRKWFELIIANREDLALILTSEQGKPLSEALGEVDIGAAYIEFFAEEARRVYGETIPTQRPDARLLAIKQPIGVCGAITPWNFPNSMITRKVSPALAAGCTVVLKPANETPLSALALAVLAEKAGIPKGVLNIITGDAPPIGKVLCEHPAVRFVGFTGSTAVGKILYQQASVGVKRLGLELGGNAPFVVFDDADIDAAVEGAIVSKYRNMGQTCVCANRLYAQDKIYDEFVQKLSKKVAVMKIGDGTEAGVTQGPLINLKAVDKVERHIADAVKRGAKVVTGGKRSELGRSFFEPTVLADVKPDSLVAQEETFGPLAPVIRFKDEADVIAMCNASPFGLASYFYSRDLGRVWRVAEALESGMVGVNTGLITTEVAPFGGVKESGLGREGSRHGMEEYVEIKYVMMAGV

SEQ ID NO: 8952 - protein, 407 aa, Arabidopsis thaliana
  misc_feature (352)..(352): Xaa can be any naturally occurring amino acid
MKAFYVFVVALLLTLNYRGEASGSVFFIDGSNNQYLRPRSSSEALPMSPVEISAAVSALLGFAPSATLTADGSSKLNKILKPNPFERPRAAFVLEIAGADDMLLETSPSHSFLGNAIRSSIKSDSYKADTELPDNEVVVVSVNEPSSDVTDKDINDFASWLGGSYVAGAEPSSGLLSIPLAGGANVEFNLEKEAERKFALNLLGLYQNIRQAVSVYDDLSHGIDRTAELTVGRFGGIDALAQEYGQGMAKQGMDVLLSTLSKLFNLLETSHKGQIVGVIVLDERVNQESENLLNFGSSRSSARSMVEVEGIPSAAIIAEVILVRLTLAWLTGIILLIATILGVYFLMNMPLXKDTLLYSNVKLELRNETELQNGKRTLIFSTGRSFTYFCVYQAVFLKLAAFETGVI

SEQ ID NO: 8953 - protein, 469 aa, Vibrio cholerae O1 biovar eltor str. N16961
MSSDSRGLYHRKNNEVTMFELFKPAAHTQRLPSDKVDSVYSRLRWQLFIGIFVGYAGYYLGRKNFSLAMPYLIEQGFSRGDLGVALGAVSIAYGLSKFLMGNVSDRSNPRYFLSAGLLLSALVMFCFGFMPWATGSITAMFILLFLNGWFQGMGWPACGRTMVHWWSRKERGEIVSVWNVAHNVGGGLIGPIFLLGLWMFNDDWRTAFYVPAFFAVLVAVFTWLVMRDTPQSCGLPPIEEYKNDYPDDYDKSHENEMTAKEIFFKYVFNNKLLWSIAIANAFVYLIRYGVLDWAPVYLKEAKHFTVDKSSWAYFLYEWAGIPGTLLCGWISDKVFKGRRAPAGILFMVLVTLAVLVYWFNPAGNPAVDMAALVAIGFLIYGPVMLIGLYALELAPKKAAGTAAGLTGLFGYLGGAVAANAILGYTVDHFGWDGGFMVLVASCVLSVLCLIYAFVGERAHHNDKLKQATI

SEQ ID NO: 8954 - protein, 97 aa, Glycine max
MAALGGNRDVAGSQNSLEIDGLARFAVEEHNKKQNALLEFEKVVSAKQQVVSGTLYTITLEAKDGGQKKVYEAKVWEKAWLNFKEVQEFKLVGDAPA

SEQ ID NO: 8955 - protein, 286 aa, Burkholderia cepacia
MDASEFSKFLKAALPAQAIAGAALTVAEVEIPGYAQDIVLRLYRRPDKTGLPVVLYFHGGGFVRGSLEDADFAARFLAERLPALVVSVDYSLAPAFPFPAAPEDAYRAAVWAATRARAFGGNPKKIGVAGHDAGGQLANCLAFIARDRGEVSIAAQALFGPMLDPSMTRIGDAERLASDITARECAACYRAYLPQAAQRMHPYAAPIESVRLAGLPPTLVVTAQNDVLHVEAENYAGCLISSGVLTQVIRYPDITHAALATHEAAFEEAVRFFQCRFQARQPNRPE

SEQ ID NO: 8956 - protein, 545 aa, Desulfotalea psychrophila LSv54
MKLFTTEQMRKIDHQAINDYGIPGAVLMENAGRETVGLMQQALGTCANSFIPIFIGPGNNGGDGFVVGRHLYQLGGRPIFFLLSDPEKYTPDSKLNFHIAEKTGLPTYPLKSDSDFRQLTTICQQELGAGRRCYALVDALFGIGLDREIGDHYARIINLINAQQRDRALPQAPVISCDMPSGIHTETGAIMGVAIGADHTASYSFAKPGQMQGAGASLVGDLHILDIGAPRQIAAKIANTFATTGREDACKTLKTIRRGPLSHKGSHGHLLIVAGSLGMTGAAILASEASLAMGTGLTSLVTTKSLNPIFEMRLAEVITIPLSGEDNFFTVSHFERICQAAMGKKITIIGPGMGNNRTSFDLVKKLYQNLKLPMLIDADGLNALATERGLLTKAAGPRIFTPHPGEMARLLDISTEEVEADRAAAVEKFMHIFSEVKVDIVLLLKGAATLIRGKRGPLFINCTGNSGMATGGMGDVLAGMIAGLIAQGLDPMDATKLGAYLHGMAGDKLRETRGIGFTASELAKTIPLCRKELEETKNPSKTTRQ

SEQ ID NO: 8957 - protein, 527 aa, Photobacterium profundum SS9
MTTSTNIHDQRILILDFGSQYTQLIARRIREIGVYCELWSWDVDEADIRDFNPNGIILSGGPESVTGDESPRAPQYVFEAGVPVFGVCYGMQTMAEQLGGKVAGSSMREFGYAQVEIVEPTSFFKNIEDAVAEDGNGLLDVWMSHGDKVVEIPSDFVKVAQTDTCPFAAIANEEKHFYGVQFHPEVTHTRQGMRIIENFVLNICGCENLWTSANIIEDAIANIKEQVGDDEVILGLSGGVDSSVVAMLLHRAIGDKLTCVFVDNGLLRLNEGEQVMDMFGDHFGLNIVHVKAEDRFLNALAGENDPEAKRKIIGHAFIDVFDEESKKLKNAKWLAQGTIYPDVIESAASKNGKAHVIKSHHNVGGLPDDMEMGLVEPLRELFKDEVRKIGLELGLPYNMLYRHPFPGPGLGVRVLGEVKKEYCDLLRRADAIFIEELHSADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 8958 - protein, 376 aa, Photobacterium profundum SS9
MSDQFIKSKAAIAWGPKQPLSIEEIDVMLPRAGEVLVRIVATGVCHTDAFTLSGDDPEGIFPVVLGHEGGGIVEQIGEGVTSVQVGDHVIPLYTAECGECKFCKSGKTNLCQAVRETQGKGLMPDGTTRFYKDGQPLFHYMGCSTFSEYTVLPEISLAKVSKEAPLEEICLLGCGVTTGMGAVLNTAKVEKGDTVAIFGLGGIGLSAIIGAKMAGASRIIGVDINESKYKLATKLGATDCINPTKFDKPIQDVIVEMTDGGVDYSFECIGNVNVMRSALECCHKGWGESVIIGVAGAGQEISTRPFQLVTGRVWRGSAFGGVKGRSELPEIVERYMAGEFALDDFITHTMGLEGINDAFDLMHEGKSIRSVIHFDK

SEQ ID NO: 8959 - protein, 553 aa, Aspergillus oryzae
MPAFSQATDLSAWKELQEHHTAVGRNIVLKEAFEKDPQRFEKFSRTFKNTVDNSDILFDFSKNFLTEETLSLLVKLAKEANVEELRDAMFKGEHINFTEDRAVYHAALRNVSNEPMQVDGKSVVEDVNSVLEHMKEFSEQVRSGEWKGYTDKKIDTIINIGIGGSDLGPVMVTEALKPYGAPGMKLHFVSNIDGTHIAEALKDSNPETTLFLIASKTFTTAETTTNANSAKKWFLETAKDESHIAKHFVALSTNEAEVTKFGIDKKNMFGFESWVGGRYSVWSAIGLSVALYIGYDNFHQFLAGAQAMDKHFREAPLEQNIPAIGGLLSVWYSDFFGAQTHLVAPFDQYLHRFPAYLQQLSMESNGKAITRSGEYVKYTTGPILFGEPATNAQHSFFQLLHQGTKLIPSDFIMAAESHNPVEGGKHQRMLASNFLAQSEALMVGKTPEQVKTEGAPDNLVPHKTFLGNRPTTSILAQKITPSTLGALIAYYEHLTFTEGAVWNINSFDQWGVELGKVLAKKIQQELETSGAGAGHDASTSGLLAAFKQKANLA

SEQ ID NO: 8960 - protein, 295 aa, Arabidopsis thaliana
MSDALNMTLDEIVKKSKSERSAAARSGGKGVSRKSGRGRGGPNGVVGGGRGGGPVRRGPLAVNTRPSSSFSINKLARRKRSLPWQNQNDLYEETLRAVGVSGVEVGTTVYITNLDQGVTNEDIRELYAEIGELKRYAIHYDKNGRPSGSAEVVYMRRSDAIQAMRKYNNVLLDGRPMKLEILGGNTESAPVAARVNVTGLNGRMKRSVFIGQGVRGGRVGRGRGSGPSGRHLPLQHSHQGGVTAGRGGFRGIGRGNGGGIGNKSGGRGGKKPVEKSAADLDKDLESYHAEAMNIS

SEQ ID NO: 8961 - protein, 288 aa, Arabidopsis thaliana
MSGALNMTLDEIVKRGKTARSGGRGISRGRGRGRGGGGRGAGPARRGPLAVNARPSSFTINKPVRRVRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGIGRVRGGRGERGPAPTVSLRLPIHNQQGGGMRGGRGGFRARGRGNGDRGRGGGRGNGNKPVEKSAADLAKDLESYHADAMNTS

SEQ ID NO: 8962 - protein, 299 aa, Pavlova lutheri
RNSARGPPARATYDAEYESDIAEEAAEEKTSRANARRRRSQTPPNLDPIIETITTEGALASAPQKPPLRSTGSIVEEALREQEQRNELVKKQTPVQILEELKAGNARFAAGEQSYPTPSLVARREFSRGQVPKVMVIGCADSRVPIEILFDQGIGDVFVSRNAGNLFDDKVGGTLDYAVNHLGIRLVVVMGHEACGAVRAAGLSTSALMREPPHLRAMLLGMQRELALCKESLDAIAEPSTRERATVIANAVGQARKILEDPLVHAKHTDGKLLVVAAYYEITTGLVQFIELPKDTLVA

SEQ ID NO: 8963 - protein, 1703 aa, Arabidopsis thaliana
MFREAGLRNIGEDVDSRWTIGNRKLDAKSVPNANSGHGFGFRSAPPLSSSIKPVRGNNNGGSSSDMDIASDSDEEIFERQHSPQDYRIHLGLPHVAAQNGLGRNGAKVFGAADDLSDSATSTEEAEACGVRNNISSHNEFERRNVEAGTSGRTLNGTSTSTSSLPRFPTFHASEQGPWSAMIAYEACVRLCLHSWSTDSVSEASYFLNNECTIMRNAFSLQRFFLHSEEELLGKGPSELVTETSVPKSKKTIGKIKLQVRRIKMGLDPPPGCNIATLTVSKEKLEVVRHHIVELNSTLSSGWKAARKVHVTPQVPLNGSLSRQSLAYMQAAARYLKQVSKAVKKEIVTSHTGPQTYEAVQETYSCSLRLKSSPEDDQIKTQPGSGETLPDSLGDDLIIEVRDSKAQLLGRVVAQLAAMADDPGPWHWMITRFASYYGVSDAYTRLRYLSYVMDVASPTKDCLDLIHDFLFPIIMTSNHRAVLSHQENRLLGEIDEQIQQILASAFENYKSLAELSFSGMKDVFESATGTPAPAIESAVKLYGLLNDVLTPEAQLKLCRYFQAASKKRSRRHLLDTNDLLNNRSEGVPVDPMVLAASYQKMKSLILSLKNEISTDIAIHDCNVLPRLREFLLVWPPPGPSPAVVDLVITTADFQRDLSSWHINPIKGGVNAKELFYSYITTWIEEKRRVLYELCKLETSKACVEIPGLTSPFVDEMYERLNGTLDEYDIIIRRWPEYAISLEKVVADSEKAIVEAMEKQFTEILSPLKESKIFGLKIVKKFTKGTPNPYSVPKELGVLLNSMKRVLDILRPSIENRFKSWNSYIPDGENRVLGERLSEVTVLLRSKFRSYMQALVEKLAENTRIQSHMKLKTIIHDLRETTAEPDVRNRMTSLKDLLDKTIDHLHGVFLPDVFVAICRGIWDRMGQDVLRLLEDRKDNVTWHKGPRIAVSVLDEIFATQMQSLLGNGLKPEHLEPPRSMMELRCPNPLPAVASLIATIFSAVLPSTFTLTLTITVFVLLCITNVNHLSTIRLFQIDSGFSQEVIRLIALATEESYLAEEVRPATVDYGGDSVSDVYRCAVCLYPTTTRCSQCKSVRYCSSKCQILHWRRGHKEECRSPDYDEEKEEYVQSDYDAKESNVDFPSRGTAYESSSNVSVDVACDMSTSRPSIHKVQPRSEAVDFTTSLNIKDNLYETRPLSRKKSRNRTDKVESASNYSKGKTDAKLRKLGNQNSRRSGDSANMSISDQFLSVGFEEEMNALKHERITSEPSSASAAMSSSSTLLLPSKANSKPKVSQASSSGLKTSVQKVVQHFRPPQSSKKSQPSSSIDEMSFSYELFVKLYCDRVELQPFGLVNLGNRGGESPLSPIKILSKLQKIGKHLGPGKEEDAHEFLRCAVDTMQSVFLKEAPAAGPFAEETTLVGLTFGGYLHSKIKCMACLHKSERPELMMDLTVEIDGDIGSLEEALAQFTAYEVLDGENRYFCGRCKSYQKAKKKLMILEGPNILTVVLKRFQSDNFGKLSKPIHFPELLDISPYMSDPNHGDHPVYSLYAVVVHLDAMSTLFSGHYVCYIKTLDGDWFKIDDSNVFPVQLETVLLEGAYMLLYARDSPRPVSKNGGRKSKQRRNLAAIPSRKGNKKQRDGDNNSLLPRVDWSSGSLSSMFSSSDTTSSCSTKDSSGIENLSDYLFGGVEPVWKWDRHNKSQTFD

SEQ ID NO: 8964 - protein, 460 aa, Synechococcus sp. PCC 7002
MVNTQLPNLTPQTDKHKVVIIGGGFGGLYAAKTLGKYEAAVDVTLIDKRNFHLFQPLLYQVATGTLSPADIASPLRGVLSGNKNTHVLLDEVVDIDPDSKTVVMNEGIVNYDSLIVATGVSHHYFGNDHWKPYAPGLKTVEDALEIRHRIFMAFEAAEKETDPALQQAWLTFVIVGGGPTGVELAGAIAEIAYSVLKKDFRKIDTTRARIILLEGMDRVLPPYDPSLSAKAQKSLENLGVQVQTKSLVTNIEDHLVTFKQGDDQCEIAAKTIVWAAGVKASGMSKVLEDRLSATLDRAGRVIVEPNLSVAGYPDVFVIGDLANFPHQNERPLPGVAPVAMQEGEYVAKLIKQRVNGQEMAPFRYMELGSLAVIGQNAAVVDLGFVKFSGFLAWLIWIFAHVYYLIEFDNKMVVMLQWGWNYFTRGRGARLITGEKDLVSGFKLYQEAADKETKVNIKVEA

SEQ ID NO: 8965 - protein, 273 aa, Brassica napus
  misc_feature (101)..(101): Xaa can be any naturally occurring amino acid
MCSLSANMLLPTKLKPAYSDKRSNSLNSLLVSKTRSKRKNQSIVPMARLFGPAIFESSKLKVLFLGVDDKKHPPTLPRTYTLTHSDITAKLTLAISHSINXSQLQGWANRLYRDEVVAEWKKVKGDMALHVHCHISGGHILLDIFAKFRYYIFCKELPIVLKAIVHGDGDLLNKYPELQEAPVWVHFHSNVDEFNRVECWGPLWEATTTTSPDDDGHRRTHTLPESQCVDECTCCSPPVISIPWSHTLSNEMSNDYSRTQAEGKCLTPNPEKL

SEQ ID NO: 8966 - protein, 583 aa, Tropheryma whipplei TW08/27
MGFYITTPVFYVNDIPHIGHAYTLVVSDVFARWQRQSGKDTFFLSGTDEHGLKVLRAAEEKNMTPQGWADLMVKTAWKPLLDLMHISNDDFVRTTESRHRERVKWFINRLRENQYIYSGQYSGYYCVSCEEFKTVSQSALPNDESVNGTLGKDPRTCSLPQGEEQNYFCEVHGCQLEHFTEKNYFFRLSAFTDRLLDLYKKNPDFIEPKSAYNEVVQFVKNGVSDLSISRSSFTWGIEVPWDEGHVVYVWFDALINYLTPVMSAKEELPIDGTTPGGAEFCTHSNLNTLESSIPGPGGSAESDRLSHTLSTSADNAALTSPFKKYWPASHIIGKDILRFHAVIWPAMLMAAGLPVPEKIFAHGWLLVDGQKMSKSKLTGIKPQDLTDIFGVDAVRYYFLRQPVFGQDYSFSIESIAACYNSELADGYGNLACRLSSMYTTYLNGRVIVPKIYSEEDESLLQACKDVSDRACKAIDELIPHIAMAEIWSLAVRANTYTTRQQPWSLHKKQDDERLACVLYTALRALSTITILLSPIMPRITNKLWSAFGADGGVSQQNIRSAWGGKLSDKVSLIPPMFPKITIS

SEQ ID NO: 8967 - protein, 467 aa, Agrobacterium tumefaciens str. C58
MQTFVENFENSDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRFNGNAQHQAGHGLVMADMPGLSESIRKP

SEQ ID NO: 8968 - protein, 293 aa, Symbiobacterium thermophilum IAM 14863
MPTFGRLLTAMVTPMTPDGAVDYQRAGELAKHLVAAGSEGLVVSGTTGESPTLSHEEKLRLFETVVDAVGGQVSVIAGTGSNNTAESIRFSREAARTGVHGLLLVTPYYNKPPQEGLYRHFRAVAEAVDLPCILYNVPSRTSVNMLPATTLRLARDVPNIVGIKECADVGQLADILSGAPEGFRVWSGDDANLLPYLTVGAYGIISVASHVVGPQMRELIDAFLAGDTARAAAWHRRLLPVFRGLFAVTNPILVKAALRLTGFPVGPVRLPLVDATEEQEEALREVLAEAGVL

SEQ ID NO: 8969 - protein, 344 aa, Arabidopsis thaliana
MFSCIACTKADGGEEVEHGARGGTTPNTKEAVKSLTIQIKDMALKFSGAYKQCKPCTGSSSSPLKKGHRSFPDYDNASEGVPYPFMGGSAGSTPAWDFTNSSHHPAGRLESKFTSIYGNDRESISAQSCDVVLDDDGPKEWMAQVEPGVHITFASLPTGGNDLKRIRFSREMFDKWQAQRWWGENYDKIVELYNVQRFNRQALQTPARSDDQSQRDSTYSKMDSARESKDWTPRHNFRPPGSVPHHFYGGSSNYGPGSYHGGPPMDAARTTTSSRDDPPSMSNASEMQAEWIEEDEPGVYITIRQLSDGSRELRRVRFSRERFGEVHAKTWWEQNRERIQTQYL

SEQ ID NO: 8970 - protein, 392 aa, Synechococcus sp. CC9605
MPRPPELSDRAVALKPSLTLEISAKAKALRDSGKDICSLSAGEPDFATPPFIVEAAQHALGSGFTRYGPAAGDPDLRAALAHKLSVENGIPTQPEQVLVTNGGKQAIYNLFQVLLNPGDEVLLPAPYWLSYPEMAALAGASTRIIATKAEEGFRLDLDLLEQQITPRSRLLVINSPGNPSGKVMTRAELEALAALVARHPQLMVMSDEIYEYLLADGQQHCSFAAIAEEIRSRCFTVNGFAKGWAMTGWRLGYLAGDAAVIKAASALQSQSTSNVCSFAQRGALAAIEGPRDCVREMANSYNRRRTLLIEGLQALEGITLTPPQGAFYAFPRLPDGVPDSMEFCRQALEQEGLAVVPGLAFGDDRCIRLSCAVADETINDGLLRLKRLLRSF

SEQ ID NO: 8971 - protein, 506 aa, Oleomonas sagaranensis
MIHQTIEEISKSIAFRSRYDNFIGGKWVAPVRGQYFDNITPITGMPVAQIARSTAEDIELALDAAHAAKDAWGRTSVAERARLLNKIADRMEEKLDLLAMVETIDNGKPIRETKAADLPLAIDHFRYFASCVRAQEGSIGEVDHDTMAYHFHEPLGVVGHIIPWNFPLLMACWKLAPALAAGNCVVLKPAEQTPLSIMVWADLIGDILPPGVLNIVNGFGIEAGKPLASNKRIAKIAFTGETTTGRLIMQYASENLIPVTLELGGKSPNIFHEDVAAEDDDYFDKAIEGFVLFALNQGEVCTCPSRAIIHEKIYDKFMERALARVAAIKQGSPLEAATMLGAQASNDQLEKILSYIDIGKAEGAELLIGGERNILGGELAGGYYVKPTVFRGNNKMRIFQEEIFGPVVSVTTFKDEAEALSIANDTLYGLGAGVWTRDGNRAYRFGRAIQAGRVWTNCYHLYPAHAAFGGYKQSGIGRETHKMMLDHYQQTKNLLVSYSPKALGFF

SEQ ID NO: 8972 - protein, 145 aa, Brassica napus
MASFATIAAVQPSSAVKGLGGSSLSGAKLFIKPSRQSFKPKSTRAGAVVAKYGDKSVYFDLEDLGNTTGQWDLYGSDAPSPYNPLQSKFFETFAAPFTKRGLLLKFLILGGGSLLTYVSASSTGDVLPIKRGPQEKPKLGPRGKL

SEQ ID NO: 8973 - protein, 628 aa, Oryza sativa
MSGWGEQMDDQPRRYVPPNLRGGGGMPNAPAPPGMNAGYPPQGGAYGGQPPAYGAGAGRGFGGGNGGGFGGGYGGGGQRGGFGGGGYGQGRPGGGFGGNRGFGAPRGGNTPWPVENRMEDPFEQDAAVKAESDAVFGQENTGINFDAYEDIPVEASGRDCPPHVDGFDQLDLGEVMMNNIRRCKYTKPTPVQRYAIPIGLAGRDIMACAQTGSGKTAAFCFPIISGLVKAGYQPTGRQRKALPAALILAPTRELTSQIYEEARKFSYQSGIRPVVIYGGAPVVNQLREMERGCDMLVATPRRLSDLIERARVSLAAIRYLALDEADRMLDMGFEPQIRRIVEGEDMPPTGQRQTMLFSATFPKEIQRLAADFLHDYIFLTVGRVGSSTDLIAQHIEYVQQDQKRETVLDCVNTVEGLTLVFVETKRGADQLEDYLLRQNLPATSIRGDKSQAEREMALRAFRSGKCRILVATDVAARGLDIPHVTHVINYDLPKDIDDYVHRIGRTGRAGKKGLATAFFTDDDFGLARSLQEVLSETGQEVPGWLANIATRHAPYGTKTRRGGGRFGGRDFRKDFGGHNNYSHQRHGGYTGGSGGYGGGGYGGGGGGYGGGGYGGGGGYGGGHQSAWD

SEQ ID NO: 8974 - protein, 273 aa, Synechococcus sp. PCC 7002
MCGNCGCNAVEKPVEIHTHAHDHSHGHHDHHHPHDHEHHHHHNHDGNHSHAIDINQSIFAKNDRLAERNRGYFLAKDLFVINVVSSPGSGKTALLERTIEQLKNKLNSAVIVGDLKTDNDAQRLRKNNIPVAQITTGTLCHLDAEMVLNAARKLALDGVHLLIIENVGNLVCPAAYDLGEHKRIVLLSTTEGEDKPLKYPTMFKSADVVIINKIDIAEVVGFDRDSALENVKKMCPQAQIFELSARTGEGMESWLNYLQSQYQDIAFQAVITV

SEQ ID NO: 8975 - protein, 445 aa, Yarrowia lipolytica CLIB122
MLSIAEIAAKGLDYPYTNNTSFRVWIHVVGTVLREAEIYRDDGDFEKAYLLYTRFADLLLNKMPGHPGLKANRALFKKMTGKMPGVLQEMQQLKKALEVQITEEKKAEEERQRKLRALQQASDSGRSGGSRGSGSTSRIDDLRSQLGQGGPDHVNLEDYSFGRYDTRQVSEPMYEHGNWQQQAHHQHDTFDYPDLNRELSSVLSPYVYESGPLTLSPTAGQIRLADSPPAIPAKPAALKASYEKPAAPAPPTTSSSSVEHTSRYTTEGGLALRSLFIPAELEATFLKVAHANTVKNLETCGILCGKLSRNAFFVTHLMIPPQESTSDTCQTTNEELLFEQIDENDLFVLGWIHTHPTQTCFMSSVDLHTQNSYQIMLPEAVALVCAPQHDPNFGIFRLSDPPGVDIIKNCNRGGFHPHTEDNIYNNARHAMVKNGLPFKMKDLRS

SEQ ID NO: 8976 - protein, 360 aa, Vibrio parahaemolyticus RIMD 2210633
MKDNTPASSPERWIIYGANGYTGELIAREAVKRGHHPILAGRSLEKVQSLAAELGLQSLAFSLEDKSSAVQHISGSSLVLNCAGPFSSTAKPMMKACLEAGAHYLDITGEISVFEFAQTLQSQAKEASVVLCSGVGFDVIPTDCIAATLKAALPDATHLSLGFDSRSGFSPGTAKTSVEGLAQGGKVRLNGKITTVPLAYKVHNIDFGDGEKLAMTIPWGDVSTAYYTTGIENIDVFIPGSPNMIKNAKRANWVRPLLGITWVQNLIKSRIERTVKGPNEEQRNQLPTYVWGKASNKLGQSKTARVQTANGYSLTVTGSLAIVEHLLHTKPEAGVYTPSKLMGSNFVSQLPGSSGITIEE

SEQ ID NO: 8977 - protein, 401 aa, Zea mays
  misc_feature (172)..(172): Xaa can be any naturally occurring amino acid
  misc_feature (177)..(177): Xaa can be any naturally occurring amino acid
  misc_feature (389)..(389): Xaa can be any naturally occurring amino acid
MVRPRESWPGLSPAAGGPNLTRAAEMNRSVPRLPACFYNSGNLRILADSNVQDTSPVGTRRPFTPPARASPTTSTFSSLNTGSSPSFSELLHSSDGFMRYMVEEQPQNCSENEHLVGATSHVIQIDDKPDEIRKETRLIWKSDEDVRVMSAWLKHSIDPLSGNHKKGDKYCXGWGEXYHLTTEKIRWRTKTQVKERWHKLNRWTNLFNDCWLKARNIYTSGYSDQMWIDKAHKFYEEENNGSHFVFMNVWNMVRNEAKWFSYNDRSTLYKRKEMDNSNPIVDEGEDIELPRPIGQKAAKKAAFEANGKVAKKAVFEAKGKERRVDELDRFEKIQNGCHANRMKVLEMQQKISNDKIEASKLSLQAAKDEKEAKLLEKESKMLETYACLXKQDMSAMHDEIV

SEQ ID NO: 8978 - protein, 193 aa, Schizosaccharomyces pombe 972h-
MTVTPINPTNQPYKYVFVVIGPAGSGKTTMAKAVSEKLGFEYIEGDDLHPKANIEKMSQGHPLNDNDRWGWLHNCGGACAMELDKESIKGVVLTCSALKRSYRDILRSSLEHRPAILRFIYLAASRETLIKRTTSRKNHYMKADMVESQLAILEAPTADEKDVITISVENGKEQSEEECLDIVHKMVNENKQP

SEQ ID NO: 8979 - protein, 1859 aa, Oryza sativa
MAIGGSDWEREGDEGNLFDGMQQGAAGQAGPSGGGGGGGGGGGGGPDRLSGLPDAVLFRIVSHLGARQAVRRVLSATCGRPRRATFATPCACDESADQERFHGFVTTMLLRRRPFAPIKALRLCWSHDGDANNWIAHAILKLTRVRMGIKFITQICYRCTFLEELELKNVNSLEGQIQSTSLKRLSIINCLISDGFLVDAPNLISLCFFRPLSGKSTEGANHSSDNRSWPFSASVWEFDDDGSDHDDDFFAIASGGEHFDDKRDNESDQANGSSDEDSDDKRAQESDHDEDVPSSPYSDSKDSCDGSDSECESYESSDKEGDDLEDCDSNDMLENLIKVARGLTAYHGEVLLRRQLENFPMFNNLKTLSLGEWCMVPDFSALSTILKKSPKVERLYLHLDMIHRGRGDIDPSGGSFACNNLRKVKITCCKDDEMVHMLKQFLQRNGISLEKIVHHTSSTHNGEEDGGGDSSNLFDGMHQGAARQAGQSGGGGGGGGGADRLSALPDAALFRIVSHLTARQAVRTSVLSKRWRHVWASVPRVDIRHPCACDERADQERFGDFVTTMLLNRRPFAPIKALRLWWSHDGDAETWIAHAVRRGAEEIDFSARHHQDDPKPELEYTSFISPKIKILKLTTFGMDIKAITHICSRCTSLEELELKDFRRLDGQIRSASLKQLSIINCFISVAFLVDAPNLISLCFIRPLSFERTKESICSSDNRRWPSPVWKDDNDGFDHGDIFAIASGEHFDDKRENESDQDYGFDDGSDDNIASESDHDDDGPPSPYSVSYDGDNECESYEPGNKEESDRTVAYGEIADEYSSNGDPGDEYRGNYVNHDSANYGRANKFGNLNFPVKSIVDASAHEGELLLRRLLENFPMFNNLDTLSLGELFDGMHQGAAGPGPSGGGGDRLSALPDAVLFRIVSHLKAREAVRTSGLSRRWRHVWASAPRVDVRYPCACDGRAVDQKSFRDFVTILLLRRRPLAPFKALRLSWSHDEDDVSAWIAHAVRRGAEEIDLSARRHHGYPVPDYKHFISPKIKILKLTHLGTTRFTADNTLDLLCSGCTSLEELELKDIKSLWGGIQSDSLKRLSIINCHVTSDGFLVEAPNLISLCCIRPARAVPWFSHMVSLVEATVVLDDSRLSDDYQQPVLEDDNDGSDYDDNFFAPKAEGPDDKRDNEADNDSGDKRNRDGSKSDLDDHDGEYDHEDGSESGDKEVDDLEGGDDRTVTYGEIADESSSYGIPIPSDEYGGNYGNHDYTIFGGDHMLDHLSDVRTLGLLGHQGEMLLRRQLENCPIFNNLNTLTLGEWCMAPDFSALSTILENSPHVERLYLNLDMDIHRSRGGINPTGGSFACNNLKKVKITCRNPFDGMQQGAAGQAPRRDDGEAAGPSGGGGGGGEDRLSALPDAVLGRIVSHLKAWQAVRTSVLSKRWRDVWASAPRVDIRHPCACNERADQERFHGFVDTLLLRRRPFAPIKALRLCWSHDGDANNWIAHAVRRGAEEIELSTRHHQGSLEPEPEFTSFISPKIKILKLMRVGMDIRSITQICSRCTSLEELELEDVRLLEGQIQSASLKRLSIIKCYIDDGFLVDAPNLVSLCFIRPLGIERKGGSNSSSDRLWWPVWLNDDDGYDHDDDFFANASAVQSDDKRGSKSDQDDLEGCNDDDCTVAYDEIADEYSSNGGPGDEHGGYSESDDSTICGPYGLFNVLVKTSLIMIAREGELLLRRELENFPMFINLNTLSLGEWCMVPDFSALSTILEKSPNVERLYIHLDMVHRGRGDIDPSGGSFACNNLKKVKITCCEDDGETERARGSFEARKEVVNVVVEEEEVRPAIVVVVAGLTWTAAMMCSVPMAVMRLQQ

SEQ ID NO: 8980 - protein, 1099 aa, Saccharomyces cerevisiae
IGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGERLGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 8981 - protein, 341 aa, Schizosaccharomyces pombe 972h-
MDGEVLANKSCCGAVVTAFSVIGIVFTILKFTSFASFVYKTFFAKGVKLSVYGAKKGYWAVVTGATDGIGKEYATQLAMSGFNVVLISRTQEKLDALAKELETVAKVKTRTIAIDYTKTTAETFEKLHQDLVGTPITVLINNVGQSHYMPTSFAETTVKEMDDIMHINCFGTLHTTKAVLSIMLRERQKNEKGPRCLILTMGSFAGLLPSPYLSTYAGSKAFLSNWSASLGEEVKKQGIDVWCFNSYLVVSAMSKVRRPTLTIPTPKKFVRAALSSIGLQRGGTNPYISQPYPSHAVMSWSLEQLLGSAKGFVVSQVAAMHLSIRKRALRKEARLQAQNQA

SEQ ID NO: 8982 - protein, 240 aa, marine gamma proteobacterium HTCC2143
MRASLNKMATPTELHAVLFDLDGTLIDTAPDFAIVLNQLRQQNNRDPLPFQSIRETVSQGSKALITLAFQRQEGDRGFEDLRQQLLDLYSRHLAVETALFPGISDLLDWLEQRRIPWGIVTNKPRRYAEPILSFLALNQRCSTLVCPDDVSNTKPHPEPMFLACDQIACVPQNTIYVGDHRRDIEAGQNAAMTTVAANYGYIERHDPTVNWNADFSVDHAQDIQPLLQANFLLPQNNDRR

SEQ ID NO: 8983 - protein, 164 aa, Paxillus involutus
MANVFFDILINNQPAGRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVVEGFDVVKEIEARGTASGKPNANIKIAKSGTV

SEQ ID NO: 8984 - protein, 205 aa, Corynebacterium glutamicum
MGPIRIGVGGPVGAGKTQLVERITRALIDEVSMAAITNDIYTIEDAKILAANGVLPEERIVGIETGGCPHTAIREDTSMNDAAIKDLVERFPDLELIFVESGGDNLSATFSPELVDFSIYIIDVAQGEKIPRKAGQGMIKSDLFIINKTDLAPYVGANLDVMVEDAKAFRKNKPFCLTNLRTDDGLDKVLEWIRHEVIMQDLQEA

SEQ ID NO: 8985 - protein, 234 aa, Thermus thermophilus
MRAENPVFFLDYDGTLAPIAQRPEEAFPHPEAPRVLRALMERHPVYVVTGRRVRGLEPLLPLPGLPVVGGHGLEEGVLFGEVRPLFPVDLGPLRARLPSCPGVRVEDKGFALALHYRGAEDEEKARACLEAWLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 8986 - protein, 115 aa, Synechococcus sp. PCC 7002
MNKRLVQVIVFVMIVLLLVPLLATPAFGADLDQGAQIFEAHCAGCHLNGGNIVRRGKNLKKRAMAKNGYTSVEAIANLVTQGKGNMSAYGDKLSSEEIQAVSQYVLQQSQTDWKS

SEQ ID NO: 8987 - protein, 234 aa, Thermus thermophilus
MRAENPVFLLDYDGTLAPIAQRPEEAFPHPEAPRVLRALMERHPVYVVTGRRVRDLEPLLPLPGLPVVGGHSLEEGVLFGEVRPLFPVDLGPLRARLPSCPGVRVEDKGFALALHYRGAEDEEKARACLEAWLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 8988 - protein, 238 aa, Oryza sativa (japonica cultivar-group)
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 8989 - protein, 152 aa, Casuarina glauca
MALTERQEALLKQSWEVLKQNIPGHSLRLFALIIEAAPESKYVFSFLKDSNEIPENNPKLKAHAAVIFKTICESATELRQKGQAVWDNNTLKRLGSIHLKNKITDPHFEVMKGALLGTIKEAVKENWSDEMGCAWTEAYNQLVATIKAEMKE

SEQ ID NO: 8990 - protein, 143 aa, Candidatus Protochlamydia amoebophila UWE25
MIIVLKHAFQTPVTLRYPEEKRILPARSRGRHYLTKWNDGLERCVGCELCAIVCPAQAIYVKPAANEPGHIHSHGERYASDFQINMLRCIFCGYCEEACPTGAIVLSNQYELSAYTREDMIYTKDRLTEKTPGESGRDPSREI

SEQ ID NO: 8991 - protein, 428 aa, Tropheryma whipplei TW08/27
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 8992 - protein, 201 aa, Oryza sativa
  misc_feature (41)..(41): Xaa can be any naturally occurring amino acid
TPSSGRQGRYQKDAEETIDGIRNATAAQLDVADIKNLSNLXSQMKKHLVTASYVDESMSKLEQSAEGAGVTILCEMGLDPGIDHMMSMKMIDEAHSRKGKIKSFTSFCGGLPSPASANNPLADKFSWSPAGAIRAGRNPAVYKFHGEIIHVDGDKLYESAKRLRLPELPAFALEHLPNRNSLMYGDLYGISKEASTVYLRD

SEQ ID NO: 8993 - protein, 552 aa, Paxillus involutus
MSGKLATEYSSWKKLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSFDQMGVELGKVLAKNILSQLGKPSDVTGHDSSTAGLIHYYQKNRKE

SEQ ID NO: 8994 - protein, 708 aa, Magnaporthe grisea 70-15
MLPQITDRWHCSGPYFKEYFNNPTRAQVGAMVAILEVGAFISSLMVGRIGDIIGRRRTILYGSMIFFVGGAMQTLATGFEMMLVGRVIAGLGVGMLSTIVPVYQSEISPPHNRGKLACIEFTGNIFGYATSVWVDYFCGFITSNMSWRLPLMMQCIMGALLGLGSLIIVESPRWLLDNDHDEEGIVVIANLYGGGDIHNSKAREEFRDIKMDVLIQRQEGERSYSEMFRRYRTRVFIAMSAQALAQLNGINVISYYAPYVFESAGWVGHDAVLMTGINGITYLLSTVPPWYIVDSWGRRPILLSGAAMMTGSLAMISYFLYLDIKQTPMLVVIFVMIYNAAFGYSWGPIPWLYPPEILPLSIRSKGASLSTATNWAFNWLVGMMTPILQDIIHWRLYLVHAFFCASSFVIVYFIYPETCGVRLEDMGSLFGDSTTAMGTPATMGTPAQDPETGALLRPSSPIPPLDIRNGSGGPFGAAGAIPGLNIDPPDQAAVDAKNSRDAEQGGGGIGAWFSRLMGREWRQANRPWPSDEPNLMVEVEILDFCDGLDKRGHGVRTFTCPCQIVNVPRYLLEGLCPSIAVFRLPQITWGVLKVGLGDDVHAEIIKAYRAMYRAGLQAVMYSKPARFVVRDQLREAFRDRSGQFDMETIQRTVLFLRSASRERGLAHRIVKNLLTDVWMGEVRSAEMEELASQAKLPIGRWNSSRIRN

SEQ ID NO: 8995 - protein, 233 aa, Triticum aestivum
  misc_feature (176)..(176): Xaa can be any naturally occurring amino acid
  misc_feature (206)..(206): Xaa can be any naturally occurring amino acid
MKKLYQGKGRRVHPAPAPGPHAADAALAMLPATLLALVAALTAEEQEVLAYLLSGGAGGAAGGRRRRLNGPHQPEMGCGCFGCYKSFWARWDASPNRHLIHRIIDAVEEGSGGGGEGAAKGAGGPGGATRRGHRRRRRGRGGPCAIDAAAEEHGAAEVHVGVPDDHLQGCCASDGXEDGDYEGDEDDGADSLYGGEEALTDDSDCXGASNSAEKSAVGKLVRFIGEKVWAAWT

SEQ ID NO: 8996 - protein, 106 aa, Gibberella fujikuroi
PMATTEGVLVASASRGCKAINSGGGAITVLTADGMTRGPCVAFETLERAGAAKLWLDSEAGQDMMKKAFNSTSSFARLQSMKTALAGTNLYIRFKTTTGDAMGMNM

SEQ ID NO: 8997 - protein, 365 aa, Coprinopsis cinerea okayama7#130
MSSDNDFSSVPVLDYSLALSPSTKPQFLTQLRHALINVGFLYLSNHPISGIPALLDYIPKLFALPQEEKDKVAMVNSPHFLGYSRLGNELTKGKVDYREQWDFATRHETRWRDERDPDYYRVWGPCQWPNPKLIPGFRETLEGYLDEVQELSLKFSSLVAEALGLGPNGLDRFYDKPELMQHRAKIVKYPVPPDGQGEGQGVGPHYDAGFLTFLLQASEHRGLQVQNLAGDWIDAPPIPGTFVVNIGKALEFVTKGIARATSHRVLSPRGSTPRYSVPFFQNISLTIKLAEVDLEFPPEILKLRDERGTVAATDSVNFGEFNREPSGRVNLIGRVKSHPDVGERHYPALFKELFPNGFEGKGSAY

SEQ ID NO: 8998 - protein, 543 aa, Zea mays
MASSGEAALLGGSVGDARAPPLPWKLLALLCAALAVAWCAVRALEWAWWRPRRLARALRSQGLCGTSYRSLAGDAPLTEELNREARSRPLPLGCHDVAPRAMPLFHQTMKEHGKTSITWFGPVPRVTITKPELVREVLSNKFGHYEKLKLRKLQRMLHNGLGSHEGDKWAKHRRIINPAFHLEKLKRMLPAFAACCTDLVERWEGLVADGQQPCEVDVWPEMQNLTGDVISRAAFGSSYLEGRRIFQLQGEQVQLVVQAMHKLHIPGYLYLPTKTNRRMKRIASEIQELLKGIIAKRENALRTGGGAASDDLLGLLLESNMEHCRGDGGKSKASGITTDDVIGECKLFYFAGMETTSVLLTWTMVVLSMHPEWQDRAREEVLHVFGDRTTPDYDGLSRLRIVTMVLYEVLRLYTPLTALQRQTYKPMELGGVRYPAGVMLMLPLLCIHHDKDVWGPDASEFRPQRFAEGVSRASRDAPAFFPFGWGPRTCIGQSFALLEAKMGLSMILQRFAFELSPAYTHAPFAHGMLQPEHGAQVMLRRLP

SEQ ID NO: 8999 - protein, 123 aa, Brassica napus
  misc_feature (74)..(74): Xaa can be any naturally occurring amino acid
MARVSFKDSLKALEADIQHANTVALDYPREKDGARVQMRLSYNPAAQFLLFLVQWTDCHLAGALGLLRVLIYMXVIFPSLLQLERGITDIDDRKQKEVCKVRYRNKEEIERVKLSEIDMECGI

SEQ ID NO: 9000 - protein, 303 aa, Agrobacterium tumefaciens str. C58
MKFEGIYTPAITPLGHDGEIDRDAFAAVLESLMEARVHGIIIGGSTGEYYAQTAQERFDLAAYARQVIGTRLPLVVGTGATRTEDSIEYAKAAKEIGADAILVSSPPYALPTERENAVHALAVDRAANLPIMLYNYPARMGVVMGEEYFSRVGKSKNVVAIKESSGDMGNLHLLARKFPQIALSCGWDDQALEFFAWGAKSWVCAGSNFLPREHVALYEACVVEKNFDKGRAIMTAMLPLMDFLECGKFVQSIKHGCEIIGLRAGSVRAPLRPLNSDEKRTLQTVVTTLKRTVAQIASGANHA

SEQ ID NO: 9001 - protein, 128 aa, Zea mays
MAMSWTRGLKHGVVPRHAAQLVESRSLAIASKAKKGGKADAGKTPALSQELKSTTVFGANIFKEGSDPKIQPDSEYPDWLWHLLDKRPVLSELRRKDPKTLSYEDLKRFVKLDNRSRIKIRNDLNAKN

SEQ ID NO: 9002 - protein, 401 aa, Tropheryma whipplei str. Twist
MSIILGIETSCDETGVGIVSGSTVLANEVASSSLRHKPFGGVIPEIAARAHLEYLPNLLELALETAQLCIKDIDGIAVTAGPGLVTSLSVGVSAAKALGLSTGTPVYGVNHLVGHAVSAFLDDYTNDGLGVIHRRDSIGSNGIENDASSTHSHTHTTQVNRHSNLCVYTPPRRVLRDVCKYMHVRDSVVLLASGGHSCLLKIHNNKISLLGETLDDAAGEAFDKIARLMGLQYPGGPAIEMLASSGNPNAVEFPRALLTHFEEHNRYSFSFSGLKTAVGRVVERIKSNPAHSIPKIEDIAASFQEAVADVLTAKTVAAALASDVDLIVMGGGVAANNRIREMLCERAKIHGLDVKIPPIALCTDNGAMIAAAGSWLMQLGYNPSHSRFSPVSIMPLTQMVV

SEQ ID NO: 9003 - protein, 722 aa, Gibberella zeae PH-1
MSGIMSKRQQARNEKALQDLVQNVPGNNMCADCHARNPAWASWSLGVFLCMRCAAIHRKLGTHISKVKSLSMDSWTNEQVDNMRKVGNVTSNNLYNPEHGKPSVPVDVDEADSAMERFIRQKYMNNTVNGTGKSKSPHMGEGTPPPLPPKNSKFGFRSASSIFPLSSKSKKDAKTIAAARANRTESPRPPNKPSKVFGATLDLDQPDELDQKMARLLDMGFQDAKRNALVLKGVNGNLERAIETLVRLGEGSGRPSPLPTPSPREQTLRTSRSLTPLTPNSGGLGLGAGLSVPSRSATDRPTTPSSASTNPFDNLGTAPPQTAQSTGSLQNRNPYGQTNPFGAPVAQEQQPTDAFSQAFQNMSLSPQQPLFPHHTGGPVPQPAAQQLTGYQQVAPSAPTTPGGFSSLGFSNNMTYPQPLQAQSTGYNPFFTNQTAAVQQQPQQLNNPFPQVNTNQAPAGYKPFTRSPTRIASPSLGQIPEQTQSSFQNPAVYQTSAVYQSSAVYQSPAPLSPPETTTNPFFANAGQSIAQTGQVFGQQPAMQPMQNQTQATNNPFVQQQTGQQLYGQQQIPQMQQQQQMQQQQQQQQMQQQQQFYQPQRPDNASIMALFNNYPQMTPQQASAESTQSSYQTAHQPQQPTIPENQPMAPVQQNHGVPAPMSSGTNPFMTNAPAANSIASPNAMTTSDPFAARSRESMNLGMDLAWTNGRHSPDAFASLSARHG

SEQ ID NO: 9004 - protein, 112 aa, Candidatus Protochlamydia amoebophila UWE25
MMTTVFGKIIKGELSAEKVFENERIMVIKDLYPVAPVHLLIIPKKEIPNLQSIQQEDLELVSEIVVIAQQLAKQFNIEEGYRLVTNNGTMAGQVIFHLHFHLIGGRQLGSLG

SEQ ID NO: 9005 - protein, 152 aa, Paxillus involutus
MPNAAERTYIMLKPDGVDRGLIGEILARFEKRGFKLIAAKLALPSKEHLEKHYADLKDKPFFPGMIKYMQSGPVFCMVFEGLDAVKTGRAMLGATNPLASQPGTIRGDYALAVGRNICHGSDSVENAEKEIALWFPDGTLQYRLSQEAMIYE

SEQ ID NO: 9006 - protein, 720 aa, Triticum aestivum
  misc_feature (190)..(190): Xaa can be any naturally occurring amino acid
  misc_feature (292)..(292): Xaa can be any naturally occurring amino acid
KNGCPLVGISDITCDIGGSIEFVNRSTSIERPFFRYDTSTNLYHDDMEGDGVICLAVDILPTEFSREASQHFGDILSRFVTSLASAKGLLELPSHLRRACIAYAGKLTPLYEYIPRMRKTMIELPPTPANSLPDKKYTTLVSLCGHLFDKFLINEALDIIETAGGSFHLVKCDVGQSIDDMSYSELELPXPVGADDTTTLDKIIDSLTSIANAHRGDPNAAEISLKIGRVSECGIDDSMDKVGPKVLILGAGRVCRPAAEFLTSYQNIDQVHVVVASLYQKDAEEVNLTVQXVDGIKNATAAQLDVSDTESLSNLVSQVDVVVSLLPASFHAAIARVCIELKKHLVTASYVDDSMSKLEQAAQGAGVTILCEMGLDPGIDHMLSMKMIDEAHAQNGKIKAFTSFCGGLPSPAAANNPLAYKFSWSPAGAIRAGRNPAVYKFLGETINVDGSKLYESAKRLRLPELPAFALEHLPNRNSLMYGDLYGISKEASTVYRSTLRYEGFSEIMAILAKIGFFDAENHPLLQETNRPTYRIFLNELLNVNNVSTSNTKVNGEETGGHDDELISRLMMLGHCKEKELAVKILKTIKFLGLHEETQIPKDCSSAFSVICQRMEQRMAYGHNEQDMVLLHHEVEVEYPDGRPTEKHQATLLEFGKTENGRSTTAMALTVGVPAAIGALLLLQNKVQRKGVIRPLEPEIYIPALEILEAAGIKLIERVET

SEQ ID NO: 9007 - protein, 436 aa, Haemophilus influenzae 86-028NP
MAKIVKVIGREIIDSRGNPTVEAEVHLEGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 9008 - protein, 211 aa, Paxillus involutus
MAEGSNYDFLFKVVLIGDSGVGKSNLLSRFTRNEFNLDSKSTIGVEFATRSINVDSKTVKAQIWDTAGQERYRAITSAYYRGAVGALLVYDISKHATYVNVTRWLKELRDHADSNIVIMLVGNKSDLKHLRAVPTEEAKNFSAENELSFIETSALDASNVESAFQTILTDVYRIVSTKSLEQSSDPIRAPTSDTIPVAIDSSAPTKNGSCC

SEQ ID NO: 9009 - protein, 340 aa, Glycine max
MASDKKIRIGINGFGRIGRLVARVALQRNDVELVAVNDPFITTDYMTYMFKYDTVHGQWKHFDVKLKDSKTLLFGEKPVTVFGFRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKAAIKEESEGKLKGILGYTEDDVVSTDFVGDNRSSIFDAKAGISLNENFVKLVSWYDNEWGYSSRVIDLIAHIASVA

SEQ ID NO: 9010 - protein, 361 aa, Magnaporthe grisea 70-15
MADKLNRKALAVDSWLWRESSRPGYDANYPVLLTTYHLTFATVATQLLARYTTLLDGRKTVKMNGQVYMRAIVPIGFMFSLSLICGNLTYLYLSVAFIQMLKATTPVAVLLSSWVLGVAQPNLRIFLNVSVIVVGVVIASFGEIKFVLAGFLFQIGGVIFEALRLTMVQRLLSSAEYKMDPLVSLYYFAPVCAAMNATVALFWEMPKVSLAEVYHVGLFNFFLNGLCAFMLNVSVVLLIGKTSSLVLTICGVLKDVLLVAASVIIWPDKPVTGLQLFGYSIALAGMVHYKLGYDALKGYAAEGGRQWAEFGVRRPVLRRVLILGSVFTLGIFVLSGLAPYATEYDATKVLSKAANKVGLPQ

SEQ ID NO: 9011 - protein, 325 aa, Synechococcus sp. CC9605
MDPEAQRLISISDQRRLLEHLELGDVERWLAQQHQSGRHRIALGHWHPQAAPDWLWSVGLPLLSLAEKWRGKRRLIGFSALPGCGKTTLGQWIEAAAKELDLSVQVVSLDDFYFEAERLEEAMRGNPWGVPRALPGSHDLGLLQECLKTWRQGENVLMPCFDKAKRQGRGDRSGWRRCAADLLIFEGWFVGCRPNADVTADEPHLESPLTPQELEWRLKLQPVLANYEPTWSCFDQLWQMRATDFNAPWRWKRQQEATLEAERGVSLSNADLDRFIRMILCSLPSSSFHTMRADVVVEVDPDRTLRRIHLPSSTQDSASSDSLTG

SEQ ID NO: 9012 - protein, 511 aa, Agrobacterium tumefaciens str. C58
MRREPIMHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 9013 - protein, 452 aa, Heterocapsa triquetra
EIKKRAEGDMKGFLGYCDEDLVSTDFETCTISSTFDSKACIMLDPTFVKLVAWYDNEWGYSCRVVDLIKHMAKVDAGESGAAPKGVKKSVADLSDADLDGKTVLIRCDLNVPLNGDLEITDETRITASIPTIEYLCKKGAKVLACSHLGRPKNGPEDKFSLKPVAKRMSELMGKEIKCAPDCKATDEVKKMVGAMGKGDVMILENTRFYKGETKNDPELAESMASLADLFVNDAFGTAHRAHSSTEGVTKFLKPNVSGFLLKKELDYLAGAVDSPVRPMCAIVGGAKVSTKIPVIESMLDKVDKLVIGGGMVFTFLKARGLSVGGSLVEEDMLDLAKKLEEQAKAKGVELILPSDIACGDAFPADGKEVGFKVVPAIEIPDGWLGLDNGPDATEEIKKALADCKTVIWNGPMGVFESPQFSKGTYEIAECLARSRRRTAPSPSSAVATPCQP

SEQ ID NO: 9014 - protein, 415 aa, Heterocapsa triquetra
  misc_feature (219)..(219): Xaa can be any naturally occurring amino acid
PAKLSIDDVDVAGKRVFMRVDFNVPQDKKDPTIITNTQRIDGALPTIQAVLAKGAKCVVLASHLGRPDGSVMEKYSLAPVAKIVEEKLGKPVTFCKDCCGPEVEATCADPAMGSVILLENLRFHVEEEGKGVDASGEKIKADKEKVKEFRASIRKLADIYCNDAFGTAHRAHSSMVGEGFDVKCSGGLMAKELSAFAKVLDEPARPLLAILGGAKVSDXIQLIMNMLDKVNKIIIGGGMAYTFLKVKDNMSIGTSLYDEEGANIVPDILKKAEEKGVELILPVDFVISSKFGEDGEIKTATKEEGIPDGFMGLDCGEKTLELNRAGVAASKTIIWNGPMGVFEMAKFETGTKTLMDDIVKRLRMASFTVIGGGDTATACKKYGTEDKVSHCSSGGGASLELLEGKDLPGVSALND

SEQ ID NO: 9015 - protein, 356 aa, Lactococcus lactis subsp. lactis Il1403
MRAARFYDRGDIRIDEINEPIVKAGQVGIDVAWCGICGTDLHEFLDGPIFCPSAEHPNPITGEVPPVTLGHEMSGVVNFIGEGVSGLKVGDHVVVEPYIVPEGTDTSETGHYNLSEGSNFIGLGGNGGGLAEKISVDERWVHKIPDNLPLDEAALIEPLSVGYHAVERANLSEKSTVLVVGAGPIGLLTAAVAKAQGHTVIISEPSGLRRKKAQEAQVADYFFNPIEDDIQAKVHEINEKGVDAAFECTSVQPGFDACLDAIRMGGTVVIVAIWGKPASVDMAKLVIKEANLLGTIAYNNTHPKTIDLVSTGKIKLDQFITAKIGLDDLIDKGFDTLIHHNETAVKILVSPTGKGL

SEQ ID NO: 9016 - protein, 172 aa, Prochlorococcus marinus str. NATL2A
MDHLKKYITEINDYPKKGIVFKDLNPIYKEPKIWKELMFPLQNLISTKKPDYIAGIESRGFISASALAFKLEIGLITIRKPNKLPGEVIGTNYKLEYGEDRLEIQQNIMEKDSKIMLFDDLLATGGTAGAAGNLIKKAGGNLIGYAFLVELTELKGRENLDSNLFVETLIKY

SEQ ID NO: 9017 - protein, 436 aa, Isochrysis galbana
MVARTATLALALFGGAEALRIGAAPMRSTSRTCTIEMAKKSVGDLTKADLEGKRVLVRCDLNVPLDGKTITDDTRIRASIPTIKYLIDNGAKVLLSSHLGRPKGGPEDKFSLGPVAPRLSELLGKEVTMAPDCIGDAVADCVTKMANGDVLLLENTRFYKEEEKNDPEFAEKLAANADMFVNDAFGTAHRAHGSTEGVTKFLSPSVAGFLLQKELDYLDGAVSDPKRPFAAIVGGSKVSSKIGVIESLMEKVDKIVIGGGMVFTFLKARGLETGSSLVEEDQLELAKKLEVIAKEKGIDFILPTDVIVADKFAADAATQIVSVDAIPEGWMGLDNGPESTKMIQQKLSECKTIIWNGPMGVFEFEAFAKGTFDVADTLAELTGKGCTTIIGGGDSVAAVEKAGLAEKMSHISTGGGASLELLEGKVLPGVAALQEA

SEQ ID NO: 9018 - protein, 614 aa, Tropheryma whipplei str. Twist
MITKDIRNIAVVAHVDHGKTTLISAMLQQTSDSTTAEDRVLDSHELEREKGITILAKNTAVTYKSSGRSVTLNIVDTPGHADFGGEVERGMSMVDGVVVLVDASEGPLPQTRFVLKKALLKKLPIVLAVNKTDRSDARIDDVVSEFQDLLISLAEEINDPALYSILDVPIVYVSGRAGRASINKPDNGQLPDRNNLDDLFEKIISYIPAPEYDKNAPLQAHVANIDASAFLGRLALTRIYNGSISKGQTVCWVNASSKQRVNVRVTELLKTVALDRVPVPSVSAGDIVAIAGIPDVMIGDSICDPDDVRPLPGISIDEPAISVVIGVNTSPLAGGVPGHKLTATQIKERLDRETIGNVSIRVIPTRGTDAWEVQGRGELALAVLIEQMRREGFELTVGKPSAVTRIVDGSLHEPYELLTVNLMDEYFGSVTKLLAERKGRVESVISNAGWTNADFVVPSRGLIGFRTEFLTITRGTGTANAIFHSYAPWSGQINQRAQGSAVADRAGHVTSYAILGLQERVLFFVSPSEQVYEGMVVGRNSRPGDLNVNVTKGKKLTNTRSSTAEELEKIVPARHLSLEECLEFAGPDECVEVTPEAIRIRKIELSQSVRSKQR

SEQ ID NO: 9019 - protein, 492 aa, Agrobacterium tumefaciens str. C58
MNGGSRPMTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 9020 - protein, 430 aa, Synechococcus sp. WH 7805
MALEVLEAVAAGAYADVALERALRQHPLQAADRGLATELAYGTIRWRQWLDAWLDKLGKVPARKQPPRLRWLLHLGLYQVLRMERIPPAAAVNTSVELAKGGPLARLAPVVNGLLRAALRARDAGDGLVRPSEPEMELAQDQSLPLWFTRDLLRWCGPVQAAQVAQACNQVPPLDLRINRLRASPAEMASRFAEHCMPTAPIPGCPDGLQVLDPAGDLRQWPGFDEGYWCVQDRAAQWVAPLLAVEAGQRVLDACAAPGGKATHLAELMGDQGEVWAVDRSPGRLQRVAANASRLGSHCIHALAADASQLLQQRPQWMASFDRILLDAPCSGLGTLARHPDARWRISESSIADLVQLQAGLLDALLPLLKPGGRIVYATCTVHPAENTDQIHGWLQRHPQLVLVSEQQRWPDPQGGDGFYAAVITAPAAA

SEQ ID NO: 9021 - protein, 473 aa, Schizosaccharomyces pombe 972h-
MTNTRLASTRRLASSLLSQASLRSRQLNPLFTSSYSTRSSSLKDRLAELIPEKQAEIKKFRAEHGQDVIGEVTINQMYGGARGVRSLIWEGSVLDPNEGIRFRGYTIPECQKLLPSSPNGKQPLPESLFWLLVTGEIPTLSQVQALSADWAARSQLPKFVEELIDRCPPTLHPMAQFSLAVTALEHDSAFAKAYERGMNKHDYWKYEYEDCMDLIAKTVPIAGRIYRNLYRDGVVAPIQMDKDHSYNFANVLGFANNEEFVELMRLYLTIHADHEGGNVSAHTGHLVGSALSSPFLSMAASLNGLAGPLHGLANQEVLNFLITMKKEIGDDLSEETIKSYLWKLLNSGRVVPGYGHAVLRKTDPRYTAQREFALEHLPKDPMFQLVSRLYEIVPGVLTEHGKTKNPYPNVDSHSGVLLQYYGLKEQSFYTVLFGVSRTLGVASQLIWDRALGLPIERPKSFSTEALKKMVETK

SEQ ID NO: 9022 - protein, 142 aa, Paxillus filamentosus
YIMLKPDGVDRGLIGEILARFEKRGFKLIAAKLALPSKEHLEKHYADLKDKAFFPGMIKYMQSGPVFCMVFEGLDAVKTGRAMLGATNPLASQPGTIRGDYALAVGRNICHGSDSVENAEKEIALWFPDGTLQYQLSQEAMI

SEQ ID NO: 9023 - protein, 644 aa, Agrobacterium tumefaciens str. C58
MQRPDVGQAHGAVSRHFGIFHHSGSNWVSTVKLWSLKMNIVAKTIPLVVTTGPHAASTKIHKPGILHPHIRVPMREIAVHPTAGEPPVTVYDSSGPYTDPSHPVLIENGLPRLRHDWVVARGDVEAYEGRHVKPEDNGFATGERLTPEFSVRHQPLKATAGKAVTQLAYARAGIITPEMEFIAIRENLGREAAKEKPTRDGESFGAHIPDYVTAEFVRQEVASGRAIIPANINHPELEPMIIGRNFLVKINANIGNSAVTSSMAEEVEKMVWAIRWGADTVMDLSTGRNIHNIREWIIRNSPVPIGTVPLYQALEKVNGIAEDLNWEVFRDTLIEQAEQGVDYFTIHAGVRLHYIPLTVNRVTGIVSRGGSIMAKWCLHHHKESFLYEHFEEICDICRAYDVSFSLGDGLRPGSIADANDAAQFAELETLGELTQIAWARDCQVMIEGPGHVPMHKIKENMDKQLKTCGEAPFYTLGPLTTDIAPGYDHITSGIGAAMIGWFGTAMLCYVTPKEHLGLPDRNDVKVGVITYKIAAHAADLAKGHPAAQVRDDALSRARFEFRWEDQFNLSLDPDTARSFHDETLPKEAHKVAHFCSMCGPKFCSMRISHDIRAEAQKEGLEAMAARFKEGGELYMPLPTPASAE

SEQ ID NO: 9024 - protein, 753 aa, Oryza sativa (japonica cultivar-group)
MTDVELRVEALSLSGVSAIPPEYVRPEEERADLGDALELARAASDDDATARIPVVDISAFDNDGDGRHACVEAVRAAAEEWGVIHIAGHGLPGDVLGRLRAAGEAFFALPIAEKEAYANDPAAGRLQGYGSKLAANASGKREWEDYLFHLVHPDHLADHSLWPANPPEYVPVSRDFGGRVRTLASKLLAILSLGLGLPEETLERRLRRHDQHGVDDDLLLQLKINYYPRCPRPDLAVGVEAHTDVSALSFILHNGVPGLQAHHAGTWVTARSEQGTIVVHVGDALEILTNGRYTSVLHRSLVSRDAVRVSWVVFCEPPPESVLLQPLPELLANGAGKPLFAPRTFKQHIRCDVFGKNFVELNQAVSKMKYVYDKWDQNRLQYMQTTRSYRSKFLSPTAMYSSSSMKPSSPSQANQDADDAKTYKELYQRCTDLVSSWPSRQGLSYLQLFRHEKGWYNGVTPLVGTMVADELFAARPSDIVVPTLPKSGTTWIKALLYATVHRREHPADAAGDHPFNSLGPHECVKFLEYHLYRADEAPDLDALPDPRLFATHAPFDLLPRAVVAAAPPSGCKVVYVCRDPKDTLVSLLQFVNEYKSRNGRELVAVDAAVGFFCDGVSPFGPYWEHVLGYWRAHRERPERVLFLRYEEMKRDPAGHVRRLAEFAGVPFTSPEEDGGAVDAIVRLCSFDNMVGLEATKGGRTQLTTTTVPNSAFFRRGEVGDWANHLSPEMAQRIDAITEAKFAGFGLAPSLIEL

SEQ ID NO: 9025 - protein, 193 aa, Desulfotalea psychrophila LSv54
MNLNDITFLLSVHGLDQLPEDGLPEFAFAGRSNVGKSSLMNTLLRRSGFVKVSGRPGKTQGLNFFQAAEDCMLVDLPGYGFARVSKEMQNNWQKLITSYISEREALKCVVVIIDIRHEPKALDRQLLDWLREQKVPVLPIYTKIDKLSGNQLSRHAAILDAGHGIKKDERILFSSKTGQGRDELIAVLESYLA

SEQ ID NO: 9026 - protein, 494 aa, Paxillus filamentosus
KLQQIYDAEHPRLILKELFAQDPDRFSKFSKEYVDPTDPNTTFLIDYSKNLITQPILDTLLSLASEAELETYRDKMFAGERINTSEDRAVLHVALRNFDDFKIQEKGVEEVASVLAHMKEFSDAIRSGSWKGYTGKTINTIVNIGIGGSDLGPVMVTEALKPYAKRDLTALFVSNIDGTHLAETLRECDPERTLFIIASKTFTTQETITNAESARDWFLSFAKDKAHVAKHFVALSTNTKAVTAFGIDGANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKNGERVDYQTGPIIWGAAGTNGQHSFYQLVHQGTKLIPADFLAPATSHNPIADSKHHRILLSNFFAQPEALAFGKTEEEVRKELGRGASEALVKSKVFEGNRPSNSIMFPLLTPRTLGALISLYEHKIFTQGVIWGINSY

SEQ ID NO: 9027 - protein, 453 aa, Glycine max
KKPTLGGVSDERKSESTSSVVNASELPPHLLLEMPALSPTMNQGNIAKWRKQEGDKIEVGDILCEIETDKATLEFESLEEGYLAKILAPEGSKEVAVGHSIAITVEDASDIEAIKNSVSSSTNQQKAPQRGTKSEVKAQKNNITRISPAAKLLIAEYGLDAPTLNATGPYGTLLKGDVLSAIKSGKLSPKPASSKEKALSSQSHQQVAASQESKSDLKKSDAYEDFPNSQIRKVIAKRLLDSKQNTLHLYLSSDVILDPLLSLRKGLKEQYDVKVSVNDIIVKVVAAALRNVPEANAYWNVETGEVVLNDSIDICIAVATEKGLMTPIIKNADQKTISAISSEVKELAAKARAGKLKPHEFQGGTFSISNLGMFPVDKFCAIINPPQACILAVGRGNKVVEPVIGTDGIEKPSIATKLSLTLSADHRVFDGKVGGAFLSALQSNFSDIRRLLL

SEQ ID NO: 9028 - protein, 279 aa, Oryza sativa (japonica cultivar-group)
MENFMLIAISCRDQDVRPPGGFMSYFGNEAQNSHLVGAVIHMSPLNQAHNGSSPPEVEILHGNDSVRTEKRIMWTPDEDVRVMSAWLEHSTDFTCGADKGGVQYWGEVVETYNKTTPPLRRRNAKQCKDRWNKINKWTDLFECAYAKARRVFTSGYSAEMWLDAAHKFYVDDNKECKDVVGPYMLTEVWKICRDVPKWKTYNENLKNARKRKAFHLEGESEENEDTCDQMPQRPIGQKAAKKAALAAKNGKLKGSSSSDDGHSKDSPIELDKFDRYSKF

SEQ ID NO: 9029 - protein, 514 aa, Synechococcus sp. CC9605
MPYTLTTPLYYVNDRPHLGSTYTTLACDALARFERLLGEKVTFVTGVDEHGQKIQRTAERQQLSPQDHCDRVSSRYRDLWNQWGISDDRFVRTTNPRHLELVGEFYERVKASGDIVVGKQTGWYCVDCEEYKDDPAEAESPSCPIHRKPLEWRDEENLFFRLSRYQSAIEELVARDDFIAPVSRRQEVRNFVAQGLHDFSISRVNVSWGLPVHDHPGHTFYVWFDALLGYLTALLDDGEAVSLDRLASCGWPASVHVIGKDILRFHAVFWPAMCMSAGLPVPQKVFGHGFLTREGQKMGKSLGNVLDPELLLERCGTDAVRWYLLRDIQFGDDGDFQQQRFVDLVNNDLANTIGNLLNRTSSMARKWFDDGVPPAGAASEADHPLALKAAETISTVMEAMPQLAFKTAAESILQLAIAANGHLNDTAPWSRMKEPGQEAGVAEDLFAVLETTRIVGLLLAPLLPDLSERILSQLGESLDPNNWSNQLNWGRLCSGSALPKPTPVMQRLELDEPL

SEQ ID NO: 9030 - protein, 419 aa, Pavlova lutheri
MSLSSKLQLSSVDVKGKRVLIRVDFNVPQDKKDPSKITNTARIEGALPTIKHCLDSGAKSVVLMSHLGRPDGSRVDKFSLKPVAGELEKLLGKPITFLSDCVGEEVEAACAAPADGSVILLENLRFHIEEEGKATTESGEKLKADPAKVAAFRASLAKLGDVYVSDAFGTAHRAHSSMLGEGFTTKAAGFLVAKELVAFAKVLDAPARPVLAILGGAKVSDKIQLIKNMLDKVDKMIIGGGMAYTFLKTTNSMPIGSSLYDEEGAKIVPEIMALAKEKNVEIHLPVDFVTSSKFGEDGTIGAATLAAGVPDGMMGLDCGPKSSEAFAKVIMESKTIIWNGPMGVFEMASFETGTKAMMDVMCKATEAGIVTVIGGGDTATCCKKYDTEDKMTHVSTGGGASLELLEGKEMPGIAALSSA

SEQ ID NO: 9031 - protein, 168 aa, Oryza sativa (japonica cultivar-group)
MAAAAARSIPDRWTLAGATALVTGGSKGIGYIHATIYITLAHPLLLAAGGGGGCVVNISSVAGTVGIPALAVYSMTKGGMNQLTRSLAAEWAGDGIRVNCVAPGGVKTDICQDETIDPELIKSEMDRLPMRRLAEPEEVAATVAFLCMPAASYITGQVVGVDGGRTIT

SEQ ID NO: 9032 - protein, 418 aa, Guillardia theta
MSSLNKKQLKDVDVSGKRVFIRVDFNVPQDKADPSKITNNARIVGALPSIKHCLEKGAKSVVLASHLGRPDGARIEKYSLAPVAKELSKLLDKEVKFLNDCVGAEVEAACADPAPGSVILLENVRFHVEEEGKGEVNGEKIKADPAKVKDFRASLRKLADVYVSDAFGTAHRAHSSMVGEGYDVKCAGFLVAKELENFSKVLDNPTKPVLAILGGAKVSDKIQLIKNMIPKVDKMIIGGGMAYTFLKVLDKMEIGTSLYDEEGAKIVPEIMSLAKEKNVEIVLPVILSSPRSLERDGETGTATKAEGIKAGFMGLDCGPESIKKNREAIMSSKTIIWNGPMGVFEMSKFEGGTKAMMDGMVEATSKGVLTVIGGGDTATWCVKYNTEDKVSFVSTGGGASLELLEGKVLPGVSALSDA

SEQ ID NO: 9033 - protein, 246 aa, Prochlorococcus marinus str. NATL2A
MRKPVIAGNWKMNMTCTEAIEYMRVLIPLLKDIPKKDREIVIAPPFTALYPLSEFIRDRNEYLSLSSQNVHWEDSGAYTAEVSPLMLNELSVKCAIVGHSEPRKYFSESDEQINKRAKSAQDHQLIPIVCVGETFQQREMGEAERVIRRQIEQGLEGIEVKRLIVAYEPIWAIGTGKTCEANEANRICGLIRKWIGYEDVIIQYGGSVKSNNIDEIMSMSDIDGVLVGGASLDPTNFARIANYEKI

SEQ ID NO: 9034 - protein, 442 aa, Kryptoperidinium foliaceum
GRATESSILHCTIMVQTRKRNVGDILESLPSDGGAKNILVRVDFNVPLNGSFEITDDSRIRGAMPTIESILKAKHNAILMSHMGRPKAVQKGEDTDGSQRKALTLQHVQKRLSELSGVDVQFVDDCIGDKVKDAVSKLPKEGGAILLLENLRFYKEEEKNAPEFAKSLASIADAYVNDAFGTSHRAHASVSGVPGLMPKEKCAVGSLVAKEVAFLDFSSLGEDEVVAAVIGGSKVSTKLPVIKGLLNQVHILVLGGGLAYTFAKAKGITIGTSLCEEEMVETAKDLIREAEVKGKKLILPIDAVCSKEFPKGEMKMEDTQTFDLVPGNGITDGWMGLDVGPKTAALFDQALTTATKIVFNGPMGVFEIRPFDEGTKAMVDTLEAVTKKGAITVVGGGDSVAALEQFHKTDVVTYVSTGGGATLELLAGDTLPGVAAIADLEE

SEQ ID NO: 9035 - protein, 249 aa, Prunus persica
NKSQDRGYEGKAGEYEEGSGARAAECGEIKDRGLFDFLGKKEAEKPQEEVIVTEFEKVKVSDHEAPHPHHHEPESYKVEQEEDKEKKHGSLLEKLHRSDSSSSSSSDEEEGEGGEKKKKKKEKKGLKEKICGDHDQKVEDTAVPVEKIYEEPTHEEKKEEEKKGFLEKIKEKLPGQQKKPEEIPASYDDQQCHAQHAEPAEPAGVGCEPKEKKGILEKIKEKIPGYHPKTEEEKEAIKEKEKEKETSSY

SEQ ID NO: 9036 - protein, 494 aa, Vibrio cholerae O1 biovar eltor str. N16961
MDTIMPLPTHFYTTQQLKQGEQDAASERGLELFHLMERAGQAVFTIAFAQYPTSHHWLICCGGGNNGGDGYIVAVLARHMGIDVTVWQLGDPEKLPADAHRAYQQWKELGGAVYAPQSEVPESTDVIIDALFGIGLKEVLRPQVVPLVELLNQSGKPIVAVDVPSGLCADTGQVMGTCIKAQHTVSLIGLKQGLVTGQARCYVGTLHYAGLGVEEVFAQHNTPSLVSIDGKLRHSLLPPRQACTHKGQNGKALIVGGNEGMGGALILCASACARSGAGLSAAMTHPDNVTAMLTITPEVMSTSWNKQHLFEERIEWCDALALGPGLGRDAQAQQIMQRLSSLKVPKVWDADALYFLAHNPSYDAQRIITPHPVEAARLLGCEVEEVEQDRFAAIRQLQQRYGGVVVLKGAGTLVDDGKEIAVCLQGNPGMASGGMGDVLTGIIVALLAQKIPLADAAKLGVWLHSSAADLNTKSHGQRGLLASDLLPHLRELLN

SEQ ID NO: 9037 - protein, 193 aa, Triticum aestivum
  misc_feature (152)..(152): Xaa can be any naturally occurring amino acid
  misc_feature (183)..(184): Xaa can be any naturally occurring amino acid
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLXAMQLMTENRVRHIPVIDGTGMLGMVSIGDVXXPVVAEHKED

SEQ ID NO: 9038 - protein, 312 aa, Heterocapsa triquetra
MLESFFHLLHFLMLLPFVGYFLVNFAYLLGPQNLKQKYGAKWAVVTGASSGIGKSIARRLAAQGINVVLVALGNSDLEAAVVELTAAFPEREFRVVACNLSDGTGAWMKDVISSTKDIDVQLLFNNAGYIVTGFFHQRSVDVHLANFHCNLTAAVHLTHHFYSLLLEKKLRGAIVFTSSAAAVMPSPFAVGYGTTKAALTEFATSLAVEGRAKGIDVCVFHPSPVNSRFLQGGGTNVEVAKLQMFDAAYKLASSPDDLPDKVFAAIGRPCISVDFGGVAVGMRLMVMTLGGSLLNFGFAVCAPLMPDYRKHS

SEQ ID NO: 9039 - protein, 179 aa, Francisella tularensis subsp. holarctica
ERVDLDKLGIYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIDVSPSDSLAIMAANAHLIPVYSKGIKGVARSMPTSTAVDRVAESLRLP

SEQ ID NO: 9040 - protein, 320 aa, Isochrysis galbana
MAMDAYTLLVAVGTLVVVREALSFLYVLYKGMIRPPKKLTKYGKWAVVTGATDGIGKAVSFELARRGCSVVLVSRTQSKLDAVAAELKDTCPNVEVKTEAVDFGNLSKERLSALEASLAELEVGVLFNNVGVSYDFSQWFHELLDDEVEALLKLNVESTTWMTRLVLPGMVKRKSGAIINQSSAAARFPLPLLAGYSAAKGYIENLTRSCHGEYEAKGIHFQCQSPLWVATPMVFPNSKVPPEKRATLMVPTTRKYAKCAVNAIGYDVLVSPYWVHELAIWVGNRLPNFLVVQGILKMHLAVRFNKKCVAKMEEKQKKKQ

SEQ ID NO: 9041 - protein, 437 aa, Pseudomonas syringae pv. syringae B728a
MATAETSSLRRAITAPMLTLFILGDVLGAGVYALAGTIAGRVGGAIWAPLLIALCFALLTAASYAELVTKYPRAGGAAVYAEKAFGKPLLSFLVGFSMVAAGVTSAAGLAVAFAGDYFQALLDWPAQWVCVAFLVTVGLLNARGIKESLSANLVMTVIELSGLLMVIAAAIWFVSQGQGVPQRVFELDSASPATAILGASLLAFYSFVGFETSANLAEEIKDVRKVYPRALFGALLAAGAVYILVGMGAAMVLPVEQLKDSQAPLMDVVSASGLGIPAPWFAVIALIAVANGALLTMIMASRLTFGMAREGLLPAVMGSVLPKRRTPGLAILATTLVAIALSFTSTLTILAETVVLLLLFVFLSVNIAVLVLKRDKVEAGHFQVHWVIPLLGILSCLLLLTQQGPETWLRAGIMLAVGAALYGLTRLGSSALASHPR

SEQ ID NO: 9042 - protein, 700 aa, Oryza sativa (japonica cultivar-group)
MTEERGCTMSDTEMPFKYSSGKAFPLGVSQVEGGLNFALFSQHASSVILCLKLPGRGTEDEKGADVVEFVLDQQKNKTGDIWHVIVEGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 9043 - protein, 179 aa, Francisella tularensis subsp. holarctica
ERVDLDKLGIYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIYVSPSDSLAIMAANAHLIPVYSKGIKGVARSMPTSTAVDRVAESLRLS

SEQ ID NO: 9044 - protein, 127 aa, Desulfotalea psychrophila LSv54
MVELNFEKSVDGLLPAVVQDYVSGEVLMLAYINKLSWEKTLETGQAHYWSRSRNSLWLKGESSGNVQVIHDILVDCDSDTVVFKVDQIGDAACHTGHRSCFFRRVHQGELVVEGKPLFDPAQVYGSK

SEQ ID NO: 9045 - protein, 454 aa, Haemophilus influenzae 86-028NP
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQAKDAIGAYPRDCELAAAIQKACFKNKLLLERGGRGGNVVRVLCAVNINQSECEEFIKRFKQSVVDALKVVRS

SEQ ID NO: 9046 - protein, 160 aa, Paxillus filamentosus
VIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVMDSGDGVTHTVPIYEG

SEQ ID NO: 9047 - protein, 258 aa, Brassica napus
  misc_feature (209)..(209): Xaa can be any naturally occurring amino acid
MGPESRSTPISASSPASSSSPSGKRTRDPEDDEVYLDNLRSQKRYLSEIMACSLNGLTVGDSLPVNMLDSPSRSDTLLSPNNHIHRDDLSLQYSPMSEDSDEARFCEDPITSTSSSQQPESRPTSPVSPYRYHRPLTSTTSHHLSNSHSCPASMSTNATTPQSRPRGSDTEGRFPSSPSDICHSSDLRRTALLRSVQMRTQPCGIASTXGTSNVDGGEEKLCFKSMEEDNRGEDVSYTQVSGGKSKSCKALDMRLCER

SEQ ID NO: 9048 - protein, 161 aa, Paxillus involutus
VVLIGDSGVGKSNLLSRFTRNEFNLDSKSTIGVEFATRSINVDSKTVKAQIWDTAGQERYRAITSAYYRGAVGALLVYDISKHATYVNVTRWLKELRDHADSNIVIMLVGNKSDLKHLRAVPTEEAKNFSAENELSFIETSALDASNVESAFQTILTDVYR

SEQ ID NO: 9049 - protein, 431 aa, Schizosaccharomyces pombe 972h-
DPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 9050 - protein, 120 aa, Triticum aestivum
  misc_feature (25)..(25): Xaa can be any naturally occurring amino acid
TEQGDAVVFDSARGDRIYLSAPPKXIVTIDHEKKRTFVLRKKELPDVVVWNPWDRKAKAMPDFGAEEYKCMLCVGAARIEKPITLRPGEEWQGRQEISPVPSSYSSGLLDPEMIQQMQRI

SEQ ID NO: 9051 - protein, 290 aa, Streptococcus pyogenes MGAS8232
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLSQLSLIHLNKTGKLLTFPFKAAALVTEQAITVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 9052 - protein, 163 aa, Heterocapsa triquetra
MQRSVCIVAAALALYGASCFVMPSMMGAAPEVGRQAVREQALAAAPEAASASAGSWSPLALGAALGLLVAVATGRPALAADLENGESVFGANCAACHAGGNNSVVPEKKIKKEALVTYGKYDVAAIIKQVTYGNGSMPAFGERLGPDDIEDVANYVFGQADKW

SEQ ID NO: 9053 - protein, 179 aa, Francisella tularensis subsp. novicida
ESVDLDKLGIYKIENTTVEVINSVIDYAELMQQIFDFDKIRELFAKGFKVRFDSMCAVSGPYAKYIFETLLQAPAGTVVNAQPLEDFGGFHPDPNPVNAEDLVKHMRSGKYDFGAASDGDADRNMIVGKQIDVSPSDSLAIMAANAHLIPAYSKGIKGVARSMPTSTAVDRVAESLRLP

SEQ ID NO: 9054 - protein, 86 aa, Isochrysis galbana
DAGAGEQVFSGNCAACHAGGMNVIMPEKTLQLEALEEYLDGGVSVQSVVYQVTNGKNAMPAFGGRLSDEDIDNVATYVINQAKGGW

SEQ ID NO: 9055 - protein, 1003 aa, Pseudomonas syringae pv. syringae B728a
MEFTQLIKDMLDAKPDAALEAALAECAREPIRVPGAIQPHGVLLSVAGDPLCIEQVSANCATEFGMAADELLGKPLSWLLSPEQSALIDHAYGHPAAPHIDPIKLTIGTAHYSASLQRADDVLIIELEPFVETGHGQSRIITRVLRNLQAATTLETLFDISVHEIQALTGYDRVMIYRFEPEGHGQVVAQALTGPLPSYSGLNFPGSDIPAQARELYRLNWIRVIPDATYVPVPLIPTLRPATGQPLDLGFSTLRSVSPVHCEYLKNMGVRSSMSISLLDGGELWGLVACGHPEPLRVSRELRDACAMIGQLLSVKISAIVATNIQREREEKVVLLGQLADAMSRANHEVLDGLVSRPELLMSLTLADGAAVLIDDQVYLFGTCPSIEQVRELYTWIRDTGLASQRSRQRATGLQGLGVFHTNSMQRELADSAVYRDIASGVIAFTLPKPIDNAVMWFRAQLTSTMNWSGNPTHHVSTRPESSASHRLHPRQSFDVWEQEVTGIASPWSRADLYGAEDIRRSALESDLERQVQREQEAVRLRDELVAVVSHDLRNPMSIIIMQCGMMQSWAVGDTHFENRNIRRALGTIEKATTRMNSLLEDLLDTAQIEAGRYQLSRLPLSVTSLLEEACSLLVMLTTEKNIELNCTAAQGLVIDADPERIFQVLSNLVGNAIKFTPKGGRINIDAVADQNEVLFRVSDDGIGIPAEHLPFIFQRYWSVKEGNPRGNGLGLYICQGIITAHGGRLWADSSLDSGSVFSFTLPVHQGTDSIGETTFLKQSGTTHRLAQSISSKLERQQLEDRLTRAGLLNELNHRVKNTLATVQAIASLTVNSSASLESFHKSFGARLFALSQAHDALARAEWISTELVDLIEQLQEQDSGAHRISFEGDPVTLEPRFSLTLSMVLHELMANALQHGALSSASGQVTVTSTLTAEHTPPTLKIEWKETGGPPVVATTVKGFGLRLIRRSIERELKGQADIQFARTGIIWSMLIPWPDKPESRL

SEQ ID NO: 9056 - protein, 178 aa, Agrobacterium tumefaciens str. C58
MRARRRCGIAYENVHLLNNLHFLWKYVEKLAIKLNISDFYENNLRGRVENQKLVRYETADNQAGGQRRPFAKAVRAGDFVYVSGQVPTVDGEVVTGGIVAQTEQVVANIRDVLALAGCTLADVVKVNVWLDDARDFSSFNAVFQKYFIDHPPARSTVQSPLMVDAKVEMDVIAYKPLA

SEQ ID NO: 9057 - protein, 179 aa, Francisella tularensis subsp. tularensis
ESVDLDKLGTYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIDVSPSDSLAIMAANAHLIPVYSKGIKGVARSMPTSTAVDRVAESLRLP

SEQ ID NO: 9058 - protein, 216 aa, Brassica napus
MGPKAGTFVLFLLGLTFLSDARSFLHQPTLSEEVSKNENVCTLCEEYVTSALAYLEKNETQTQILEDLHDQCSLIRGFEQQCVTLVDYYLPLFFLHLESFQPHYFCKRMNLCGHVVALVQEARQDTCDVCHRTVSEILIKLQDPDTQLDVIELLLKGCKSFKNYEYEKKCKKLVFEYGPLILVNAEEFLVKNDICTLLRACPNKQTVLRLPGLADS

SEQ ID NO: 9059 - protein, 185 aa, Zea mays
MSVDSLTSYISKQTVGSSYAADFDIPCMSVRANANIERVACGPPLDGTMDLVAGFCSIKGCRNQPWILALSVLIQGRHVRRALSWHETTRSKVVAHFGASWCVTSLSMNYKFEELAQTHPEVLFLYVDVDDVQSVSSRYGVKAMPTFFLIKSKEVVGKIVGANPDEVKKLVDASAEPLETQIVVE

SEQ ID NO: 9060 - protein, 682 aa, Gibberella zeae PH-1
MGYGELDQKAINTIRVLAADATAHSNSGHPGAPMGMAPVAHVLFNKFMNFNPKNPDWLNRDRFVLSNGHGCMLQYAILHLFGYDLSIDDLKAFRSVDSRTPGHPEAHDTPGVEVTTGPLGQGISNAVGLAMAQAHTAATFNKDGFELVNNYTYSFLGDGCLMEGVSSEACSLAGHLQLGNLIAIWDDNQITIDGDTAVAFTEDVPKRYEAYGWHVIKVDDGDHDLAAIEAAIKEAKSVTDKPTLIQLKTTIGFGSLNQGTHGVHGSPLKADDIKQLKEKWGFNPDESFAVPQEVYDFYGKRSSEGAAREQEWNQLLAKYKEQYPKEHADLVRRLTGELPEGWEKSLPVYTPSDPAIASRKLSETVLAKIEGVIPELFGGSADLTGSNLTRWKEAVDFQPKSTGLGDYSGRYVRYGVREHGMGAILNGLAAYGTILPYSGTFLNFVSYAAGSVRLSALSRVRTIWVATHDSIGLGEDGPTHQPIETLAHFRALPNTMVWRPADGNETSGAYYVCLTSKHTPSIIALSRQNLPQLEGSTIEKAAKGGYVLHEVEGADITLVSTGSEVSIAVDAAKYLEEKKNIKARIVSMPCFEAFDLQDKEYRLSVLPDGVPSLSIEVMSTMGWERYTHEQFGINRFGASGAYKDKFEFTPEGIAKRAVATIDFWKDVPNVRSPINRAFQQII

SEQ ID NO: 9061 - protein, 633 aa, Arabidopsis thaliana
MSASWADVADSENTGSGSSNQNSHPSRPAYVPPHLRNRPAASEPVAPLPANDRVGYGGPPSGSRWAPGGSGVGVGGGGGYRADAGRPGSGSGYGGRGGGGWNNRSGGWDRREREVNPFENDDSEPEPAFTEQDNTVINFDAYEDIPIETSGDNVPPPVNTFAEIDLGEALNLNIRRCKYVKPTPVQRHAIPILLEGRDLMACAQTGSGKTAAFCFPIISGIMKDQHVQRPRGSRTVYPLAVILSPTRELASQIHDEAKKFSYQTGVKVVVAYGGTPINQQLRELERGVDILVATPGRLNDLLERARVSMQMIRFLALDEADRMLDMGFEPQIRKIVEQMDMPPRGVRQTLLFSATFPREIQRLAADFLANYIFLAVGRVGSSTDLIVQRVEFVLDSDKRSHLMDLLHAQRENGIQGKQALTLVFVETKRGADSLENWLCINGFPATSIHGDRTQQEREVALKAFKSGRTPILVATDVAARGLDIPHVAHVVNFDLPNDIDDYVHRIGRTGRAGKSGLATAFFNDGNTSLARPLAELMQEANQEVPEWLTRYASRSSFGGGKNRRSGGRFGGRDFRREGSFGSGRGGYGGGGGGYGGGGGYGGGGGYGGGGGYGGGYGGASSGGYGGEPPSAWD

SEQ ID NO: 9062 - protein, 112 aa, Arabidopsis thaliana
  misc_feature (52)..(52): Xaa can be any naturally occurring amino acid
  misc_feature (76)..(76): Xaa can be any naturally occurring amino acid
RTRANRMRSSATMVEHPSQATRGTASNGRKASASLQTTRRATNDTTFITSNXHRDNWMQVCTAIEKNKFETLFYLXDTTDHKAAIKTDYHILNTSIASVEFKWEQTFVYLVH

SEQ ID NO: 9063 - protein, 161 aa, Paxillus involutus
VVLIGDSGVGKSNLLSRFTRNEFNLDSKSTIGVEFATRSISVDGKTVKAQIWDTAGQERYRAITSAYYRGAVGALLVYDISKHATYVNVTRWLKELRDHADSNIVIMLVGNKSDLKHLRAVPTEEAKNFSTENELSFIETSALDASNVESAFQTILTDVYR

SEQ ID NO: 9064 - protein, 130 aa, Haemophilus influenzae 86-028NP
MDRLIRRTFYREQTMAEETIFSKIIRKEIPANIVYQDELVTAFRDISPQAKTHILIIPNKVIPTVNDVTEQDEVALGRLFSVAAKLAKEEGIAEDGYRLIVNCNKYGGQEVFHLHMHLVGGEPLGKMLAK

SEQ ID NO: 9065 - protein, 307 aa, Rhodobacter sphaeroides 2.4.1
MIEAETTALTMLGASLDDSFGAAVETILRARGRVIVSGMGKSGHIGRKITATLASTGTPAQFVHPAEASHGDLGMVTRDDVALVLSNSGETPELADIIAHTRRFDIPLIGVASRAQSTLLRQSDVALLLPPAPEACGNGIVPTSSTTMTLALGDALAVALMEHRQFTPEHFRVFHPGGKLGARLARVADLMHRDLPLVAMGTSMGEALITMSRLGFGVLGVTGPEGRLAGIITDGDLRRHLDGLLSLSVEDVMTRHPLTIAPDALAEKAVAVMNGRKITSLFVVDPEGSGAAEGLIHIHDCLRAGVA

SEQ ID NO: 9066 - protein, 269 aa, Methanococcus maripaludis S2
MAPLTSYNPVFLALLATIFTWLVTALGASLVYLTKTVNRKLLDISLGFAAGIMIAASFWSLLAPAIELSSSMDNLSWFPASFGFLIGAFFLAGIDKIVPHLHMGQPLKEAEGPKTTWHKNRLLLMAVTIHNIPEGLAVGIAFGALALNMSVDSLMAAIVLALGIGIQNFPEGIAVSFPLRGEGLSKNKSFFYGQLSAIVEPIAGVLGAFLVTIFTPLLPYALSFAAGAMMFVVIEDIIPECQREGNIDSATIAAIFGFIVMMILDVALG

SEQ ID NO: 9067 - protein, 135 aa, Xanthomonas axonopodis pv. citri str. 306
MSKLNKTILADFEAAQIQRKLPEFNQGDTVVVNVKVKEGNRERVQAYEGVVIGTKNAGLNSSFTVRKISHGFGVERVFQTHSAIIDSVEVKRRGKVRAGKLYYLRGLEGKAARIKEDLAAAAQAKAARQAAAKAE

SEQ ID NO: 9068 - protein, 492 aa, Oryza sativa (japonica cultivar-group)
MQCRPNWEGGQYEGDDATRFEALRLAMELGVNYVDIELKVADKFISFIYGSKPEKCKLIVSAHNYESTPSCEELADLVARIQAVGADIVKIATTANDIVDVSQMFQVMVHCQGLNTNRIGAKLLISVPISGAELWDLAARSWATQHNSYVGRPRGAEPSNLSANVPMIGLVMGEKGLMSRVLSPKFGGYLTFGSLDATKVSAPGQPTVEELIDIYDIRRIGPDTKVLGVIANPVKQSKSPVLHNTCLQSVGYNAVYLPLLADNIARFLSTYSSPDFSGFSCSLPFKVDAVQCCHEHDPVAKSIGAISTIIRRPDGKLLGYNNDYIGAICAIEDGIGGPGSKNAAVTPLAGRLLVVVGAGGAGKAIAYGAKEKGARIVVANRTYEKAVSLAAAVGGHALRLAELETFRPEEGMILANATSLGMYPNVDGTPIPKQALSFYDVVFDAVYAPKVTRLLREAEECGVKVVSGVEMFLRQALGQFERFTNGIEGFDS

SEQ ID NO: 9069 - protein, 457 aa, Arabidopsis thaliana
MASLSQITLPRAPSSEIGLLRRRLERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSHVKEVRGEGLIIGVELDVPASSLVDACRDSGLLILTAGKGNVVRIVPPLVISEEEIERAVEIMSQNLTALD

SEQ ID NO: 9070 - protein, 304 aa, Synechococcus sp. CC9605
MHQFLPYAWFQGQCVPFEEARISIATHALHYGTGAFGGMRAIPDLQSSNTMLLFRADRHARRLSQSARLLLTDLSEETILSALTAMLQANKPDQPIYLRPFVYTSDLGIAPRLHNIETDFLIYGLPLGDYLSPEGVSCRISSWTRQEDRSLPLRGKISGAYITSSLAKTEAVQSGFDEALLLNSRGKISEASGMNLFLVRDGQLITPGVDQDILEGITRASVIELAKAMDIPVIERPVDKTELFIADEVFLSGTAAKVTPIRQIESTVLNAKRPVMDALKAKLVAITEGRDPAYEHWVTRISIA

SEQ ID NO: 9071 - protein, 373 aa, Pseudomonas syringae pv. syringae B728a
MDRFRESAAMNNNKLRIAAIAGDGIGLEVLPEGVRVVQAAAARHGLELEFEYFEWASCDYYLKHGKMMPDDWFEQLKGFDSIFFGAVGWPEKVPDHISLWGSLLKFRREFDQYANIRPVRLFPGVPCPLANRKPGDIDFVVVRENTEGEYSSLGGIMFENTENEFVLQESVFTRRGVDRILKFAFEMASKRERKHVTSATKSNGMAISMPYWDKRTEAMASQYPGISWDKQHIDILCARFVLQPERFDVVVASNLFGDILSDLGPACAGTIGIAPSANLNPERHFPSLFEPVHGSAPDIFGQNIANPIAMIWSGALMLEFLGQGDQRFTAAHDEIITAIEQVIANGDVTPDLGGTLSTQHVGAAIAERVSAGH

SEQ ID NO: 9072 - protein, 372 aa, delta proteobacterium MLMS-1
MKIDYYKTLGVGTDASMEEIKKAYRKLALQYHPDRNPGDQEAEEKFKTATEAYEVLGDLEKRKIYDRYGVDGLRDSGYQGPGGFDDIFSSFSDIFGDLFGFGGARGGSRRASGGPIPGNDLRYDLVISFMEAAHGVEKEVEISKGETCWTCEGSGARPGHPPESCSTCNGIGQVLHAQGPFRVQSACPHCRGQGRVVTEPCQDCQGQGLVKRSKKVSLKIPAGVDSGARMRLKGEGEGGRRGGPAGDLYVIIHVQPHDFFQREGYDIVCSLPLSFTQAALGCSLEVPTIYGSHKLKIPAGTQPGQHFTINEMGVAKLRGGGYGDMICEVRVVVPKRLTKKQKKLLKEFADSEEDPSDDAAKGDGFLKKFFHL

SEQ ID NO: 9073 - protein, 469 aa, Aspergillus oryzae
MALDAKSPTVATLNDGTTDYVPMRKKYTSNQPHITEQPITWGNWYKHVNWLNCFFILFIPFLGCLGAYWTPLHLYTGIFAVVYYFNAGLGITAGYHRCWAHRCYKATLPLRIYLAAAGAGAGQGSIRWWSRGHRSHHRYTDTEKDPYSVQKGFWYSHIGWMVLKQNPKRIGRTDVTDLDADPVVVWQHTNYIKSALFMCLVFPTLVCGLGWGDWLGGFVYAGILRVFFIQQATFCVNSLAHWIGEQPFDDRNSPRDHVITAFVTLGEGYHNFHHEFPSDYRNAIEWWQYDPTKWSIWIWKQLGLAYDLKQFRQNEIEKGRIQQLQKKLDQKRSTLDWGIPLDQLPVMDWDEFVAEAKNGRALVTIGGVIHDITSFIKEHPGGKAFISSAVGKDATAIFNGGVYNHSNAAHNLLSTMRVAVLRGGCEVEIWKRSLPEGKMPMLMDSTGRRIVRAGDQVTRMVQPVPMVSA

SEQ ID NO: 9074 - protein, 316 aa, Castanea sativa
MKLFSLLLFLAFLLGTSAEQCGRQAGGAACANNLCCSQFGWCGNTAEYCGAGCQSQCSSPTTTTSSPTASSGGGGDVGSLISASLFDQMLKYRNDPRCKSNGFYTYNAFIAAARSFNGFGTTGDVTTRKRELAAFLAQTSHETTGGWATAPDGPYAWGYCFVMENNKQTYCTSKSWPCVFGKQYYGRGPIQLTHNYNYGQAGKAIGADLINNPDLVATNPTISFKTAIWFWMTPQANKPSSHDVIIGNWRPSAADTSAGRVPSYGVITNIINGGLECGHGSDDRVANRIGFYKRYCDTLGVSYGNNLDCYNQKPFA

SEQ ID NO: 9075 - protein, 668 aa, Ustilago maydis 521
MHASQFMIHDYASEARLDGEIGSKEQQPTSMHGEVVLCLTHDSRLYLCTIHDSRFTIRLTHASTLSKVNAVSKPSLTQNHVAYGLRRTAEITKYESQSRIVNSRLVGEQTNVDDCGKREEVKTRRPNHRRENHEITNHESRITNHESRIVKSWMTRGPGSSARTDALKSRTRTHVEHLHEASSARMTRVLSATWFHLPKRLLPTIGRSIMTSCSAADRTRWATHRAQRIHQELDSGVDVWSLFNPVVFPTAINLGQGFMNWQPPSYILDTLTHEFANRVDLHHYSHPKGRARLRQAISDFYSSQFHLPRGAAEEVPIEVGKQRAAGHRKLDVETEIQITSGANGGIYSVMGAFINDGDGVVCIEPFFDQYNAEILFHGGKPLYVPLLPPAASGTSHIDANDWTLDMAHLERVLSQASTKALILNTPHNPVGKVFSHAELASIAELCVKYDILVVADEVYDCLTFDGQPHTRIASFSGMWDRSVTVGSAGKSFACTGWRVGWLIGPDHLIAPSRAVHTRITFAVNSSAQEGAAIGLESADSHHFFQSQINQYAHRRQLLSNALDQIGLSYTIPHGGYFIMADATKIQIPDTWIESNNVPDAILNKPQDYLKAWFIAKVCDVVVIPATAFYAEKGAEQVGKNYVRFSFCKDDQIEQAAPRLKKLIPYLTK

SEQ ID NO: 9076 - protein, 330 aa, Rubrobacter xylanophilus DSM 9941
MAETKTYREALREAMVHEMDRDESVVLLGEDIGVYGGTHLITDGLYDQYGPRRVIDTPISENGFTGAAIGMAMMGMRPIVEMMTWNFSFLAADQIIQNAAKVRYFSGGQVKVPLVIRGPNGGGVQLSAQHTHSLESFYGHFPGLKVVAPVTPNDAKGMMLTAIRDDNPVIFLEAGALYGTKGEVEDGDNAVPFGKARVAREGTDVTLIAYGRQVNLCLRAADTLAEEDGVSAEVIDLRSLRPFDEDAIVESVRKTHRAVAVQEQWRWFGVASEVAAIIQDKAFDYLDAPVERVSGAEVPAPYARNLELAAFPSEKAVANAARRVLYMEEK

SEQ ID NO: 9077 - protein, 353 aa, Rubrobacter xylanophilus DSM 9941
MSADRENSGNEAEVRGGESAVATSPDRLAELYGKMVLIRAFEDACQRAFRQGKIGGYLHVYTGQEAVATGFLEAFREGDRVITGYRDHAHALLLGCDPKEVMAELFGKRTGLVKGKGGSMHLFDVERGFMGGYGIVGGHIPLGVGIAYALRYGGSEGICQLYLGDGAINNGAFHEAANLAGLWGKDGMCPCFFIVENNQYGMGTSVERATAMTDLAAKFNSYAIGNEKVDGMDLEAVIECGERVAERVRETGRPYAVEAITYRIAPHGAADFFEKYRTKEEVEKWRARDPIGILEKKLLERDALDEERIEEIKDEARQRVSEAVKYADESEEPPIEELYTDVYAGEDEYMGTR

SEQ ID NO: 9078 - protein, 372 aa, Oryza sativa (japonica cultivar-group)
MATAQVLFHRFYCKKSFVRFSVKRVAASCVWLAGKLEESPRRSKHIIIVFHRMECRRENVPIEHLDVFSKKYSDLKHDLVRTERHLLKEMGFICHVEHPHKFISNYLATLEAPELTQEAWNLANDSLRTTLCVRFKSEVVACGVVYAAARRHGVPLPEDPPWWNVFDADEAGIQEVCRVLAHLYSLPKSQYIQVYKDNDSFTHRRTSDTNASKESPATTVASDKGTPVPSSSSQEKDALIKAGSDKVKEKGDDDGKTLPSEPNGKEGPAVNLKSEKSESNVDRSRERERDRSRGRDRDSRGRDSDRDSKGRDSDRERERDREADRDRQRRHHSKDRSSGYSDKEKSRHRSSRDRGDHYSSHSSRDKDRHRRQ

SEQ ID NO: 9079 - protein, 228 aa, Staphylococcus epidermidis RP62A
MPKLILCRHGQSEWNAKNLFTGWADVKLSKQGIEEAQSAGKKIYGNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 9080 - protein, 295 aa, Vibrio angustum S14
MSKINKVAVVGGTHGNEFSGIYLLKKWQSDPLQLARESFSVDTVFANPKAYGENKRYVDHDLNRQFGIDDLANNELTSYEQTRAKAINQQIGPKGNANSDFIIDLHNTTSNMGPSLILLQSDLFNRQLGAYVKSKMPKAVVVFEDHTSVDEHLFLCSIAKQGVIVEIGPQPQSVIRQDVLDWMEAMTKHILDFVHLNNTNEVPELPASYDAYCYEETLKLPEDEQGERIGMVHQSVQDNDFEPLRSGDPIFTLFDGTEIFWEGDYEAYPHFINEAAYYDNNLAMSLGKKIVVSTN

SEQ ID NO: 9081 - protein, 276 aa, Glycine max
MGLPASPGAATRKVVFSAEEAKLQAENGNKVELMRPETSPEDIEGMVASEALVTTHGDGSAGDLYLRAIETVNAEHSEEFDQFLTWSEEIARLQARMNAETPQDIKAGYNFGSKRIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLK

SEQ ID NO: 9082 - protein, 662 aa, Yarrowia lipolytica CLIB122
MGTQIFEKNSAAATCATRPSAPYGSSHPHPHHHHHQTPHAPPSPPRSPPHMKSDVMESEADDKEKSDFSSKAAKFGASLLGRKKLAVNTTAKEGKSAGSVSPPVATPVDKIAPRVSNSSVRSSGAGAASAVAHAASAAVRPVTGAVGSTAAAVRSPPTAATAAGTGAAPPAGVRSPSTTPAAPGPNSRTTPSPLPSPICGPTAAPSGRIPPADLRDVGSSVRSSSRASSSTTSLTLKETPNAGAAPTSGGVSAAAKKEPTKRFFAYDNGTHEHCLKAAKRHEKIGNMIKDLLGAKKLRDEAVSAVPQILAGANAPNGGNGDLPPSLMHGFLKQINDPNSPNPQVQHAHPAPEKDGKNPYVCNHPATTSGSFLEKYGRCQEVIGKGAFGVVRISHKAADRKSGTAEQLYAVKEFKRRPNETEKHYNKRLTSEFCISSSLHHPNIIHTLDLLQDAKGDYCEVMEFCSGGDLYTLILSAGKLEFTEADCFFKQIIRGVNYMHDMGVAHRDLKPENILLTLKGTVKITDFGNGECFRMAWEKEVHLSNGLCGSAPYIAPEEYHEKEFDPRPVDIWACGVIYMAMRTGRHLWRTANAEEDEFYTRYLQGRKDEDGYEPIEHLKRARCRNVIYSILDPVPSRRITGKQILNSEWGREIKVCEAGETGH

SEQ ID NO: 9083 - protein, 493 aa, Pseudomonas syringae pv. syringae B728a
MSLTRFQMCIDGQWVDALSGKTFDSLDPALAEPWAQLPDADEADVERAVQAAQKAFEGQAWRGLTATARGKLLRKLGDLIAENKEQLAQLESRDNGKLIRETRGQVGYLPEFFHYTAGLADKLEGGTLPLDKPDLFAYTVHEPMGVVAGIIPWNSPLYLTAIKLAPALAAGNTIVLKPSEHASATVLELARLALEAGIPPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPQDEGTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 9084 - protein, 676 aa, Candida glabrata CBS 138
MSHIEFLERAGCSQYADLFEEYSLTDINDLMHIDRDILLEIGVKKLGDRIRILKESKKLQEPKDDAKHVQQLQELISNISELSTTSTNINEEVITERHCVIFILNDGSAKKVNISGCFNADSIKKRLIKRLPSNLLAVNTDGQTTQESSDYDVFIVDYSKNVLRLLYDIELVTICHSNDRVEKNRLIFVSKDQTPTDRAINASKKLYLKTITALNHIESYYDAQSGMPNTPVTQDGTLRIHKEGKDKLRKIFDQRPPSEFISTNIAGYFPHADTKRLEKALRESYRQSARISMKSNNSRHISSESNRVGDILLKHSNAVDMALLQSLDNNNAPSSKPEVIPPSTPQEEDNEGKIKLMEETESIDDYYMNSDEEHGTVSLPTKIVTPKNWLKGARIGSGSFGTVYLGMNAQTGELMAVKQVEIKPAIAATADANVEDKNAEKNVAKAPSTNLHRKMIDALQHEMSLLKELQHENIVTYYGSSQEGGNLNIFLEYVPGGSVSSMLSNYGPFEEPLIVNFTRQILIGVAYLHRKNIIHRDIKGANILIDIKGCVKITDFGISKKLSPLNQENQDKRTSLQGSVYWMSPEVVKQTATTSKADIWSTGCVVIEMFTGKHPYPDFSQMQALFKIGTNVTPEIPSWASPQGRDFIRKTFELDYQRRPTAIELLQESWLESHII

SEQ ID NO: 9085 - protein, 379 aa, Pseudomonas syringae pv. syringae B728a
MKAIVYSGPRDVSVKNVPDAKIQKPTDALVRVTSTNICGSDLHMYEGRTSFETGRIFGHENLGQVIEVGAGVDRIKVGDWVCLPFNIGCGFCENCEKGLTGYCLTANPGSAGAAYGFADMGDHEGGQAELLRVPYADFNCLLLPEDAAEREEDYVMLSDIFPTGWHATELAGLLPGESVAIYGAGPVGLMAAHSAMIKGASQVFVVDNHPDRLALAAKMGATPINSLEQGAVDQILNLTDGKGTDRGCECVGYQCCDRHGHEANHVTMNNLVASTKATGGIGVVGVFVPQDPGAKSDLAKEGKMAFDFGSFWFKGQQIRTGQANVKAYNRRLAELIHHGRAKPSQIISHRLKLEEGPDAYKHFDARDEGWTKVVLKPGA

SEQ ID NO: 9086 - protein, 386 aa, Aspergillus niger
MATATVLEKANIGVFTNTKHDLWVADAKPTLEEVKNGQGLQPGEVTIEVRSTGICGSDVHFWHAGCIGPMIVTGDHILGHESAGQVVAVAPDVTSLKPGDRVAVEPNIICNACEPCLTGRYNGCENVQFLSTPPVDGLLRRYVNHPAIWCHKIGDMSYEDGALLEPLSVSLAGIERSGLRLGDPCLVTGAGPIGLITLLSARAAGASPIVITDIDEGRLEFAKSLVPDVRTYKVQIGLSAEQNAEGIINVFNDGQGSGPGALRPRIAMECTGVESSVASAIWSVKFGGKVFVIGVGKNEMTVPFMRLSTWEIDLQYQYRYCNTWPRAIRLVRNGVIDLKKLVTHRFLLEDAIKAFETAANPKTGAIKVQIMSSEDDVKAASAGQKI

SEQ ID NO: 9087 - protein, 364 aa, Coccidioides immitis RS
MVPGQAASDSEPESSPKGIPVVDFANWKRGSSREERMKVAQEIVSACRDVGFVYIVNHGMAPEKVAEAFAWSEKFFNLSSDEKQKAPHPSGASVHRGYSSPGLEKVSQAMSDKEDPELAKRLREITDYKESYDIGSDGNQDQPNVWIPEEMLPGFRSFMTQFYWDCFEVTKNVLGAISIGIGLEEEDYLLKFHSGHNNQLRLLHYPPLPAALLEEQKYARMPSHTDWSTITFLFQDECGGLEVEDIRNKGRYIAATPIKDAIVMNVGDLLQRWSNDYLRSTFHRVTLPPLSDRYEGFNRMVRGRYSIPYFTAPDPTSVIKCLPSCVSEDKPASYLPITQHDYNRLRATTHYETAATNTGSGAAY

SEQ ID NO: 9088 - protein, 83 aa, Oryza sativa (japonica cultivar-group)
MVQLTKMREEFWDTAPHYGGRKEIWDALRVAAESEVSLAQAIVESAAIIVSNTDLTLCYDERGAKYELPKYVLSEPTNLIQDS

SEQ ID NO: 9089 - protein, 1329 aa, Vibrio parahaemolyticus RIMD 2210633
MDNKTFKLSTIAKTVLPLISIAVISGCGSDSTSDDTTNPGSGLYPAGENEVVIYYKRDIASASTASDYEGWGLHLWNGEGCTSTDLEAMGIAGTGTDWSAPRPFDGINDTYGAYYVLKVNPDASDPHECMNFILHKGDEKAFGSSNSKVELTKIGESKGLFGFHGSSELYYEPIEERPVDIDGQKAHWLDANTIAWEAAANADSMKLFYSLTNDIKMDEDKQISGGTAVELTKAGDLSDGLKSRFRHLASLQAAGIDVDDATLRTILKSQIVMVAYNANGDVISATEVQKPGVLDAVFADSKAGNAISQELGAIVEGGAATFKLWAPTAQDVALIIYDENLKEETTVAMKEDSATGIWVSEAQSNVVNKYYRYQVKVYHPTTGVIETRLVTDPYSLSLSKNSMYSQVIDLDDPSLMPQGWSDYERPTVKKDEDHVLYESHLRDFSFNDTKGTKEYNGKYLALTEADRESVSHLQALKDAGLTTLHILPAFDIATVDEEAANRVDITDTVGKLCGIKPEASVCDEVDGAKVIEDVLNSYDPATGSAQALMNDLRMLDSFNWGYDPFHYTVPEGSYATDPNGSKRILEFREMVQATHKMKLKLIMDVVYNHTNASGINDKSVLDKIVPGYYHRLNVNTGGVENSTCCDNTATENLMMGKLMVDSLKVWADDYKVDGFRFDLMGHQPKDVMVYALEQIRKIDENTLFYGEGWDFGEVSNNARFDQATQLNMAGTEIGTFSDRLRDAVRGGSPFDGGVDSEGKHPLRFNQGFGNAAYANEETKVDAESVNGRLHNQDLVRLGMAGNLADFVLLDYKGDTKLGKNVDYNGAPAGYTKVPSENISYVSKHDNQTLWDNNAYKIATATPSADRARMQSVSLSTVMLGQGIPFIHMGSELLRSKSMQRDSYDSGDWFNRVFFDGSDNNWNVGLPREDKDGANWELIKKIVSDTTAKPDATDIELTKQQFLELLKIRSSSELFRLDTAQEVMNRVDFRNVGKDQVEGLIVMSIDDGKSAGADLDSKYDAIVAVVNSTSSEKSFVVKGATGFELHEVQQNSADDIVKGASFANETFTVPALTTAVFVQPQDGAQGAGLPVNTDNKDVSSIPPFGETVVYVKGTMNNWSDNSDWAMTFIGNGMYSVTGVLEAGSHEFKFADTGWANPNIGCSVATVGSGSLELGAEENCKLTVAETGKYNFTLNALYVQDEKVEKPVVSVTKSADAPTFGETALYLRGTITSWDTPAQDSAAKFSYVANDVYSLDIDLAAGSYEMKIASADWAADTNFGGEGSVELGKALTMEVGGGSANLKIAIAEAGNYNFHFNAADKSAPIVTVTKN

SEQ ID NO: 9090 - protein, 421 aa, Schizosaccharomyces pombe 972h-
MAFRGIRPSNKVAASRPDVWTLVNQATAECKVPPVSLSQGFFNYNPPKFVLDAAKKSIDEVACNQYSHTRGRPSLRKALSEAYSPYFKRTLNPDTEIVVTAGANEGFFSVFAAFLNPGDEVIVMEPFFDQYISNITMNGGVPVYVPIIPPEEGSVKPVSAGAWKLDMNKLRNAITEKTKMIVINTPHNPLGKIFSEEELNEIADLVLKHNLLVVSDEVYDRLSFVPFVRLATLRPELFKHVVTVGSGGKTFGCTGWRVGWLIGDESLIKYSAAAHTRICFAVNSPCQEALAIAFGEAEKHNYYEEYKSSYKKRFEILAKAFDQLEIPYTIPDGSYYTMANFSKLKLPKDYPFPEEIANRPRDFKLCYWILKEIGVATIPPTEFYTDEDAPVAENYLRFAFCKTFETLEEAARRLQKLKDYF

SEQ ID NO: 9091 - protein, 286 aa, Pseudomonas syringae pv. syringae B728a
MNEEYPKPPFASQPQEVPGMQGKMDPYPDCGEKSYKGSGRLQGKIALITGADSGIGRAVAIAFAREGAQVAISYLNEHEDAQETKRWVEEAGRKCLLLPGDLAQKQQCEDIVSKTVAEFGRIDVLVNNAAFQMTHETLDEISDEEWVKTFDINITAMFRICKAAVPHMPRGGSIINTSSVNSDMPKPTLLAYATTKGAIANFTGGLAQLLGEKGIRVNSVAPGPIWTPLIPATMTDEDVKSFGSETPLGRPGQPVEVSPIYVLLASDEASYISGSRYAVTGGKPIL

SEQ ID NO: 9092 - protein, 476 aa, Pseudomonas syringae pv. syringae B728a
MYPDVQLYIDGQWRASRDNRTLSVINPATGEALGAVAHAGIADLDEALAAAERGFATWRATSAYDRYKLMQKAANLVRERADSIARIMTQEQGKPLAEARMETLSAADIIDWLAEEGRRSYGRLVPSRNVSIEQKVIKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTEKFVGLTREIKVGNGLEAGTTMGPVANDRRIPALVDLIDDAVRGGATLSAGGKAGEGPGYFFEPTVLSGLKPHMRIMNEEPFGPVALLVPFDTLEEAIAESNRVPFGLASYAFTTSMKTAQALSTYIEAGMLSINHQGIGLPEVPFGGIKDSGYGSEGGTEAIEAYLNTKLVTQYN

SEQ ID NO: 9093 - protein, 117 aa, Medicago truncatula
MQATGTDIIKLVAHAADITEITRIFSLFPYCQVPLIAYSIGESGLISQFLCPKFGGFFVCGSLARNPIPGLPSLHSLQEAYKLEHVNANTEVFGLISSQNQLATAKALHCIILPSDM

SEQ ID NO: 9094 - protein, 575 aa, Lactococcus lactis subsp. lactis
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTDQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 9095 - protein, 502 aa, Zea mays
VIPKLNGPKGNPTTTGLESRQIGVDDPTTRWPSHAFPGMAEPTPPSLPSSDCADVLVGSSAPSFPYIRGWSFPSDSGAAMGSVEEHLQPKVCVQTSTSAGLEQILPWLFYHKVVGVAQFLLFVEGKAAKPNVAGVLESIPGVKVVYRTKDLEERQARSRIWNETWLSGFFYKPCNYELFVKQSLNMEMAIVMARDGGMDWIIHLDTDELLYPGGAAEYSVRRLLAEVPRDVDMVIFPNYESSVEHDNIKDPFSEVSMFKRNYDHLPKDTYFGMYKEATRGNPNYFLTYGNGKSAARIQDHLRPNGAHRWHNYAKSPNEIKLEEAAVLHYTYTKFSDLTSRRDRCGCKPTKEDVKRCFMLDFDRAAFIIASTASEEEMLRWYNERVVWTDKQLNLKLLRKGVLTRIYTPMTIVQSLRESGVFTSAIAAGQPAVNAKLSPKETNAQSQNVTASGNMTRVVRSTDSKASGRKILQAVDLAFSDTNVTAVPPLSPPSLDEHRHHSE

SEQ ID NO: 9096 - protein, 321 aa, Haemophilus influenzae 86-028NP
MIKKIAVLTSGGDAPGMNAAIRGVVRSALAEGLEVFGIYDGYQGLYNNKIKQLNRYSVSDVINRGGTFLGSARFPEFKDPNVRAKCAEILRSHGIDALVVIGGDGSYMGAKLLTEEHGFPCVGLPGTIDNDVAGTDYTIGYQTALQTAVDAIDRLRDTSSSHQRISIVEIMGRHCSDLTISAGIAGGCEYIVASEIEFNREELIQQIERSIIRGKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 9097 - protein, 239 aa, Methanococcus maripaludis S2
MARTKKANDEVATDSDSLKLKVAKQAAKLVKDEMVVGLGSGSTANLFIQELGKRVVEEELYIYGVPTSFDSRMMASNSGIPLISLDQCGEIDIAIDGADEVCKKTLSLIKGGGGCHTMEKIVDYHAKEFVVLADEGKLVESLGDKTAVPLEVIPFAYSTVLNKLLDMNTAPAIRSGSGKMGPVITDNGNMIIDVFINIEDAEETETMLNNIPGVLENGIFSKCDKVLVGTSKKVEILKK

SEQ ID NO: 9098 - protein, 256 aa, Arabidopsis thaliana
  misc_feature (77)..(77): Xaa can be any naturally occurring amino acid
  misc_feature (196)..(196): Xaa can be any naturally occurring amino acid
MARKFFVGGNWKCNGTAEEVKKIVNTLNEAQVPSQDVVEVVVSPPYVFLPLVKSTLRSDFFVAAQNCWVKKGGAFTXGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAXKNVSADVAATTRIIYGGSVNGGNCKELGGQADVDGFLVGGASLKPEFIDIIKAAEVKKSA

SEQ ID NO: 9099 - protein, 259 aa, Rubrobacter xylanophilus DSM 9941
MGVLELFNLRGKTAIVTGGGRGLGLYMAEALAEAGASLTICSRRREQLEEARGRLESAGKGGVLALGCDVTDPEQVEEVVEKTVEGFGSVDIVVNNSGATWGAPPLEMPLEKFDHVLRVNVRGTFLMSRSAARRMIERGSGGVIVNVSSVAGLVGGDPRYMQTVGYNASKGAIISMTRDLATSWAPHGIRVNAVAPGWFPTRMSRGLIERHERQMLADIPMKRFGGPEDIKGAVLFLASPASSYMTGQTLVVDGGLTAW

SEQ ID NO: 9100 - protein, 382 aa, Rhodobacter sphaeroides 2.4.1
MAKRDYYEVLGVSRTASADELKKAYRTKAKELHPDRNADNPQAEAQFKEVNEAYDVLRDADKKAAYDRYGHAAFEGGMGGGARAGGGYGQQGDFASAFSDVFEDLFGDFMGGRGGAPRSRAQRGSDLRYNLRVTLDEAYRGVQKTINVPASVACDACKGTGAEGGAEAVTCPTCSGMGKVRAQQGFFTVERTCPTCNGMGQIVKNPCKVCHGAGRVEKERSLSVNIPAGVETGTRIRLAGEGEAGMRGGPSGDLYIFIEVREHALFQRDGVHLFCRVPVSIAAAALGGEVEVPTIDGGSSRVKIPAGSQTGKQMRLRGKGMPALRGGGAGDMLIELAVETPVNLTARQKELLREFEKLSEDNNPEGKSFFSKVKGFWDGMTG

SEQ ID NO: 9101 - protein, 148 aa, Paxillus involutus
GRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVVEGFDVVKEIEARGTASGKPNANIKIAKSGT

SEQ ID NO: 9102 - protein, 67 aa, Glycine max
  misc_feature (11)..(11): Xaa can be any naturally occurring amino acid
FVDKSVYFDLXDLGHSTWQWDLYCSNAPSPYNPFQSKFLKTFAAPFTKRGLLLKCLILGGGFTHSYF

SEQ ID NO: 9103 - protein, 838 aa, Agrobacterium tumefaciens str. C58
MPRGCAEVPLRTSPLRRSRGVITMTQKLVIIGNGMAPGRMLENLFETAPGLYDVTIFNAEPRVNYDRIMLSPVLSGEKSYEDIVIHNDEWYAANNVTLHKGAKVTRIDRANKIVTSENGITASYDRLVIATGSLPFIIPVPGHQLPGVLAYRDLDDVTKMLEIAKGKGRAIVIGAGLLGLEAAYGLKRQGMDVTVIHLMPTIMERQLDPAAAYLLEKALNERGIDIITKANTKCILGEEKVEGIELEDGRIIKGDMVVMAVGIRPASGLAKEAGIAVNRGIVVDDGMMTSDASIYALGECAEHRGMCYGLVAPLYESARVLADRLCGGSAEYHGSVTNTKLKVTGINLFSAGDFAEGDDREEIVLRDATAGVYKRLILKENRIIGAVLYGETADGSWFFDLMKKSTDISAMRETLIFGQAYQGGSPLDPMAAVAALPDDAEICGCNGVCKGKITSAITSKGLTSLDDVRAHTKASASCGNCTGLVEQLMTLTLGDTYNPAAVQPMCKCTDLGHDDVRRLIKAKGLKTIPAVMQELEWKTSCGCAKCRPALNYYLVCDFPDEYADDYQSRYINERVHANIQKDGTYSVVPRMWGGVTNADELRAIADVVDKFEIPLVKVTGGQRIDLLGIEKEDLPAVWADLGKAGFISGQAYAKGLRTVKTCVGEQWCRFGTQDSTGLGIRIEKFMWGSWTPAKLKLAVSGCPRNCAEATCKDIGVICVDSGFEIHFAGAAGLDIKGTEVLGLVHTEDEALEHIVALTQMYREQARYLERIYKWAKRIGYDEVRRQIMDDADKRKAYFDRFVFSQKFAQVDPWSERVSGHDKHEFRPMAAIGFSEAAE

SEQ ID NO: 9104 - protein, 903 aa, Agrobacterium tumefaciens str. C58
MWGRCPAGQRGVSVIRREGNSMPAETKTTCPYCGVGCGVIATVNDSGVVSVKGDPDHPANFGRLCSKGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLPEIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTMTRTGKSARLTAHIAEPFAEIHPRDAQALGIKSADLVELESPHGKVLLRALVSERQARGSVFAPMHWNDQFASRARIDVVVAPVTDPHSGQPASKNVGVRVTRFEASAYGFAICRSRPDAPDCAYWAVAKAEGGYRMELAFAEAPEDWTLWARRVFGIDVRIEPLGYSDRQTGDLRLAFFDGDTLLAALFIAREPVAVARNWAISQLSERHEDLRMRFALVAGRPGAGRADPGATVCSCFNVGVNQITAAIREGCHSVEAIGNALNAGTNCGSCRAEIRGIIDGCLKTAAE

SEQ ID NO: 9105 - protein, 359 aa, Streptococcus pyogenes MGAS8232
MKPSIYSLTRDELIAWAVERGQKQFRATQIWDWLYKKRVQSFEEMTNISKDFVPILNDSFCVNPLKQRVVQESADGTVKYLFELPDGMLIETVLMRQHYGHSVCVTTQVGCNIGCTFCASGLIKKQRDLNSGEITAQIMLVQKYFDDRKQGERVSHVVVMGIGEPFDNYKNVMCFLRVINDDNGLAIGARHITVSTSGLAHKIRDFANEGVQVNLAVSLHAPNNDLRSSIMRVNRSFPLEKLFSAIEYYIEKTNRRVTFEYIMLNEVNDSIKQAQELADLTKTIRKLSYVNLIPYNPVSEHDQYSRSPKERVLAFYDVLKKNGVNCVVRQEHGTDIDAACGQLRSKTMKKDREKVTATK

SEQ ID NO: 9106 - protein, 531 aa, Triticum aestivum
MEDAVLLTVATTVSILCCTLLLRAARSHHSKSKLVTTVPPPSPWRLPLVGNLHQLAGGRLPHRTLSALAAAHGPVMLLRLGQVPAVVVSSPDAAREVMLEQDHVFATRPSLAIPSKLFYGCTDVAFAPDGPYWLHARKTCVLHLLSPARVRAYRAVREEEVGALLDKVRRQARVVNLSELLAGFAKDVIGRIVFGASAATRADRWGAKVDALLEEGNALLGTFHVGDYFPRLAWVGALDGTDAKVGKAFDRIDAVLEEIVDAAERRMGRVHGGDALGLHDSTFVDVLLSLGNNTSGNGTGGASPERRFTRDNVKGLLANLFGAGADSTIIVLEWAMAELLRNKEAMEKLQDELRSRSVSTNSDMITEEDLQGMVYLKAVIKETMRLHPPGPLLIPREAMESARIQQYDVPSKTMVIVNAWAIGRDPGSWESPEEFRPERFLGTGGEVDFRGRHFQLVPFGSGRRVCPGINFTMSIMEVAIANLVGRFDWALPEGAAAAVDMEEAPGITSRKRVPLHVLATPRAQASCNHDV

SEQ ID NO: 9107 - protein, 368 aa, Bordetella pertussis Tohama I
MKTKAAIAWKAGAPLTVEDVDLEGPKAGEVLVEIKATGICHTDYYTLSGADPEGIFPAILGHEGAGVVMDVGPGVTTLKKGDHVIPLYTPECRQCKFCLSRKTNLCQAIRTTQGKGLMPDGTSRFSIDGKPLFHYMGTSTFANHIVVPEIALAKVRPDAPFDKICYIGCGVTTGIGAVVFTAKVEAGANVVVFGLGGIGLNVIQGAKMVGADKIIGVDLNPAREAMARKFGMTHFVNPSEVENVVDHIIQMTDGGADYSFECIGNTKVMRQALECCHKGWGQSVIIGVAEAGAEISTRPFQLVTGREWKGSAFGGARGRTDVPKIVDWYMEGKINIDDLITHTLPLDRINEGFDLMKRGESIRSVVVY

SEQ ID NO: 9108 - protein, 358 aa, Aspergillus niger
MSTQNTNAQNLSFVLEGIHRVKFEDRPIPEINNPHDVLVNVRFTGICGSDVHYWEHGSIGQFIVKDPMVLGHESSGVVSKVGSAVTSLKVGDCVAMEPGIPCRRCEPCKAGKYNLCVKMAFAATPPYDGTLAKYYVLPEDFCYKLPESITLQEGAIMEPLSVAVHIVKQAGINPGQSVVVFGAGPVGLLCCAVAKAYGASKVIAVDIQKGRLDFAKKYAATATFEPAKAAALENAQRIITENDLGSGADVAIDASGAEPSVHTGIHVLRAGGTYVQGGMGRSEITFPIMAACTKELNVKGSFRYGSGDYKLAVSLVSAGKVNVKELITGVVKFEDAERAFEEVRAGKGIKTLIAGVDS

SEQ ID NO: 9109 - protein, 782 aa, Aspergillus oryzae
MRISFFFLFSILPLHVWPQTSLRGSGAGDALSQVKGQIYQAFDLADHPFTYIPSSTAPDRPDPPIPIEPTSSYPRSAAASDNILSSSRSDPSVDSSYPAVGASGNFYLSSTRRRRRPSTPGVSESNIDGTGGLTGDHTASEAGISEQRVVYANTAEGHSPSPKRRRLTNMRPDGVSSANGPSHVSNGSVASPSHKVGLSHSLNGQASHASSNGDLQTNGVQKSSAVPPSYFGHDREEVTRILIQSLYELGYNGAASLLSKESGYQLESPAVAAFRGAVLAGRWAEAERILVQSFYPDGTRRTTSGDGDLPTKERLVLVESADMNEMLFYLRQQKFLELLEARNLSAALTVLRHELTPLNYDIGRLHALSSLLMCPPEHLHDQAGWDGSITSSRERLLSELSKSISPSVMIPDNRLAILLDHVKQNQINQCLYHNTATPPSLYSDHMCDRADFPSRPGIELSQHSDEVWYCQFSHDGTKLVTAGRDHSVIIYDTSTFAVLHKLMEHDDGVAHACWSPDDSKLITCSQDKKARVWSVDTGRCLLTINHHRQPVTAAAWAADGDSFVTASLDKDSHLCHWSMRGHALHMWQGDFRVQDCAITPDGRRLIAADVEEKIHVYDFLTHEEEYCLALKSKPTSVAVSKDSRHMLVNLSEGQIQLIDIDTTDVIRRFQGQKQGSFVIRSAFGGAAENFVVSGSEDSRVYVWHKENGTLVETLEGHIAGCVNAISWNPTNPGLFASAGDDCLVRIWTRERDANSHTTARTQRPTSASGFARTSALRSTMSF

SEQ ID NO: 9110 - protein, 211 aa, Hyacinthus orientalis
RIAICNAVAVAKIMNATLILPVLKQDQIWKDKTNLEDIFDVDHFIEYLKDDVRIVRDIPDWFTDKAELFTSIRRTVKNIPKYAPAQFYIDNVLPRIKEKKIMALKPFVDRLGYDNVPPEINRLRCRVNYHALKFLPEIDEMANLLASRMRNRTGNPNPYMALHLRFEKGMVGLSFCDFVGTREEKAMMAAYRQKEWPRRYKNGSHLWQLAL

SEQ ID NO: 9111 - protein, 1108 aa, Pyrococcus horikoshii OT3
MEREEIIERFLKFFREYAEEGEEPLYMGKIKDLLTITPKRSIVINWMHLNSYDPELAEEVIENPEECILAAEDAIQIILKEDFLREDVPKIHARFHNLPKTLMVKEVGAEHINKLIQVEGVVTRVTEIKPFVSVAVFVCKDCGHEMVVPQKPYEGFVAVKKCEQCGSKNVQLDVEKSKFVNFQMFRIQDRPESLRGGQMPRFIDGILLDDIVDTAMPGDRVIVVGILRVIQEKREKVPTFKKVIEVNHIEPISKELEELEISPEDEQKIRELAKRKDIVSAIVDSIAPAIYGYKEVKKGIALALFGGVSRTLPDGTRLRGDIHVLLVGDPGVAKCVDYDTEVLLGDGRKRKIGEIVEEAIKKAEKEGKLGRVDDGFYAPINLELYALDVRTLKVRKVKADIAWKRTTPEKMLRIRTKRGREIRVTPTHPFFTLEEGRIKTKKAYELKVGEKIATPREEAPEAEIFWDEVVEIEEYKPNNSWVYDLQVPEHHNFIANGIFVHNSQLLRYVANLAPRAIYTSGKSSSAAGLCVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHNTAAVVRDEFTGGWVLEAGALVLADGGYALIDELDKMSDRDRSVIHEALEQQTISLSKAGITATLNARTTVIAAANPKHGRFNRMKRVSEQIDLPPTLLSRFDLIFVLMDEPDEKVDSEIARHILKVRRGESEVVTPKIPHELLRKYIAYARKNIHPVISEEAMEEIEKYYVKMRRSAKKSSGDEIKPIPITARQLEALIRLSEAHARMRLSPIVTREDAREAIKLMEYTLKQIAVDEAGQLDVTILEVGQSARKLSKVERILDIVEKLERTSEKGAKIDDILEEAAKFGIEKSEAREILEKLLEKGQIYMPENGYYKTV

SEQ ID NO: 9112 - protein, 271 aa, Pseudomonas syringae pv. syringae B728a
MSVTANRETLLCMSMAARPGNFGVRFHNHLYQQLGLNFYYKTFAPNDLAAAVAGIRSLGIRGSAVSMPFKEACIELVDELDASAAAIQSINTIVNTDGHLKAFNTDYIAVAQLMESHAVPRSAFALRGSGGMAKAVAFALRDAGFTEGLIVARNEQAGRRLAEACGFRWQAELGSARPPLLVNVTPLGMQGAQADELSFDLQAIDAAETVFDVVATPADTPLIQAARRLGKRVVSGDEVAAIQALEQFVLYTGVRPTDEQYQQAAAFARAG

SEQ ID NO: 9113 - protein, 633 aa, Arabidopsis thaliana
MVKIEVGSVGDSFSVSSLKAYLSEFIATLLFVFAGVGSAVAFAKLTSDGALDPAGLVAIAIAHAFALFVGVSIAANISGGHLNPAVTLGLAIGGNITLITGFFYWIAQCLGSIVACLLLVFVTNGKSVPTHGVSAGLGAVEGVVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYEAVETLKSSSDFAMVSVEKLRRRTRKSSKISAEKTPDRTQSSPIPPVPPISSPIQQNFATRSSVYPFPQFDFADAHYSPYALSNGDNPGTTIVSEVLDGSNFSSWKIAMFVALDAKNKIAFVDGTLPRPPEFDPSFRVWSRCNSMVKSWILNSVTKQIYKSILRFNDAAEIWKDLDTRFHITNLPRSYQLTQQIWSLQQGNMSLSDYYTTLKTLWDDLDGASCVNTCRNCKCCSATASVNEHSKIVKFLAGLNDFYSTIRSQIIMKKTIPDLAEIYNLLDQDHSQRNIVTNPTNASAFNVSILSNDQIAVNATRSFQPNSKPKVQCSHCGYTGHTADTCYKIHGYPIGIGPDGIAELVGNMSKSQIQDVIAYFSTIRHSLIGKMSLLSIYGSS

SEQ ID NO: 9114 - protein, 310 aa, Oryza sativa (japonica cultivar-group)
MAVLWTVSLLYSYILLFFLRRGAPVPRLRPMPEPDDDAARRRRRRPVCVITGATSGLGKAAAAALAREGYHVILAGRSSQLLSETVQQIRDQQPDAHLEAFQIDLSSYKSIKKFETSLNQWIKDSNMEHSIQLLVNNAGILAKSYRITEDGLDEMIQANYIGPFVLTNILLPLLKNSSTPSRVVNLTSFTHRCVSEINLSEKGLSGVRAADPGVVQTGIMRELPPCLSWLALSVLRLLNLLQQPDTGVDAVLDAALAPPDSSGKYFFGGKGRTITSSQLSYNVEVAKKLWAESLALFNELQNRVCELRTS

SEQ ID NO: 9115 - protein, 522 aa, Oryza sativa
  misc_feature (9)..(9): Xaa can be any naturally occurring amino acid
MASQPPALXSLVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKGVPASVQIFSCDKDAQGQAVARRSFFRCSTVQFHWNKGSTGLLVVAQADVDKTNQSYYGETKLNYLTTDRAFEGIVPLKKDGPVHDVQWSYSGSEFAVVYGFMPARATIFNKKCNPLLELGEGPYNTIRWNPKGRFIVLAGFGNLPGDMAFWDYSEKKLVGKTKAECSVTSEWSPDGRHFMTATTAPRLQIDNGIKIFDHNGSLQFKKMFEKLYQADWKPEAPEKFSDIADLTISLGSIKIEETKKQVSAQGSKSAQPSSKAPANIAAKPTAYRPPHSKNSADVQDKLFGGLASTGGEMSKNALRNKKRREKQKEKKAAEGSGASADDN

SEQ ID NO: 9116 - protein, 431 aa, Escherichia coli
MVSLEKNDHLMLARQLPLKSVALILAGGRGTRLKDLTNERAKPAVHFGGKFRIIDFALSNCINSGIRRMGAITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKVTEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 9117 - protein, 291 aa, Neisseria meningitidis MC58
MLQGSLVALITPMNQDGSIHYEQLRDLIDWHIENGTDGIVAVGTTGESATLSVEEHTAVIEAVVKHVAKRVPVIAGTGANNTVEAIALSQAAEKAGADYTLSVVPYYNKPSQEGIYQHFKTIAEATSIPMIIYNVPGRTVVSMTNDTILRLAEIPNIVGVKEASGNIGSNIELINRAPEGFVVLSGDDHTALPFMLCGGHGVITVAANAAPKLFADMCRAALQGDIALARELNDRLIPIYDTMFCEPSPAAPKWAVSALGRCEPHVRLPLVPLTENGQAKVRAALKASGQL

SEQ ID NO: 9118 - protein, 358 aa, Haemophilus influenzae 86-028NP
MQSYNVAVLAGDGIGPEVMAEAMKVLNKVQEKFGFKLNFNEFFVGGAAIDHCGYPLPAETLKGCDEADAILFGSVGGPKWTNLPPDQQPERGALLPLRKHFKLFCNLRPATLYKGLEKFCPLRADIAAKGFDMVVVRELTGGIYFGQPKGREGEGSQTKAFDTEVYYKYEIERIARAAFEAAMKRNKKVTSVDKANVLQSSILWRETVTEMAKDYPEVTLEHIYIDNATMQLIKAPESFDVLLCSNIFGDIISDEAAMITGSMGMLPSASLNEAGFGLYEPAGGSAPDIAGKGIANPIAQILSAAMMLRYSFNLNEAADAIESAVQKVLASGHRTADLADDSTPVSTAEMGTLITQAI

SEQ ID NO: 9119 - protein, 148 aa, Paxillus involutus
  misc_feature (118)..(118): Xaa can be any naturally occurring amino acid
GRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVXEGFDVVKEIEARGTASGKPNANIKIAKSGT

SEQ ID NO: 9120 - protein, 553 aa, Rubrobacter xylanophilus DSM 9941
MTDAHLGFWPRRMPTSLPLPAAGVHHNLEVSARRYPECPALVYYGEEITYRRLLEESRRLAGYLQREAGLSKGDRVLLYMQNSPQFVVAYYAALMSGGVVVPANPMLLTEELEHYVEDSGARLALVGQELLPRVLPLAGREGLGCVIVAAYSDYLPPEPEVSVPAEVAAPRETLREERVILWEETLRAGLSPESGGPGPEDVALLPYTSGTTGRPKGCVHTHRTVQATLVGAGLWVNLNPASVALATLPLFHVTGMQHSMNAPIYYGGTVVLMTRWDREAAARLIERRRCTHWTNISTMVVDFLSPGGVEGADLSSLMCVGGGGAPLPEAVGERLHRLTGLRYMEGYGLSETVSQTHMNPPDRPKMQCLGIPSFDVDARVVDPDTLEELGPGEQGEIVVSGPQVMRGYWQRPDADAEVFFERDGRRFLRTGDLGRYDEEGYFFMVDRIKRMINAGGYKVWPAEVESVLYAHPAVREVCVIRSPDPRRGETVKAVVVPAGEVSGEEVISWARERLAAYKCPRLVEFVGELPKSGSGKILWRALGEREERRAVRG

SEQ ID NO: 9121 - protein, 364 aa, marine gamma proteobacterium HTCC2143
MIRGIHSSDKRWWLLAGKGIFQRQDAISYATDTTPIGCHMPLDLGAQMQQLYRDFGELPGITIELHQQLLAVRVDNQKASATVFLQGAQVTHYQPNEAKDIIWCSDQCDYAPGSALRGGIPICWPWFGDLNKNPTEVQQQIADNNDTRTLPSHGFVRNKLWELSAINIIDGDTTQLIFQLMLDDTTDSLWPYAGELTYTVTIGSTLSLQLCINNKSDETVSFCNALHSYFSVDAIERTMISGLETCRYTDTLEEWTEKDPQEQLLIDGEVDRFYWDTPDQIHIIEQNQREISIESQGSNSTVVWNPWIEKSVRLSQFPSDGYKNMVCVETANVGRDFVQLAPNQTHTLAVTISSKDRRLRQNSQ

SEQ ID NO: 9122 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 9123 - protein, 389 aa, Arabidopsis thaliana
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 9124 - protein, 436 aa, Methanococcus maripaludis S2
MEFLGNEMITVDGGNLKIDGHDASKLASTYGTPLYVMSETQTVKNFTRYVESFKEYSEKTGKEFIISFAYKANTNLAVTRLLSKLGCGADIVSAGELYIAKLSDVPSEKIVFNGNCKLKEEIKMGIEAEIRAFNVDSISELVLINETAKEMGKIANVAFRVNPNVDAKTHPKISTGMKKNKFGLDIESGIALETIKMAEKMENVKIVGIHCHIGSQLTYISPFVEEARKIMDFVVLLKNEGIKIRDVNLGGGLGIPYDKNTKIPVQKDLSKAVLDVIYEYEGKIELPNLILEPGRSLVATAGVLLGTVEHVKETPVAKWVMIDAGMNDMMRPAIYESYHEITPCTIRAEKEVVSVAGGLCESSDVFGKDREISKMEVKDTVAILDVGAYGISMANNYNSRGKPAMILTNEKEVSLIRARETLADLISKDIVPNHLL

SEQ ID NO: 9125 - protein, 148 aa, Paxillus involutus
  misc_feature (1)..(1): Xaa can be any naturally occurring amino acid
XRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVVEGFDVVKEIEARGTASGKPNANIKIAKSGT

SEQ ID NO: 9126 - protein, 472 aa, Novosphingobium aromaticivorans DSM 12444
MADATRFYIGGEWVAPSTSVTTDIVNPANRSVVGQVALGGPADAEAAIAAARAAFPAWSATTREHRLAVLERINAALIARADEIGDAIMAEMGAPLGLARGAQAGSGPQHFEETIRVLKDYAFETPLGTTLLQREAIGVCVLITPWNWPMNQIATKVAPALAAGCTMILKPSEVAPLDAAILAEIIDEAGLPDGVFNLVHGTGPGIGDALTGHPDVDMVSFTGSTRAGIAIAANAAPTIKRVALELGGKSANILLPDADLAKAVPASVRGCMLNTGQSCNAPTRLLVPRTTLSRVEHLAREAAEAIVVGMPTDNPHMGPVANEAQYRRVIALIEQACHEGTQLLCGGVEPPKSLEHGLFVAPTIFTDVAPDATIAREEVFGPVLAIIPYETVDEAIEIANDSPYGLSGYVWGDPDAARNVARRMRTGMVHVNGASLDSAAPFGGYRMSGNGREWGVWGLEEFLEVKSIYGGA

SEQ ID NO: 9127 - protein, 458 aa, Staphylococcus epidermidis RP62A
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFVFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 9128 - protein, 142 aa, Paxillus involutus
YIMLKPDGVDRGLIGEILARFEKRGFKLIAAKLALPSKEHLEKHYADLKDKPFFPGMIKYMQSGPVFCMVFEGLDAVKTGRAMLGATNPLASQPGTIRGDYALAVGRNICHGSDSVENAEKEIALWFPDGTLQYRLSQEAMI

SEQ ID NO: 9129 - protein, 445 aa, Staphylococcus aureus subsp. aureus COL
MSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 9130 - protein, 433 aa, Novosphingobium aromaticivorans DSM 12444
MTTNAELWTRREAAVPRGVSSMHQRFFARGENAEAFDAEGNRYIDFATGIAVCNTGHGHPRVLAAVQRQLDAFSHCSFQVTPYENYIELAERLNAIAPIDGPVKSIFFTTGAEALENAVKIARAHTGRRGIITFQGGYHGRTLLTLAMTGKVLPYKARFGPMPGDVFHARFPIPYHGFSEEEAIAGIEALFASAIEPSAVAAIVLEPVLGEGGFYTASYAFFRALREICDRHGILLIADEVQAGFARTGRMFAMDWVREATGVTPDLMTVAKAMAGGFPISGVMGRAEIMDAPDPGGLGGTYGGSPLGCAAGLAVLDVIADEDLCARAVAIGNRIKARLRRMRDNGMTAIGDVRGPGAMIAMELVHDGDPSRPNPDATRALVQEGAREGLLLLSCGLRGNVVRFLPALTMPDALLDEALDRLEIALNRVLGGQ

SEQ ID NO: 9131 - protein, 470 aa, Novosphingobium aromaticivorans DSM 12444
MLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMAVASAEIFGPVVPVIRFADEPQAIRIANDTPYGLAAYFYARDVGRIWRVMEALEYGMVGVNDGIISTEVAPFGGIKHSGLGREGSRHGLDEYLELKYCLMGGIDR

SEQ ID NO: 9132 - protein, 293 aa, Streptococcus mutans UA159
MSIQDFKDVNIITAFITPFKEDGSINFAALPKLIEHLLAHHTQGLLLAGTTAESPTLTHDEELELFAAVQKIVNGRVPLIAGVGTNDTRDSVNFVKEVADFGGFSAGLAIVPYYNKPTQEGLYQHFMTLADASDLPIIIYNIPGRVVTTLETDTMLRLAQHPNIIGVKECTNLDNIAYLVDNKPDDFLIFTGEDGEAFHALSLGADGVISVASHTNGDELFAMVEAIEKSDIKKAAGIQRQFLPKVHALFSVASPAPVKAVLNHQGFDAGPLRLPLVACTDEEARRIIEIVEK

SEQ ID NO: 9133 - protein, 446 aa, Methanococcus maripaludis S2
MNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 9134 - protein, 337 aa, Rhodobacter sphaeroides 2.4.1
MKAAIFDGSPTLRLTDLPIQEPGPDEVLIRIDSATICGTDQHILEGKFWAKPPVVLGHEFAGYVERVGERVQNCRPGDLVSVEPHVYCGCCKPCRLGKPHLCLDRLAWGINLNGGFEQYATVRMDTVYQVPEGIGPEEAALGEITGCCMHGIDRVGVELGDLVVILGGGAAGLILARLAELRGAARIVISEPNAARREQIRAFGYPDVVDPLNEDLAARIGALTDGLGADVVIEAAGRAETAAQAVELVCHGGRVLFFGVAAPGTMAAIEPNRIFAREITVVGSIRNPYTHHRVMEILPRLRLKDIVTHRFPLENIAEAFDAAHRGEGLKICIKPNG

SEQ ID NO: 9135 - protein, 130 aa, Guillardia theta
MEIILHLYEFVNMKSNKNLIQLVESNHSNKTLPQLQVGDTVRLGVSITEGNKERIQATEGVIISKSNCGINLTITIRRVLQGIGIERVYLLHSPKLKSIEILRKSKIRRAKLYYLRTRSGKATRLQQRFN

SEQ ID NO: 9136 - protein, 377 aa, Anemia phyllitidis
  misc_feature (39)..(39): Xaa can be any naturally occurring amino acid
MGDAEEVQPLVCDNGSGMVKAGFAGDDAPRAVFPSIVGXPRHTGVMVGMGQKDAYVGDEAQSKRGILTLKLPIETGIVTNWDDMEKIWHHTFYNELRVAPEEHPVLLTEAPANPKANREKMTQTMFDTFNVPAMYVAIQAVLSLYASGRTTGIVLDSGDGVTHTVPIYEGYALPHAILRLDLAGRDLTDALMKILTERGFSWTTTAEREIVRDMKEKLAYVALDFEQELETAKSSSSLEKSYELPDGQVITIGAERFRCPEVLFQGSLIGMEYAGIHETTYNSIMKCDVDIRKDLYGNVVLSGGSTMFPGIADRMSKEITALPPSSMKIKVVVRPERKIRVWIGGSILASLGTFQQMWIAKSEYDESGPSIVHRKCF

SEQ ID NO: 9137 - protein, 198 aa, Bordetella pertussis Tohama I
MLNMRTAEITRNTNETRIRVAVNLDGTGKQTIDTGVPFLDHMLDQIARHGLIDLDIKADGDLHIDAHHTVEDVGITLGMAIAKAVGSKAGLRRYGHAYVPLDEALSRVVIDFSGRPGLEYHIDFTRARIGDFDVDLTREFFQGLVNHALMTLHIDNLRGFNAHHQCETVFKAFGRALRMALEVDPRMGDAVPSTKGVL

SEQ ID NO: 9138 - protein, 441 aa, Synechococcus sp. WH 7805
MPALSSTMTEGKIVEWLKKPGEKVARGESVLVVESDKADMDVESFNEGFLAAVLMPAGSTAPVGETIGLIVESEAEIAEAQAKAPAGAPAAASTGAPTASASASVPAPAVSVPSPPPAPTTQAPAAVPAPPVAPAPTSTGRLIVSPRAKKLAAQMGVDLSLVRGSGPKGRIQAEDVERAAGRPVSVPQVGEGTAPAASSGGAVPAPPSAPAGNSFGLPGETVPFNTLQAAVNRNMEASLAVPSFRVGYTITTDKLDAFYKQVKPKGVTMTALLAKAVAVTLARHPQVNAATTAEGMAYPADVNVAVAVAMEDGGLITPVLRQADRIDLYELSRQWGDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIETRPESLAL

SEQ ID NO: 9139 - protein, 664 aa, Aspergillus oryzae
MKGFRQRVLSRAKDANKSSKKKDSSHSSQNQASLGVNHNQQSSSPKNGTPTSSTTSVNDTRGKSPDNAAQAGVYPPGQYNVPQGAGVAGQPVNNGGPATPTKQGQVPAPSVIISPSAPHVPPPGAAETMPGDLAPPRKSHVFDRLQTTPKDMSEGIRTPKRQHSSRFDISDQRQRELEKLPGFHEVPPNRRQDLFMQKIDQCNIIFDFNDPTADMKSKEIKRLALHELLDYVANNRSVITEPMYPRVVEMFAKNLFRPIPPPVTPQGEAFDPEEDEPVLEVAWPHIQVVYEFFLRFIESQDFNTNIAKAYIDHHFVLQLLELFDSEDPRERDFLKTTLHRIYGKFLNLRSYIRRSINNVFFQFTYETERFNGIAELLEILGSIINGFALPLKEEHKLFLTRVLLPLHKAKGLSMYHPQLAYCIVQFLEKDSSLTEEVVLGLLRYWPKVNSTKEVMYLNEVEDIFEVMDPAEFAKVQVPLFQQLAKSVASPHFQVAERALYFWNNEYFCNLVSDNVETILPIMFPPLYENSKGHWNRTIHSMVYNAMKMFMEINPQLFDECSHEYNERQNSAEQRERARKERWEKLAEQAKDRQNGVPAPPPPADIPVYVDEVDTITEDSQNRLQSLKLDDSGSVKERRSSTISHSDGIATTSCDECFVFTWFDI

SEQ ID NO: 9140 - protein, 377 aa, Anemia phyllitidis
  misc_feature (266)..(266): Xaa can be any naturally occurring amino acid
MGDAEEVQPLVCDNGSGMVKAGFAGDDAPRAVFPSIVGRPRHTGVMVGMGQKDAYVGDEAQSKRGILTLKYPIEHGIVTNWDDMEKIWHHTFYNELRVAPEEHPVLLTEAPLNPKANREKMTQIMFDTFNAPAMYVAIQAVLSLYASGRTTGIVLDSGDGVTHTVPIYEGYALPHAILRLDLAGRDLTDALMKILTERGYSFTTTAEREIVRDMKEKLAYVSLDFEQELETAKSSSSLEKSYELPDGQVITIGAERFRCPEVLFQXSLIGMESAGIHETTYNSIMKCDVDIRKDLYGNVVLSGGSTMFPGIADRMSKEITALAPSSMKIKVVAPPERKYSVWIGGSILASLSTFQQMWIAKSEYDESGPSIVHRKCF

SEQ ID NO: 9141 - protein, 290 aa, Oryza sativa (indica cultivar-group)
MQMSTNPNHYPVFPHSFCNQHVVSFQTSTIANGSGAIPVCPASSGGMNSDMTLLNTTPSTIVSTSSPNMLADSNQSLKYAAPMAVDWSYPELQLLNDGLLKYANEPGIMKYIKIAAMLPEKTVRDVAMRCQWMAAKKENTRRRKTDEHYLGKKTRDRKDKMVESSWATNRQVQTTDIRSPSTLACNTVRDNQFQSGASEIDRAMLNILEENARVLKQIGENIMTSQVQNNIDLFHHARRNISDLLQSMSQMPGIMSKMPPLPVSVDDRLASYILPGVNLAQVFGSSHLRS

SEQ ID NO: 9142 - protein, 365 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATY

SEQ ID NO: 9143 - protein, 350 aa, Pseudomonas aeruginosa PAO1
MNAMNPQHENAQTVTSMTMIQALRSAMDIMLERDDDVVVFGQDVGYFGGVFRCTEGLQKKYGTSRVFDAPISESGIIGAAVGMGAYGLRPVVEIQFADYVYPASDQLISEAARLRYRSAGDFIVPMTVRMPCGGGIYGGQTHSQSPEAMFTQVCGLRTVMPSNPYDAKGLLIACIENDDPVIFLEPKRLYNGPFDGHHDRPVTPWSKHPASQVPDGYYKVPLDKAAIVRPGAALTVLTYGTMVYVAQAAADETGLDAEIIDLRSLWPLDLETIVASVKKTGRCVIAHEATRTCGFGAELMSLVQEHCFHHLEAPIERVTGWDTPYPHAQEWAYFPGPARVGAAFKRVMEV

SEQ ID NO: 9144 - protein, 483 aa, Kluyveromyces lactis NRRL Y-1140
MLSLQQFQLLECVGKGNFGDVYLAHYLGSNQEPTDPKIPKNVPLAIKCINLEHSNEPIDLLLKEIYFLSTLHCPYITHYYGTFTGDCNLYIVMEYCSNGSLLNLLRYYSRLTEQTTCFIILQVCHALEYLHEKRLIHRDLKAANILLNDDGEVRLADLGVTGQLKFNSTRHGGKNLNTFVGTPFWMAPEIIKNQSYDGKCDIWSLGITTLELLNGKPPMSHLDSMKALMRIPKLNADSILRNMDISPLGKDFIRSCLQQDPNQRPTCKQLLQHKWLKKCSITNIMEEITVMKTNQILSKEKPRSCKPRFPLSDKVYKTNLPNQLESWRFEDESVLRFDGLGDIPNLYNNSNNKNEMANSPLLTKQQLRTPNISTPTSALSPTSMAISPKTNLSTPATESYEDVSSSPSEQKMKLGHENQNIDYWKDVFLYSLKKVRQRAINEPTKETVKSLTRYMGDLEKDFPGLSEALVQEISTRVAKLKNL

SEQ ID NO: 9145 - protein, 464 aa, Pseudomonas aeruginosa PAO1
MSQILKTSLLIVGGGPGGYVAAIRAGQLGIPTVLVEGAALGGTCLNVGCIPSKALIHAAEEYLKARHYASRSALGIQVQAPSIDIARTVEWKDAIVDRLTSGVAALLKKHGVDVVQGWARILDGKSVAVELAGGGSQRIECEHLLLAAGSQSVELPILPLGGKVISSTEALAPGSLPKRLVVVGGGYIGLELGTAYRKLGVEVAVVEAQPRILPGYDEELTKPVAQALRRLGVELYLGHSLLGPSENGVRVRDGAGEEREIAADQVLVAVGRKPRSEGWNLESLGLDMNGRAVKVDDQCRTSMRNVWAIGDLAGEPMLAHRAMAQGEMVAELIAGKRRQFAPVAIPAVCFTDPEVVVAGLSPEQAKDAGLDCLVASFPFAANGRAMTLEANEGFVRVVARRDNHLVVGWQAVGKAVSELSTAFAQSLEMGARLEDIAGTIHAHPTLGEAVQEAALRALGHALHI

SEQ ID NO: 9146 - protein, 604 aa, Triticum aestivum
MEEEARPPLLPVRIPMNGEDLAPAAPGACAVGGGRAEIDTSAPFESVREAVDRFGGSAAWSSHLVNRIFAHHKKQNQTVCMGTEDEQCANLAEQTAQIEKELGAKERETLDVLKQLESAKRIIADLKLKIQKKTAEDALQAEEEKQQHPESNCSLTQLSTAEPEVKQPEGNAEAAEEVQITEPEVKQQPEENANSGADVDMCAGLDEQEQQQQHPNLVLMELEQAKSNLNRTTGDLAAIRASIESLRHDIATEKVLVERSRAKVSSDATLVSSLKEELDQTTKKLQTLKDLQRRREDPSDIFFEIKRMTSEIEQLRNAANASKSEAMMLAAEIEQTKATIGTAEVRCLAAKKMEEAARAAEALALAEIKALLCSEASAEDLQGTDGVILSVEEYSELASKAREVDESSRNKIAAAMVHVDEANQSKSESLTRLEEAKMEVEECKKALQEALKRVETANRRKFAVEETLRRCRSETGHKRRSFRGSPKFKTAAHRHRDDSHCMDIVDVSDNSMKPTLSIGQILSMKLMGPDGYDKSVSDDTSTSETSSVSLGQILNRRQAILTYSSDTSANKKFSGKRKKFAFTGLSVFLAKQAKSKKKRGSDEN

SEQ ID NO: 9147 - protein, 392 aa, Crocosphaera watsonii WH 8501
MHFAQRIQALEKNVFADMDRAKSQAISKGKKIIDLSLGSSDLPADPEAIATISASLEDPSTYGYLLHHGTLNFRETVGQWYSNRFGVEVDPQREVLTLIGSQEGTAHLPLALLDPGDFALLLDPGYPSHAGGVYLAGGQIYPMPLLAENDFLPVFEDIPSQVLGQAKLMVLSYPHNPTTATASLSFFQEAVNFCRNHGLVLVHDFPYVDIVFEGMTQPPSILQADTQKSLSIEFFTLSKSYNMGGFRIGYAIGNAEIIQALRQVKAVVDFNQYQGILNGAIAALTGEQTTVKKTLARFQSRRDAFIKALNNIGWQVTPPQATMYVWAKLPQTWENKSVEFSTELVAATGVAVSPGAGFGKQGEGYVRFALVHDPHVLELAVEKIAQFLATRT

SEQ ID NO: 9148 - protein, 349 aa, Zea mays
  misc_feature (310)..(310): Xaa can be any naturally occurring amino acid
  misc_feature (340)..(340): Xaa can be any naturally occurring amino acid
MAPELMTAKMTANAAAAAAAAAAAKPATRAYVTFLAGDGDYWKGVVGLAKGLRKVRSAYPLVVAVLPDVPESHRRILVSQGCVVREIEPVYPPENQTQFAMAYYVINYSKLRIWEFVEYERMVYLDADIQVFENIDGLFELEKGYFYAVMAGFCEKTWSHTPQYRIGYCQQCPDKVAWPTRTAELGLPPSSYFNAGMFLKEPNLATAKGSPETLRLIPPTPFAKKDFLKMFFRDNYRPIPNVYNLVLAMLWRHPENVQLEKVKVVHYCAAGSKPWRFTGKEANMDREDINALVKKWWDIYNDETLDLKGXPRFSPDDDDEVEAVPKKPLRAALAEAGTVXKYVTAPSAA

SEQ ID NO: 9149 - protein, 142 aa, Paxillus involutus
  misc_feature (17)..(17): Xaa can be any naturally occurring amino acid
YIMLKPDGVDRGLIGEXLARFEKRGFKLIAAKLALPSKEHLEKHYADLKDKAFFPGMIKYMQSGPVFCMVFEGLDAVKTGRAMLGATNPLASQPGTIRGDYALAVGRNICHGSDSVENAEKEIALWFPDGTLQYQLSQEAMI

SEQ ID NO: 9150 - protein, 468 aa, Agrobacterium tumefaciens str. C58
MAYDVVVIGTGPGGYVCAVKAAQLGLKVAVIEKRATYGGTCLNVGCIPSKALLHASETFAHVAHGVDTLGIEVAAPKLNLEKMMGHKDGVVKANVDGVAFLFKKNKIDAFQGTGKVVSAGKVSVTNDKGETQEIEAKNIVIATGSDVAGIPGVKVDIDETVIVSSTGAIALSKVPEKLIVVGGGVIGLELGSVWSRLGAKVTVVEYLDNILGGMDGEVSKQSQRLLAKQGLDFKLGAKVTAVEKTAAGAKVVFEPVKGGAAETLEADVVLISTGRKPYTEGLGLAEAGVVLDSRGRVEIDGHYKTNVDGIYAIGDVVKGPMLAHKAEDEGVALAEILAGQRGHVNYDVIPAVVYTQPEIASVGNTEEELKAAGVAYKVGKFPFTANGRARAMQVTDGFVKILADKETDRVLGGHIVGFGAGEMIHEITVLMEFGGSSEDLGRTCHAHPTMSEAVKEAALATFFKPIHM

SEQ ID NO: 9151 - protein, 377 aa, Anemia phyllitidis
  misc_feature (318)..(318): Xaa can be any naturally occurring amino acid
MADAEDIQPLVCDNGSGMVKAGFAGDDAPRAVFPSIVGRPRHTGVMVGMGQKDAYVGDEAQSKRGILTLKYPIEHGIVTNWDDMEKIWHHTFYNELRVAPEDHPVLLTEAPLNPKANREKMTQIMFETFNVPAMYVAIQAVLSLYASGRTTGIVLDSGDGVTHTVPIYEGYALPHAILRLDLAGRDLTDALMKILTERGYSFTTTAEREIVRDMKEKLAYVASDFEQELETSKSSSSLEKSYELPDGQVITIGAERFRCPEVLFQPSLIGMETPGIHETTYNSIMKCDVDIRKDLYGVIVLSGGSTMFPGIVDRMSRXITALAPSSMKIKVVAPPERKISVWIGGSILASLSTFQQIWIAKSEYDESRPSIVHRKCF

SEQ ID NO: 9152 - protein, 134 aa, Bordetella pertussis Tohama I
MNTEPTWMAEVVFDENGLIPAIAQDAETGQILMVAWMSREALAETAATGRAVYWSRSRQRLWRKGEESGHAQDVHELRLDCDGDVILLKVHQNGGIACHTGRASCFYRRLEGTASQAEWITIDPVLKDPELIYK

SEQ ID NO: 9153 - protein, 133 aa, Triticum aestivum
AYLGDTIEQVCTKKQAGTGPEFPGYRRPTRPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 9154 - protein, 115 aa, Bordetella pertussis Tohama I
MTTPTAGDDILSRIADTLATRRPEAGGDPQSSYVAKLLSKAPDAFLKKIGEEATELVMAAKDGQPDRIISETADLWFHCLVALTHYNLRPEDVLAELARREGLSGLEEKARRPRD

SEQ ID NO: 9155 - protein, 312 aa, Pseudomonas syringae pv. syringae B728a
MFLVCGEALFDIFTRADDSGSLNRLGFDAIAGGSPFNVAIGLRRLGVEASFLAGLSTDYLGRRLRAVLEKETVNTDHLIDFDAPTTLAMVAVGSDGSPTYSFRGDGCADRQLRLEHLPELDGQVRGIHVGSFSLVVQPIADTLLALVARESSTRLISLDPNVRLNPAPDIQRWRSQVAAFAEHAHMIKVSDEDLHLLYPDSDPQKIAEGWLGKRTQLVIVTRGTQGASVFTRQHGTWSAPAKTVVTADTVGAGDTFQAALLTFLSERQLDTPEGLATLSRELLDEMLSFAVGAAALTCTKVGPDLPYRHQLG

SEQ ID NO: 9156 - protein, 122 aa, Bordetella pertussis Tohama I
MSDNCIFCKIARGEIPAKKVFEDDEFVAFHDINPAAPVHLLLIPRRHVVSLQDIAEGDAGWLGRMTVLASRLAAGNGCNPGPDGGFRLMANSGAEGGQEVPHLHFHILGGPRPWKGRVAPAA

SEQ ID NO: 9157 - protein, 269 aa, Pyrococcus horikoshii OT3
MLENLLSTLSSWLLLASHGNLIIVAVYAGIFVALMTTLGALIAIFANRMPDWGMDVSLSFAAGVMIVASFTSLILPAIDLTGSFTPAGIGIFLGVLLIYGIDNFIPHEHIIKGYEGPKEFKEKLKLVWLVVLAVIIHNLPEGLAVGISIVYNLNAGLVTAIAIGIQDFPEGTVVSLPLATIQKKRLVPILLGALSGIAEMVMVILGAFLFSIFKSFLPYGLGLAGGAMLYVTVKEMIPEIYKRQENEKLVTLGFFLGFYVMLFLDSMLG

SEQ ID NO: 9158 - protein, 375 aa, Archaeoglobus fulgidus DSM 4304
MDWIEREKKHILQTYTRQKVVIERGEGCYVYDVNGKRYLDLVAGIATVSIGHCNSHLVERLKEQLEKLIHISNLYYTTPQVELAEKLSEIAGMDRFFFCNSGAEAVEAALKFARRATGRKKFVSFTGDFHGRTMGALSVTHKEKFRKPFEPLVSPVEFAEFNNPESLEKVVDEETAAVIVELVQGEAGVYPADREFVKAIEELREKYGFLLIVDEVQTGFGRTGRWFAKDHYGIEPDMITMAKAMGSGVPIGCCALKEEVAEKIQVGDHGSTFGGNPLACTAALATIEVIEREGLVENSARMGEYFVKRLKESFENVIGVGLMIGFDVGDAAEFVRKCLENGLLVNNTSERRIRLVPPLVITEREVDKAVEIMLN

SEQ ID NO: 9159 - protein, 135 aa, Candidatus Protochlamydia amoebophila UWE25
MIMSRSAIIEKLQNEQMKKDITPFRIGDTVRVHIRIIEGDKERTQVFAGTVIARKGQGLSETFSVHRVAYGEGMERVFMLHSPRIAKIEVIKEGDVRRSKLYYLRGTSGKASKVKARLGARRSSNAVTKQIVSAE

SEQ ID NO: 9160 - protein, 334 aa, Candida glabrata CBS 138
MSEPVQKKQKTNSSLDQLKASGTVVVADTGDFESIAKFQPQDSTTNPSLILAAAKQPAYAKLIDVAVEYGKKHGKTVEEQTEAAVDRLLVEFGKEILKIVPGRVSTEVDARLSFDKEATIAKALQIIKLYEEQGISKSRVLIKIASTWEGIQAARELESKHGIHCNLTLLFNFAQAVACAEANITLISPFVGRIMDYYKAKTGETYTGETDPGVKSVRAIYNYYKKYGYKTIVMGASFRNIDEIKALAGVDYLTISPNLLDQLLNSNDPVPKILDPATAKDEAGEKVTFVDNESAFRFALNDDAMATDKLSDGIRKFSADIITLFDMIEKKVKA

SEQ ID NO: 9161 - protein, 140 aa, Kluyveromyces lactis NRRL Y-1140
MKFTTGLSVLLFFVLQVFAEKLTELVVGVTKEPVDCKIKASKGDVVSVHYTGKLRDSGEIFDSSYNRGVPIQFKLGYSQVISGWDQGILGMCIGEGRTLHIPSELGYGSRGAGSVIPPDADLIFETELVDIQREAVDDEL

SEQ ID NO: 9162 - protein, 365 aa, Aspergillus oryzae
MAEFVRAQIFGTTFEITSRYTELQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAACIFAEMLEGKPLFPGKDHVNQFSIITELLGTPPDDVIETICSENTLRFVKSLPKRERQPLATKFKNADPDAVDLLERMLVFDPKKRIRAGEALAHEYLAPYHDPTDEPVAEEKFDWSFNDADLPVDTWKIMMYSEILDFHNIDQGTEASQVLVEGAGDAQQNFV

SEQ ID NO: 9163 - protein, 379 aa, Phragmites australis
MATAGQVIKCKAAVAWEAGKPLSMEEVDVAPPQAMEVRIKILFTSLCHTDVYFWEAKDQTPVFPRIFGHEAGGIVESVGEGVTDVAPGDHVLPVFTGECKECAHCKSAESNMCDLLRINTDRGVMIGDGKSRLSINGKPIYHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHNKPVQEVLAEMTNGGVDRSVECTGNINAMIQAFERVHDGWGVAVLVGVPHKDAEFKTHPMNFLNERTLKGTFFGNFKPRTDLPNVVELYMKKELELEKFITHTISFAEINKAFDLMVKGEGIRCIIRMDN

SEQ ID NO: 9164 - protein, 542 aa, Archaeoglobus fulgidus DSM 4304
MELKYKIGFPSLYYPKISLADRIDAAAEKFGEKTAIISAEPKFPSEFPESMNFLEICEVTKKLASGISRKGVRKGEHVGVCIPNSIDYVMTIYALWRVAATPVPINPMYKSFELEHILNDSEATTLVVHSMLYENFKPVLEKTGVERVFVVGGEVNSLSEVMDSGSEDFENVKVNPEEDVALIPYTGGTTGMPKGVMLTHFNLAANALQLAVATGLSHMDTIVGCMPMFHSAEFGLVNLMVTVGNEYVVMGMFNQEMLAENIEKYKGTFSWAVPPALNVLVNTLESSNKTYDWSYLKVFATGAWPVAPALVEKLLKLAAEKCNNPRLRHNQIWGMTEACPMVTTNPPLRLDKSTTQGVPMSDIELKVISLEDGRELGVGESGEIVIRGPNIFKGYWKREKENQECWWYDEKGRKFFRTGDVGFIDEEGFLHFQDRVKEVIKYKGYTIAPFELEALLMKHEAVMDVAVIGKPDEEAGEVPKAFIVLKPEYRGKVDEEDIIEWVRERISGYKRVREVEFVEELPRTASGKLLRRLLREKEAEKG

SEQ ID NO: 9165 - protein, 482 aa, Comamonas sp. NCIMB 9872
MNSSLHYNYVGGDWVNGATERHNLNPSDLSDSIGIYVGANEAQTQAAIDAAFDARTAWACWTAEQRADALDRIGTSILASAKELGHLLSREEGKTLAEGIGEAARAGRIFKYFAAEALRCGGDLLPAIRPGVSVEVTREPEGVVGIITPWNFPLAIPAWKIAPALAYGNTVVFKPADLVPGSAWALTEIIHRVGGLPPGVFNLVMGPGSKVGNTLANAPKVRALSFTGSATTGRQVGLACMERGAKVQMEMGGKNPLVVLNDADLQSAASVAIQGSFYSTGQRCTGSSRLIVEAGIHDAFVEAMRQQMSALSIGHALKQGTDIGPVASEDQLQQDLEYIRIGVAEGGRLYCGGSQLERETEGFYLSPALLTETDNSMRINREEIFGPVASVIRVGSYEEALHTANDTVFGLSSGICTTSLKYASDFKRRSAAGMVMVNVPTAGVDYHAPFGGRKGSSYGAREQGAYAREFYTVIKTAYTSAG

SEQ ID NO: 9166 - protein, 316 aa, Pseudomonas aeruginosa PAO1
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 9167 - protein, 410 aa, Agrobacterium tumefaciens str. C58
MATEIRVPTLGESVSEATVGTWFKKVGDTVKADEPLVELETDKVTVEVPAPASGVLTEIVAQNGETVGLDALLGQIAEGAAGAATSAPAAKPAAPAAAPAPAAAVAAAPGGSAMPPAPAAGKLLAENNLSADQVDGSGKRGQVLKGDVLAAVAKGVSAPAAAPAPVAAPRPVSAEQDQVREERVKMTRLRQTIARRLKDAQNTAAMLTTYNEVDMSAVMDLRNRYKDVFEKKHGVKLGFMGFFTKAVTHALKELPAVNAEIDGTDIIYKNYCHVGMAVGTDKGLVVPVIRDADQLSIAGVEKELGRLAKAARDGSLGMADMQGGTFTITNGGVYGSLMSSPILNAPQSGILGMHKIQERPVAIGGQVVIRPMMYLALSYDHRIVDGKEAVTFLVRVKESLEDPERLVLDL

SEQ ID NO: 9168 - protein, 427 aa, Neisseria meningitidis MC58
MSKSIKLNVPGQAGLELPVLEASIGHDVVDIRGLTKNTGLFSFDPGFVSTASCESKITYIDGDQGLLYYRGYPIEQLAEKSDYLEVCYLLIYGELPTPEQKAEFDNTVRRHTMVHEQLTWFFRGFRRDAHPMAMMVGVVGALSAFYQDSLDISNPEHRKIAIYRLISKIPTIAAMCYRYSNGLPFNYPKNNLSYSENFLHMMFATPCEDYKPNPVLARALDRIFILHADHEQNASTSTVRLAGSSGANPFACIAAGIACLWGASHGGANEAVLKMLDEIGDVSNVAAYMEGVKQRKYRLMGFGHRVYRNMDPRASIMRETCYEVLKELGLEDSPKFKLAMELEQIALKDPFFIERKLYPNVDFYSGIVLSALGIPTEMFTVIFALSRSVGWISHWHEMISDPSLKIGRPRQLYTGSERRDYVPPGER

SEQ ID NO: 9169 - protein, 542 aa, Rubrobacter xylanophilus DSM 9941
MQGLTMDYQLTLPAVLKRADQLFGRKEIVTRRPDKSFHRYTYADFVRRAKKLAVALGGLGLQKSDRVATLGWNTYQHLEAYFGVPSAGLVLHTLNPRLPADELAYIIDHAGDRVLLVDETMVRLLDGFRDKVNLEHVFVFTYSPEGEVPEGLRGYEELLQEADEGDFAYPDLDERDAAAMCYTSGTTGRPKGVLYSHRCICLHSLITSVAEAFGLSEADSVLPVVPMFHVNAWGIPFAATMHGAKQVFPGPHLDPQSLLEDFEQEKVTFTAGVPTVFLGILRELDRQPGRYDLSSLKAMGIGGSAAPEGMIRGFRERHGLTVLHAWGMTEMAPVGTAGHLTSDLLQEPEDVQYRYRAKQGIPLPFIEIRARGAEGLVPWDGRTMGELEVRGPTVASSYYEAPEAADKFTEDGWFRTGDIVTIDERGYIEIRDRDKDLVKSGGEWISSVELENALMGHPAVAEAAVIAVPHPKWQERPLAVVVLKEGESATPEELIQSIAPRFEKWQLPDAVEFVDEIPKTATGKFLKTRLREMFKDYQLAKS

SEQ ID NO: 9170 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 9171 - protein, 665 aa, Haemophilus influenzae 86-028NP
MATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAERFEAYGWQVIRNVNGHNAEQIRAAAVLAQAEKEKPTLIICKTIIGFGSPNKSGSHDCHGAPLGDEEIALTRKALGWEYAPFEIPAEYYAEWSAKEKGAAAEKSWEEKFAAYAKAYPELAAEFKRRVSGELPTNWAAESKAFIEKLQANPASIASRKASQNAIEAYAHLLPEFLGGSADLASSNLTLWSGSKPIRAHENVSGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVQAAEALSAEGKKVRVVSMPSTNRFDKQDEAYRESVLPAAVTKRVAIEAGIADFWYKYVGFNGRVVGMNSFGESAPADQLFKLFGFTVENVVAKAKEIL

SEQ ID NO: 9172 - protein, 393 aa, Neisseria meningitidis MC58
MIIDVKVPMLSESVSEGTLLEWKKKVGEAVARDEILIDIETDKVVLEVPSPQAGVLVEIVAQDGETVVADQVLARVDTAATAAAEAPAAAPAEAAPAAAPAATQNNAAMPAAAKLAAETGVDVNALQGSGRDGRVLKEDVQNAAAKPAGAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 9173 - protein, 230 aa, Novosphingobium aromaticivorans DSM 12444
MNELIGRVFSFEKTVFPDSRELFGKLSTQGQSPKALMISCADSRIVPEQIMQAEPGELFVCRNAGNMVPPFATMNGGVSSTVEYAVVALGVRDIIVCGHSDCGAMKALAAPELPQGMPNVVAWLRHGSAAEHVVSSCSPHLHGNERVRAVSLQNIIAQIAHLRTHPSVAAAIARGEMALHGWFVDISAGMVLGLDGDTGQFVPLREDRSLPVALPAQPRAASEPLVEAAE

SEQ ID NO: 9174 - protein, 1871 aa, Cryptococcus neoformans var. neoformans B-3501A
MPDGSTSPREPANSTYSTHEPQSKRHSSPQSVAMPAAPRFHRQHTSSQDHGSSSTPISPAASSTGPLSPSIPPGSFVFPIRSVFQGMVHSDSSNGITEGHQQRKKDGLQRSSGSSSPLRSPALSDAHRFSTDAAGALHDEPDAGIQTIAQLLQQDRSAPLKEKGKHQPGVATFVGKAERDRNGSGGGETLKPSSPDASGHLGNSPITHSSSDSEHQKQQDVAKSSRSEEGTNDSPESSHGSGGTLKQATRTDLPAALQRSSTVKGKVSASGLTKPSPSNYRHFPSEHHSGQRERRFSTVNKVNPPSRNSSSHPVDASHPPNPELQHPVPRRNTRQQHTQDAEGNNRTSSHGSRTSLEVDESGMRSLISDMSGIVLLGEAGSWGSMGGSGVSGSKGTDGGTGTTGTLDSASIDSGHATGGRGQGDERQVTKASLAAKHGARQTSRQDSVRSFIQSQAGTTNLQDPNAPTLSPMPSGSPPAEGSQDATVSMEDSANNEKQREQQQEEGEAEQQGEEENGQVEQPVAASAEDAENPDEPAVTMRFEHVVTEEGHHIVAGREGRLRRCQDEPITTPGAVQGFGVLMVLEEDYETGNLEIRQVSEVNIFVIVMSKYQETILRDTLEYLPESYGGSNSVEDSGPSVFLLSGFGEPGSDAEEGVTEGGPETEVRSTASNAGGKRKEWTCWVAAHRPEHRGWNKVDEIGEPIPPPDWIILEFELERDVYNPLVHPSENAETSTAAANSNARSLSPDSTAASVSASGSNSNSNTLSASTRSGERTLDSLTSTLAGGRAGVSAGLGPGTASSDASPGDLGSSASDFTSVPKQEARMGLDGLEMHIPLEKILESTTNHASPLRALERMRGTTVNASNEARSRGRGRGRARGGRQRPIRTESGGTGTMDIFAVLGQINDQLVAAPDLDTFLKVAVGLMQDICRFHRVLIYQFDEQMNGLVVSELVEWGKTTDLYMGLRFPATDIPPQARELYKINKVRMLYDRSQTTARMVLRNKEDLDQPLDMTHCYLRAMSPIHLKYLGNMSVRSSMSISIMAFGQLWGLIACHSYGQHGMRVSFPVRQMLRLLSDSISRNIERLSYAQRLHTRKLISTIPDRSHPTGYIISNAGDLLQIFGADAGLLVIGDGCKLLGHSNEQGQAMLAIAEYLRIKRFDNLNASSSIQRDFPDLVLPRASDTIAGLLYVPLTAKAGQDFIVFLRKGQVREVQWAGKPYKDDKASEEASLEPRKSFKAWTETVTGCSRAWTDHQLESAGVLALIYGKFIQVWREKQTAMASNQLTAILLSNTSHAVRTPLSQIINTLELALAGNIDDDVRKMLENSHQASRALLFHVHDLLDLTRIETGNETAFNDPFDIRQSISDAVRLYQTEVARRGLEFRVNMAEDLPRYVVGDSRKIKTVISNLVANSVKFTEKGFIEVYCGIQRPFDGESSQTSLTESKEGNTITIEIVISDSGCGIPTVQLEEMFFTLEGAEPLQKNTGVGLGLAVVARIVEQLEGQLRAESEVGVGTRFYFNVPMVAHPSGRPGSRQSSHNSRNTNSSQLRTRTGSSGSKSDSVVSLRSDGSGVPEIESFVQDFGGSHLPAPVGDDDPRLLEAQERMSRLGTFPVTDSSYPVRATKVNTDDQHVKSPKPKKPRFTAIGSSERSTSRHNTTSSKTSSASQSPAFSRPSSNSVQGPKRNKKGPNGKTVMRIMVVEDDPINSQILQKRLKMDKHVVVAVTNGQEAVDQLEKDRDIDAILMDIQMPIMDGRTSAKEIRELEARTPQPDDIEPFKVDGRTPIFAVSASLYEDDRANLAENFDGWLLKPLDFSRVRAILEGLESSEKRGAEVYQQGNWERGGYLKAAPLPASSSASTPSTTQSSPCTSTS

SEQ ID NO: 9175 - protein, 119 aa, Triticum aestivum
ILLEIVVKESSTRTIALLPRIFLMHGTDDYSIPSSASRTFVDVLQQVGAQATLLLYEGKTHTDIFIQDPLRGGRDPLVEDVFSVIYADDATRQNAASAPTPRRLVFEWQLQLARWISPF

SEQ ID NO: 9176 - protein, 323 aa, Cryptococcus neoformans var. neoformans B-3501A
MPTSLEALKASGTTVVADTGDFSSIDEFKPQDATTNPSLILAAVKMPAYAKLLEPAIKYAKSKGGDIEVQSENAMDRLLVEFGTEILKIIPGRVSTEVDAKFSFDTQATINKAHQIIALYKEQGIDKNRVLIKIASTYEGILAAKQLESEGIHCNLTLLFGFGQAVACAEAGVTLISPFVGRILDWYKKANPDTTYTAETDPGVQSVQKIYNYYKQHGYKTIVMGASFRNTGEIAALAGCDFLTISPKLLDELNKSQDDLPKKLDASSTGEAIPKTSYLDDEAKFRWALFEDVMAFDKLHEGIRGFAKDGASLKQMLIEKLKA

SEQ ID NO: 9177 - protein, 577 aa, Schizosaccharomyces pombe
MRERVPGEKILPKSNERNILITSALPYVNNVPHLGNIVGSTLSADVFARYHRARNHNTLYICGTDEYGTATETKALEEGVSPKELCDKYHALHKEVYDWFEIDFDHFGRTTTPKQTGIAQHIFTKLYNNDYMAIDTMTQLYCEVHQGYLADRYVEGTCPKCGYDDARGDQCDGCGGLLNAFELIDPKCKLDRATPVKRETKHVFLSLDKLQPAVESWAMQSAVEGKWSNNGRSITESWLKEGLRPRCITRDLKWGTPVPLEEFKGKVLYVWFDATIGYISITANYTDEWEKWWRNPEQVKLYQFMGKDNVPFHTVIFPSSLLGTGEKWTMLHHINTTDYLNYETGKFSKSRGVGVFGNTAQDIGLSPSVWRYYLLSSRPETSDTMFTWKEFITRHNSELLANLGNFVNRTLKFTTAKYNGLVPHYLTDPSVGAGKLKADFVKDVNALLAKYNAALEASKLREGLRLAMEISARGNQYLQDNRIDNKCYLYERQKCADAIGYALNLIYLLAAIFYPYMPSTSTSIYKQLNAPAAAIPDTWELCLLPGHRIGEPEYLFTRIDESMEEEWRSKYGGNGSN

SEQ ID NO: 9178 - protein, 295 aa, Schizosaccharomyces pombe
MPIYNILRKVIHLAKFAKSKLISITSDRDQISMSIPEVSSHDSCLNDCHSVNSEEQAKPVCCLELNAHKDGIKVVDTSNDASTFSNSPLVPDNFGVVYPGIIYRSACPRASNFNFLESLHIRTIISLRQEEYSEEDLHYFTKHHINYYHIAMPGSKHRKNDCISSSSNPDISDVDDLVRKTLQLLLNKENWPVLLHCSRGKHRTGIVIGCLRALMNWPVGNRLQEYISFSHPKEREVDEEYIQNFSSDPSLKSSLNDLKRYISDSSSELADVVLSSESPTVQAATVNETCRSPGS

SEQ ID NO: 9179 - protein, 584 aa, uncultured bacterium 577
MTQLIEIKVPDVGDFKEIPVIEILVQPGDNVEKETSLITLETDKATIEIPAPQNGTVKEIKVKIGDTVSEGSIILTLKPITNPTDSPPHTKKDTKAEFSPPTVNPISTQPTTIPRGDFHADVAILGAGPGGYTAAFRAADLGKKVILIERYPVLGGVCLNVGCIPSKALLHMAKVVTDAEETIHAGVNFNTPKLELDKLRKWKESIIGKLTNGLTALAKKRNVEVIQGNGKFITPNMISVTTPNGQKTVSFEYCVIAAGSSVAHPPGIIQNDPRIIDSTGALELEDIPKRMLIIGGGIIGLEMATIYDAFGSKVSVVEMKDQLISGADKDLIKPLYRRIKKRYEAIYLRTKVSEINPQKDGLEVTFEGEESPGTQTYDRILVAVGRRPNGHAIEAGNAGVHVTKQGFITVDNQLRTNVPNIFGIGDIVGEPMLAHKATHEGKLAAEIIAGQKAAFDVRTIPSVAYTDPEIAWMGLTEIEAKNQGIDYEKASFPWAASGRAIAMGRDEGMTKLLFDKNTRRLLGAGIVGINAGELISETVFALEMGTDMEDISLTIHPHPTLSETINFAAEIAEGSITDLYMPKK

SEQ ID NO: 9180 - protein, 949 aa, Methylobacillus flagellatus KT
MDKQADYGTPASRTTEQQVTLEIDGMQVTVAKGTSIMRAAMEAGVSIPKLCATDTLEPFGSCRLCLVEIEGRRGYPASCTTPVDEGLKVHTQTPKLADIRRGVMELYISDHPLDCLTCSANGDCELQDMAGAVGLREVRYGYDGSNHLHAEKDLSNPYFQFDPSKCIVCSRCVRACEETQGTFALTIQGRGFDSKVAAGNFDNFLESECVSCGACVTACPTATLMEKTVIEHGQPEHSVITTCAYCGVGCSFRAEMKGEQVVRMVPDKNGGANHGHSCVKGRFAWGYATHRDRITTPMIRKSIHDPWQEVSWEEAITYAASELKRIQAKHGRNSIGAITSSRCTNEETYLVQKLVRAAFGNNNVDTCARVCHSPTGYGLKQTLGESAGTQTFDSIMKSDVIMVIGANPTDGHPVFGSQMKRRLREGAKLIIADPRAIDLVSGPHVKADYHLKLRPGTNVALITALAHVVVTEGLVDEAFVRERCEWDSYQYWSEFVAQPEHSPEAMQDVIGVPAQDLRAAARLYATGGNAAIYYGLGVTEHSQGSTMVMGIANLAMATGNIGREGVGVNPLRGQNNVQGACDMGSFPHEFPGYRHVSDDTTRALFEAAWGRPLDKEPGLRIPNMLDFAIHGSFKALYCEGEDIAQSDPNTQHVTQALSSMECVIVQDLFLNETAMYAHVFLPGCSFLEKNGTFTNAERRISPVRRVMTPKNGYEDWQITAMLSEALGYPMPYRHASEILDEIARLTPTFHGVSFKKLEEMGSIQWPCNEEHPNGTPIMHVDEFVRGKGRFMITEYVPTSERVNEKYPLILTTGRILSQYNVGAQTRRTDNVTWHPEDMVEIHPHDAEDRGIKDGDWVGITSRAGNTVLRAKITERVQPGVIYTTFHHPESGANVITTDNSDWATNCPEFKVTAVQVTRVSQLSDWQRRYQEFSNSQIALVKQRDMARMG

SEQ ID NO: 9181 - protein, 169 aa, Zea mays
  misc_feature (52)..(52): Xaa can be any naturally occurring amino acid
  misc_feature (70)..(70): Xaa can be any naturally occurring amino acid
  misc_feature (80)..(80): Xaa can be any naturally occurring amino acid
  misc_feature (99)..(99): Xaa can be any naturally occurring amino acid
MGYWNSKVVPRFKKIFEKSSVKKAAAAEACKTFDESKEAINKEIEEKKTELXPKVVETYEATSAEVKALXRDPKEAGVKXNSAAVQKYLEALAAIDFPXSTAAKDAASSFGAAYVSGPVMVIIQESLCVSFPRRLRTRKIPGGRKGKPKKPAKNGGAGPKPKNRFKTQK

SEQ ID NO: 9182 - protein, 822 aa, Ustilago maydis 521
MFTVVGLQVRRHAPSHPHAPYAADSWPLAARRRAPIVTRGDLTLMTCPHAHVTQAVSEARVHESTLGHVVQTCCCEYCIRDFNGTLAAGQTERVSDRSLRTAPPACWSFAISPVAQLLGYYPPSAQPLSQHWHHKRSHSKHSSFATMASLIPPKKPRKPGMPKLTIPTRPTSSSSAPSGSLACDDAPFDAASAAKAQPGHPSQRPQPSLIIPQHSTSSLSLGGHAYQDEGYEDGHPGVFNTTASTIYPDTVPHLTNSQMYTAITDDLRRAIGGMSITDSDGERLDASGLRIPVTGGKSSSHGYWMTNDSATASINADGTEPNGADVSSQPSQSRTRTDSSASAASTRASNQGGHDDELVLAGNFEMLSRLGEGASGEVHKVRHRPTGLIMAKKTISTSPNPAIHRQILRELAFNRSCHSDYIVRYYGAFLEEQDTSIAICMEYAEAGSLDAIYKKVKSRNGRTGEKVLGKVAECVLKGLSYLHERKIIHRDIKPSNIVVTRQGQIKLCDFGVSGELINSVAGTFTGTSFYMAPERIRGLAYTITSDVWSLGLTILEVASNRFPFPAEGEPPLGPIDLLSYVVNMKVPELQDDEKAGVKWSRALRDFIERCLEKEPTKRPGPHKMISHPFIRKSETRQPQPDIAKFVADVYGWSYLPSSIANQQEQTPTQATTKSATLGRIPSVRSAPVATAALTAMTNDQPIPVPIPTSVTATATATATQFGAPPCIAPATQASRSIGAPSDRLRTLPKISVTIDEQARTEPTNEPPEESAGTQAASFGIRPRSHSQARSQEERLAARLREADIGLVGSPTTTTDEDEAGRA

SEQ ID NO: 9183 - protein, 58 aa, Brassica napus
MVLWELALGTTYFLGLKRSYRLALKTQRRFGRPNYSRIRQFFHRRTYQIFDVALRVHK

SEQ ID NO: 9184 - protein, 246 aa, Ustilago maydis 521
MNIVESLFGRAKSPAERLRQHQRTLQKAQRELDRERTKLEQQEKKLTQDIKKSARAGQMPACKVMAKDLVRTRRHIHKFYQMKTQLQAVSLRIQTLRSNQQMAEAMKGATRAMGTMNRSMNLPAIQRIMRDFERESATMDMKDEMMGEAVDEAMDDEDEGVGEEEESDNILKEVLDEIGVSVGQQLGEAPTAALSAPLAAPQQRIAIGEGASGGGGFGGGGGGGGGGGASKDEDALQARLDNLRRD

SEQ ID NO: 9185 - protein, 145 aa, Glycine max
MGAFTDKQEALVSSSFEAFKTNIPQYSVVFYTSILEKAPVAKDLFSFLANGVDPTNPKLTGHAEKLFGLVRDSAGQLKASGTVVIDAALGSIHAQKAITDPQFVVVKEALLKTIKEAVGDKWSDELSSAWEVAYDELAAAIKKAF

SEQ ID NO: 9186 - protein, 477 aa, Neisseria meningitidis MC58
MSQYDVVVIGAGPGGYVAAIRAAQLGFKTACVDAGVNKAGNAPALGGTCLNVGCIPSKALLQSSEHFHAAQHEFAEHGITVGDVKFDAAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 9187 - protein, 717 aa, Kluyveromyces lactis NRRL Y-1140
MAVQTAGSDVSQSNASVSTVPTSHDSFIPKYTKKPLSHLDIDGSDQPFDRVQLTKLLIDALKQIGYEETAITLQKESGGILVESTHVKSLFSAIKEGRFYHCTLDLLLQLPIFLESLELSGDLSHVELPQTKRNISTTIIDHFLAEYEKLGFVMKRLSEFKDVDIVKLTICVEMLVAIQTLAFSEILMSDRRMALELLRLVIRPTISIWDTLLTLQTMKYDSEIQWQTGNDVMYSNSFSSFQPEHLLSQLSTLIVCGQNSNAAPFVTREATFEHIAHFINPNDLVPRGRLMQLLKQAIQYQRSRDLLSFHIEDSSTGTKRSASSTYNLLQDNVTKSTQFQFDNIKTLNRNNDEIWFLQFSSDGRFLASASPSKKFERKIIIYDVKNNFEIYAICCETRQSVLYLKFSPDNTKLIACSINSAAKIYDLNQLSPPTYDGYLCEYDQLKPVASVFVTFPTTSDSSAISSNNTPASAETMRLWCGDWFHDPELKDFIVLGSPDSDVIIYDMKTATIFARISMTMGEDLKSSFPHVHDIKISSDDNDLIVMNNEKYIDVFDISTLKYCIKENATFVSPRKRRLLIGKRMTGMQFPDTSQCSPDPSLSSLLLVSIQNQELQLWDYQRDILIQRYIGQIQSNFIIRSCFGYYSNFIASGSEDGKIYLWDRFYGNIIGVIPAHSENSTSSQSKICNIVAWNPQDQTMFASGGDDGLVKVWRVSAT

SEQ ID NO: 9188 - protein, 501 aa, Oryza sativa (japonica cultivar-group)
MAGKKRKSASSDKQPKQQQQRLPLGADADAVADAAKRRRSGASKKHQAEEEASIPSSLSAKILREALTQQQEESLADQRPAAAATAAPSPSFSFPVPKKDGEEDEDDDDVDEFDGFDAQSEYDGGVPEIDEEDEKALAAFMSKDTSSKRSLGDIILEKIREKDAEISTEGRTPVKLDSSIIELYKGVGEFLSRYTSGKIPKGFKRIPSLECWPDVLQLTEPENWSPNAVYQATRLFSSNMNAKNAVRFYEAILLPRVRNDIRKNKRLHFALYQSLKKCLYKPAAFFKGILLPLCQERNCTLREAVIIGSIISKVSIPPLHASAALMKLAEMEYCGTTSYFIKLFLDKKYALPYRVVDAVFAHFMRFIDEERVMPVIWHQSLLAFVESYFIKLFLDKKYALPYRVVDAVFAHFMRFIDEERVMPVIWHQSLLAFVERYKNELEKKDKEKLARLLDHQKHYLVTPEIRRELRMSCNRGEKDTIMSIYILTVHADSYLFCIIIH

SEQ ID NO: 9189 - protein, 677 aa, Oryza sativa (japonica cultivar-group)
MLSCSGNMLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLCPNNRGAHIIYDGCVLTFSGRDFLGAATNPADMERKLRNTENVTVSDVGEFNGAIYEVLNATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSTAMSLNDVTVTEPEPR

SEQ ID NO: 9190 - protein, 647 aa, Oryza sativa (japonica cultivar-group)
MHGGGARALAAAFVLALLAAAPAASEVVCSGRRYAANSSFDASLQQVARTLPGNASSSPLLFATLAVAGEAYALALCQGGTSAGSCNYCVAQTMRDGEHACAGDADVAMYDDICTVRFSDRDFLAATTNSPEKLVVAGSQSQKLVPSAAGRFYRLVGELLDATADYAVANSTARFATGDVGVGGYFDGEPFSKIYALAQCTPDLTPAQCRACLASAMEEMTRQVFAASSPGGKVIGERCGLRFEVFSFYTVDAMVHLQVAMEGKKKSTPVLAIVLPIVFAGLLTIIIVSFYIWRKKRLPTKTPLIENTEDLEDFESIFIDLSTLQSATSNFDESNRLGEGGFGVVFKGVFPDGQEVAVKRLSNCSNQGLGQLKNELSLVAKLQHKNLVRLIGVCLEEGEKVLVYEYMPNKSLDTVLFDPEKSKQLDWGKRYNILYGIARGLQYLHEHSQLKIIHRDLKASNILLDSDMKPKIADFGMAKIFGDDQTRNATSRVVGTLGYMSPEYAMRGQYSTKLDVFSFGVLVLEIVTGRRNSYAVVSEHCEDLFSLVWRHWNEGTVTEIVDPSLGNHYSRGDILKCINIGLLCVQQNPVDRPPMSAIILMLSSGTVTLQAPYRPAYIFGRNRSYTETMDVPLPSGPHSSITELEPR

SEQ ID NO: 9191 - protein, 336 aa, Buchnera aphidicola str. APS (Acyrthosiphon pisum)
MRILGIETSCDDTGIAIYDTNKGLLINEIYNQRKLNNIYGGIIPELASREHMEAMIVLLNKIFKKKNIYKYVDMIAYTAGPGLIGSLLVGATFACSLGLSLNIPVLPVHHMEAHLLSPMLDYKTIQFPFIGLLVSGKHTQIIGAHKFGEYEILGNCLDDAAGEAFDKTAKLLGLKYPGGLELSKLASKGIKDYFYFPRPMIHHSDLNFSFSGLKTFAAQTIKKSSKSMQEKANIAKAFEDAVIDILLIKTKKALKKQKWKRLVIAGGVSANQKLRKKSEIMVKKNFNGTVFYSSLEFCTDNAAMIAYLGSLRQKEARNSQLEILVKPKWSIDDLCF

SEQ ID NO: 9192 - protein, 534 aa, Schizosaccharomyces pombe
MSNESIYSVLDLTQVIFEDRYLVKQKLGDGSFGTVYLAQRKEKNGLYETALRKISKHPCLIDLLETFMDPYRNIFLVMEFMDCNLFQLFKRRQGRLFTKETAFNILLQIISGIEHIHKHGFMHRDIKPENILVKRISPKPISSRYSIKLGDFGLARPSVSSDPLTEYVSTRWYRAPELLLRSGSYNHSVDLYAFGCIVFEIYSLKPLFPGRNETDQLNRVCEILGNPGIDELDTLHYWSQAKELAKRLGFMLPPTKPYPIQKLLPQNCPEGHAKMIPCLLAWNPDVRPTAKYCKEVFFPLPPSASKSNSVPQKISNPKVEQNLGFPISREDKKSTRRVGWLKKNLSEFVSSVKSVFPDSHGSQPHVKTEKPINAKESTGHLANPIASSNVPAISLKPGELHESVFFSENEQIDYLLTSIDYLPSYKPPSNGSNIAINAFNETVGDRIPSSKDILITEKIPFKKENEIRDSIVPSCSQPDESNKEGVASCLLLQKSGMEMTSVLEYSTPNPAEVQNICNDHAKFETSKSLHLSSP

SEQ ID NO: 9193 - protein, 87 aa, Triticum aestivum
HGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 9194 - protein, 892 aa, Oryza sativa (japonica cultivar-group)
MVSSRFVAVLLLVALAPAARGQGGGGGNSSAPAASPPGPFVPRDNILLDCGATGQANDTDGRLWTGDTGSKYLPANLAAAAATAQDPSVPQVPYLTARFSAAPFTYSFPVGAGRKFLRLHFYPANYSNRNAADALFSVSIPDPNITLLSNFSAYQTALALNFDYLVREFSVNVTASTLDLTFTPEKGHPNAFAFVNGIEVVSSPDLFGSSNPMEVTGDGSGTPFPIDAGTAMQTMYRLNVGGNAISPSKDTGGYRSWEDDTPYIPFASFGVSYANDTNVPINYPDSIPQYVAPADVYSTARSMGPDNNVNLQYNLTWAMQVDAGYQYLVRLHFCEIQSGISKINQRTFDIYINNQTAFSGADVIAWSTGLGIPVYKDFVVFPMGSGPMDLWVDLHPNVKNKPQYYNAILNGMEVFKLQLTNGSLAGLNPVPSIVPTASGGNSGKKSSVGPIIGGVIGGLVVLALGCCCFFVICKRRQRAGKDSGMSDGHSGWLPLSLYGNSHTSSSAKSHTTGSHASSLPSNLCRHFSFVEIKAATNNFDESLLLGVGGFGKVYRGEIDGGATKVAIKRGNPLSEQGVHEFQTEIEMLSKLRHRHLVSLIGYCEEKNEMILVYDYMAHGTLREHLYKTQNAPLSWRQRLDICIGAARGLHYLHTGAKHTIIHRDVKTTNILLDEKWVAKVSDFGLSKTGPTMDHTHVSTVVKGSFGYLDPEYFRRQQLTDKSDVYSFGVVLFEVLCARPALNPTLAKEEVSLAEWALHCQKKGILDQIVDPHLKGKIAPQCFKKFAETAEKCVSDQGIDRPSMGDVLWNLEFALQMQESAEESGSLGCGMSDDSTPLVIVGKKDPNDPSIESSTTTTTTTSISMGEQSVASIDSDGLTPSAVFSQIMNPKGR

SEQ ID NO: 9195 - protein, 348 aa, Pyrococcus horikoshii OT3
MSEKMVAIMKTKPGYGAELVEVDVPKPGPGEVLIKVLATSICGTDLHIYEWNEWAQSRIKPPQIMGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELMRAGKTGKVVFMLK

SEQ ID NO: 9196 - protein, 556 aa, Pyrococcus horikoshii OT3
MPKFDVSKSDLERLIGRSFSIEEWEDLVLYAKCELDDVWEENGKVYFKLDSKDTNRPDLWSAEGVARQIKWALGIEKGLPKYEVKKSNVTVYVDEKLKDIRPYGVYAIVEGLRLDEDSLSQMIQLQEKIALTFGRRRREVAIGIFDFDKIKPPIYYKAAEKTEKFAPLGYKEEMTLEEILEKHEKGREYGHLIKDKQFYPLLIDSEGNVLSMPPIINSEFTGRVTTDTKNVFIDVTGWKLEKVMLALNVMVTALAERGGKIRSVRVVYKDFEIETPDLTPKEFEVELDYIRKLSGLELNDGEIKELLEKMMYEVEISRGRAKLKYPAFRDDIMHARDILEDVLIAYGYNNIEPEEPKLAVQGRGDPFKDFEDAIRDLMVGFGLQEVMTFNLTNKEVQFKKMNIPEEEIVEIANPISQRWSALRKWILPSLMEFLSNNTHEEYPQRIFEVGLATLIDESRETKTVSEPKLAVALAGTGYTFTNAKEILDALMRHLGFEYEIEEVEHGSFIPGRAGKIIVNGRDIGIIGEVHPQVLENWNIEVPVVAFEIFLRPLYRH

SEQ ID NO: 9197 - protein, 552 aa, Pseudomonas syringae pv. syringae B728a
MYVYDDYDQKIIEDRVKQFRDQTRRYLVGELSEEEFRPLRLQNGLYVQRFAPMLRVAVPYGQLTSRQARMMAKIARDYDKGYAHISTRQNVQFNWPALEDVPDILAELATVQMHAIQTSGNCLRNVTTDQFAGVAADELVDPRPWCEIVRQWTTFHPEFAYLPRKFKIAINGSTSDRAAIEVHDIGLEPLRNEAGELGFRVLVGGGLGRTPVVGAFINEFLPWQDLLSYLDAILRVYNRYGRRDNKYKARIKILVKALTPEVFAAKVEAEMAHLRGGQTTLTEAEVQRVSRHFVDPQYKVLSDQHAELAALDAQHPGFARWRQRNVLAHKKPGYIAVTLSLKPTGVAPGDVTDKQLDAIADLADRYSFGQLRTSHEQNIILADVEQRELFTLWNELRDNGFATPNIGLLTDIICCPGGDFCSLANAKSIPIAESIQRRFDDLDYLFDIGELDLNISGCMNACGHHHVGHIGVLGVDKKGEEFYQVSLGGSASRDASLGKILGPSFAQEAMPDVIEKLIDVYVEKRTEDERFIDTYQRIGIDPFKERVYAANH

SEQ ID NO: 9198 - protein, 196 aa, Oryza sativa (japonica cultivar-group)
MKGLLKGLRYISQIFDPSVKEPEMQIGNPTDVKHVAHIGWDNASVTAPSWVIAAALLLPPDRAISHVSNCSDHWSQMNEFKPTAGGTEGGEAEENQGGGGGRADQAERPRRAGRGKERRDGGSEGSRRPPKTEVGENNCEGEAAAGAAPKQRRRKARASGGTSSGRSKSSSVGGGGGPSAAARPAAAGDDDGDKCF

SEQ ID NO: 9199 - protein, 416 aa, Ustilago maydis 521
MSLSSKLGITDVDLKDKKVLIRVDFNVPMDGDKITNNQRIVAALPTVKYAIEQNAKAVVLMSHMGRPDGKPVPKYSLKPVAAEVSKLLNKDVEFLADCVGAETEKAVESATGGKIFLLENLRYHVEEEGKGTNEAGEKVKADPKKVEEFRASLTKLGDVYINDAFGTAHRAHSSMVGVQLPQRAAGFLMKKELEFFAKALESPERPFLAILGGAKVSDKIQLIDNMLDKVNSLIICGGMAFTFKKTLDNVKIGTSLFDEAGSHKVAELVEKAKKNNVELVFPVDYITADKFDKNAKTGSATDADGIPDEWMGLDAGEESRKKFRETILKAKTILWNGPAGVFEFDNFAGGSKAMLDACLEAEKNGSTVIVGGGDTATVVAKYGAEDGISHCSTGGGASLELLEGKTLPGVKELSEK

SEQ ID NO: 9200 - protein, 107 aa, Kluyveromyces lactis NRRL Y-1140
MPSAATIARVQGLINSSKIFVASKTYCPYCQATLKTLFEEKKVDKKLATVLQLNQLEDGSDIQDALAEITGQKTVPNIFINGKHIGGNSDLQELNNSGDLDKLLASL

SEQ ID NO: 9201 - protein, 357 aa, delta proteobacterium MLMS-1
MEIKKQLLAPTERRSLPDEKEFGFGRIFSDHMLVMPYDADLGGWQEPVIKPYENFSLDPAAMVLHYGQAIFEGLKAYRGREHRICLFRPQANLERMNRSAARMCMPPLPLDIAMECLRELVRTDADWVPDGDQGATLYIRPTMVATEAGLGVRPARQYLFFIILSPVGAYYPEGFNPVRIYVTDTHVRAVPGGVGEAKTAGNYAASIMAAVEAQKLGFTQVLWLDACHRHYVEEVGTMNIFFVLNDCVITPPLTGSILPGITRESVLELLRDWGLRVEERQITIDEVFTANQQGELQEVFGTGTAAVISPVGSLHYQGRDCEINQGQTGKLSRRLFDELTAIQYGHKPDPHGWVTTL

SEQ ID NO: 9202 - protein, 568 aa, Secale cereale [sequence omitted]

SEQ ID NO: 9203 - protein, 487 aa, Rubrobacter xylanophilus DSM 9941
MSETQTREELVSYPAIIGGERVSPERSFEDVDPSTGRPCALVARCGRQEVDRAVEAAREAHEKAWRRSTPAERARVLHRISQLLRRDHEEIARLESLDTGKPLSQARADATVAARYFEFYANTIESFYGETIPALPDAFVYTLREPHGVTGHIIPWNYPIQISCRSVAPALATGNCCVLKPAEEAPLTALRLGELALEAGLPPGALNVVPGYGEEAGAALAAHPGIDHLSFTGSVEVGRLVSRSAADNVVPVTLELGGKSPNIVLADADLERAVPVIVNSIIQNAGQTCSAGSRLLVESRLHGELVERVASRFQEIRIGPGPEDPDLGPIISEAQRERVKGYVETGRREAELVTGGGVPQDPRLAGGFYFEPTLFDRVEPGSTIFREEIFGPVLAVSTFEEAEEAAALANATDYGLIAAVWTRDVGKAHWLARELRVGQVYINTYGAGGGVELPFGGFKKSGHGREKGYEALYEYTQVKTVALSYAR

SEQ ID NO: 9204 - protein, 243 aa, Triticum aestivum
MGSDFKAIPLIDISPLVEKIDDPAMAGDEGLLDVVRMLDDACREAGFFYVCYTPIEPGRYGDLAKPMEGSNLWPDYPSNFDALLENYISLLRDLSRKIMRGIALALGAPLDAFEGGVAGDAFWVLRLIGYPISDDIPQEERTDIGCGAHTDYGLLTLVNQDDDICALEVRNQSGEWIYAKPVPGTFVCNIGDMLKVWSNGIYQPTLHRVVNNSPRRRVSVAFFYESNRLSRRTPWARCPRPSL

SEQ ID NO: 9205 - protein, 797 aa, Cryptococcus neoformans var. neoformans B-3501A
MSASYNGIEAPIPRDQATDFPIQTFYASTESPELDQKQEDNVDLEKNESTDNVEVKVESIKDPGVELTPNEAFRWNVDGDQSPFPEVAACVPNTDDPSIPCNTVRAWILLTVFVVLFAGVNQFFGLRYPSLTIGYVVCQLLVFPIGRAWEKLPKWVVPLGPFSFYLNPGKFTIKEHALIVICVNLTASTAYAMGSLVAIISPVYWNSDFGAGFSFVYLLTTQALGFGLAGLARRWLVYPAALIWPSSLASTVLFRALHEPQSRSPANGWTITRYRFFVYLTIGAFIWFWFPDYIWTSLSTFAFITWIVPHNQKVNTIFGMNSGLGLLPISFDWTQINYAGYPLTTPFYITCNAFAVVVFFYLFLSPILYYKNVWHSAYLPLLSSSTFDNTGSSYNISRVVDEKLDFVLAKYQEYSPMYISMSYSLTYGLSFAAVTSIVFYTYLYSGKEIWAKFKDAKHGGEDIHKRLMSSYKEVPDWWYGVLTLVVLGLGIFTCRYWDTQLPVWGFIVVCFGMGLVLIVPEGILEGTTNQRIFLNIITELIAGYAWPGKPIANMLVKCYGYNSVKHGMDFAQDLKLGQYMKIPPRTLFWAQIYSTLLATMTQTGVLRWMIGNIKDLCQPTNSDRFTCAGAKVVYNASLIWGTIGPQRMFQAGQVYNGLMYFFLIGPVVTVLVYLVYRRYPSSWVKYINVPVFFNAAGNIPPANTTQYSLWFIFGFIFNYLIRRRAFAWWKRYNYLTQAAMDTGTALATIIIFFALSYNGVKLNWWGNTVGSDTDDAKGTPWLTVPSGSYFGRGPGEF

SEQ ID NO: 9206 - protein, 559 aa, Clostridium tetani E88
MEKVLTDIEIAQKAQMKPIGEIAEKYGILEDELELYGKYKAKLSLDIFDRLKDEKDGKLVLVTAISPTPAGEGKSTTSIGLGQALNKIGKKTFIALREPSLGPVFGVKGGAAGGGYAQVVPMEDINLHFTGDMHAIGITNNLLSAAIDNHIHQGNALKIDSREIVWKRVVDMNDRALRNVVVGMGGKACGFTRQDGFMITVASEVMAILCLAKDLMDLKERLGNIIVAYSLEGKPVTAGDLKVNGAMAMLLKDAIKPNIVQTLENTPALIHGGPFANIAHGCNSLIATRLGLKLGDILVTEAGFGADLGAEKFLDIKCRYGGLKPDAVVIVATIRALKMHGGVKKTELSGENLEALDKGFANLQKHITNMKNFGLPVMVAVNRFITDSEAEIDLLIKKCKEIGVEVSLNEVWAKGGEGGIEMAEKLVKILETEKPNYKPLYDVEDSIPEKLNKIVKELYGGEGVVIESSAMKQIKKLEEIGLDKLPICMAKTQFSFSDDATLMGAPKGFNITIKNVRVSAGAGFIVCETGNIMVMPGLPKVPAAEKMDVDENGNISGLF

SEQ ID NO: 9207 - protein, 373 aa, Erwinia carotovora subsp. atroseptica SCRI1043
MQMIKTRAAIAWGPNQPLSVEEVDLMPPQKGEVLVRIVATGVCHTDAYTLSGKDPEGVFPAILGHEGGGIVEAIGEGVTSVAVGDHVIPLYTPECGECKFCRSGKTNLCQAIRSTQGKGLMPDGTTRFSKNGQPIFHYMGTSTFAEHTVVPEISLAKVNKEAPLEEVCLLGCGVTTGMGAVLNTAKVKAGDTVAIFGLGGIGLSAIIGAHMAGAGRIIGIDLNTSKFDLARKLGATDLLNPKDYDKPIQDVIVELTDGGVDFSFECIGNVNVMRSALECCHKGWGESIIIGVAGAGEEIATRPFQLVTGRVWRGSAFGGVKGRSELPGLVDRYLKGEFPLNDFITHTMGLDDINTAFDLMHEGKSIRTVIHFG

SEQ ID NO: 9208 - protein, 885 aa, Rhizobium leguminosarum bv. viciae 3841
MAAEVKTTCPYCGVGCGVLATVDEAGAVSVKGDPEHPSNFGRLCSKGSALAETIDLDGRLLHPEIEGKQSGWDEALDLVARRFSETIAEHGPDAVAFYVSGQLLTEDYYVANKLMKGFIGSGNIDTNSRLCMSSSVAGHRRAFGADTVPGTYEDIELADLVILTGSNLAWCHPVIYQRLAAAKTARPNMRIVVIDPRRTMTCDIADLHLAIRPDGDVALFMGLLAHLATSPAIDQNYIGAHTEGFGDAFAAAAALDINDLLERTGLPAMQIREFFRLFETTPKVVTCYSQGVNQSSSGTDKVNAILNCHLATGRIGRPGMGPFSLTGQPNAMGGREVGGLANMLAAHMAIENSEDRDRVQRFWNSPVIAAKPGLKAVDMFQAVADGRIKALWIMATNPVVSMPDADSVESAIAACPFVVVSDILKETDTTRHANVLLPSLGWGEKDGTVTNSERRISRQRPFLDVPGDARADWWQLAEVGRRMGFAAAFDFDAPAAIFDEHAALSAFENNGSRDFDIGARAGLSGGAYDELSPFQWPQAAGTEPSITRFFAEGGFFHPDRKARFVAVKPPATDRTNAEYPFTLNTGRIRDQWHTMTRTGKSARLSAHIAEPFAEIHPRDAIETGIASAGLVEIDSPHGKAIVRALVTDRQARGGIFAPMHWNDQFAARARIDAVVAPITDPISGQPASKNVAVAVRPFRATHYGFAVSATKPATPDAAYWALAKAAGGWRLELAFGETVEDWTAWCRAVFAIPAEIEPLGYADRQSGDLRLAFFDGEVLLAALFLAREPVAVARNWAISQLSASHGDLRKRFALVAGRPGAGRPDPGATVCSCFSVGVNQIAAAVRGGCHSVEAVGKETSAGTNCGSCRSEIGSIIDRCLAAAAE

SEQ ID NO: 9209 - protein, 816 aa, Rhizobium leguminosarum bv. viciae 3841
MTEKLVIIGNGMAPGRMLEHLFEQAPGRYEVTIFNAEPRVNYDRIMLSPVLSGEKDYEQIIIHGDGWYIKHGIMLYKGHKIVNIDRAAKTVTSDHGVTESYDKLVIATGSVPFIIPVPGKDLPGVITYRDLDDVQAMLLAAQSREKAVVIGGGLLGLEAAAGLAQRGMDVTVLHVMPTLMERQLDPAAGYLLQKAVEERGIKVICKANTKAIVGNGKVEGIELDDGRIIPATLVVMAVGIRPSVGLAKDAGIAVNRGIVVDAGMQTSDGDILALGECAEVGGMVYGLVAPLYEMARIAASHLSGDRSPAFVHADTPTKLKVTGIELYSLGDFADGDDREEIVLRDASAGVYKRLVLKDNKIIGTVLYGETADGAWFNDLKKKATDISEMRETLIFGQAYQGGSPLDPMAAVAALPDDAEICGCNGVCKGKITSTISGKGLTSLDDVRAHTKASASCGSCTGLVEQLMALTLGDSYNPTAVQPMCTCTELGHDDVRRLIKAKGLKSIPAVMQELEWKTSCGCAKCRPALNYYLVCDWPDEYADDYQSRFINERVHANIQKDGTYSVVPRMWGGVTNSNELRAIADVVDKFEIPMVKVTGGQRIDLLGIEKEDLPAVWADLGKAGFVSGQAYAKGLRTVKTCVGSDWCRFGTQDSTGLGIRIERFMWGSWTPAKLKMAVSGCPRNCAEATCKDIGVICVDSGFEIHFAGAAGLDIKGTEVLGLVRTEDEALEYIVALTQMYREQARYLERIYKWAKRIGLEEIRRQIMGDAEKRKAYYERFVFSQKFAQVDPWSERVSGKDKHEFKPMATIGYPQAAE

SEQ ID NO: 9210 - protein, 331 aa, Methylobacillus flagellatus KT
MNILDPIMHTLMPETDQYSGMEPKTRAFLEELAASDSKPVEALSPEEARKVLSDLQAGVDVELGGVTVEEREIAIEGHSIHLFIVKPADIAISPPVVMFFHGGGWVLGDFPTHQRLVHDLCVASNCAVVFVDYSRSPEVKYPTAIIECYLATKWVAQNGAEIGVDPARLAVAGNSAGGNMAAVVCMMAKEKREPFIKHQTLFWPVTDARFNTDSYQQFDEGYFLTRNMMKWFWDNYLENKDARKEIYASPLNASLEHLADLPPALIQTAEFDVLRDEGEAYAHLLMDAGVSVTCTRYLGAIHDFGLLNPLAKTPQAYASIMQAAGEIRKHI

SEQ ID NO: 9211 - protein, 253 aa, Archaeoglobus fulgidus DSM 4304
MEDEIRKAAEILAKSKHAVVFTGAGISAESGIPTFRGEDGLWRKYDPEEVASISGFKRNPRAFWEFSMEMKDKLFAEPNPAHYAIAELERMGIVKAVITQNIDMLHQRAGSRRVLELHGSMDKLDCLDCHETYDWSEFVEDFNKGEIPRCRKCGSYYVKPRVVLFGEPLPQRTLFEAIEEAKHCDAFMVVGSSLVVYPAAELPYIAKKAGAKMIIVNAEPTMADPIFDVKIIGKAGEVLPKIVEEVKRLRSEK

SEQ ID NO: 9212 - protein, 585 aa, Candida glabrata CBS 138
MSLPTLIRNLTRPKTPIVGVAKSRFYNKRWVQVLGLSVGTSCILYETNENFHNTVRHGYISFKRIGVVTIALSRCVIQYKKVLSLNDTIDDEDQKDENLRQCHLKAANITLKALEKNGGVFIKLGQHIGAMSYILPLEWTQTMVPLQDHCPESSLDDIDRMFAKEIPGEDLTTYFEWIDDEPLGVASLAQVHRAKLKQGTKEVVAVKFQHPQLQEFVSVDVMMTKFVFATLDKVFPQYSLVWLADELHSSIYDEINFNKEAQNAELTAKFFNKNKKLKRATSVRVPKVLLHKDRVLIMEYIGGARLDDPTYLEDHNIKRNEVSESLAHIFNSMIFTKDAGIHCDPHMGNLSIRTCKPTKENGYHNYEIVLYDHGLYRYPDLKTRRNYAKFWLSLLRHDQNEMRKWSYELAGITDDEFPLFAAAITGRSVESALNYDIDSVRGNDEIEIMRKRMLDKASMPADLEGTSTQGEENKLLKQLMKILAHIPRIVILLLKTNDLTRYLDESLRNPLGPARGFLILTSYCSSLVLQEDLETAAAMWKDNIYIKAATQYIAAWYKYIATAYVRTTAYEIILFSRDCYKKLAH

SEQ ID NO: 9213 - protein, 648 aa, Mycoplasma pneumoniae M129
MKNLFACQHLALSAIQHAKGGHVGMALGASPILYTLWTKHIQFNPNCPKWINRDRLVMSAGHGSMALYPILHFAGLITKQEMLHHKYGQVNTSSHPEYAPNNFIDASTGPLGQGLGMAVGMALTQRVLAAEFKALSPKLFDHFTYVVVGDGDLQEGVSYEVAHLAGVYQLNKLIVLHDSNRVQMDSVVRDVSLENLQTRFTNMGWNYLETSDAVADIDAAIKQAKKSDKPTFIEVHTTIAKNTTLEDQPAGHWFIPTDKDFARFNSNTKTNFTPFEYPQTVYDFFHKQVIARQAKPVQAYKELLEKLKDKPLYTKFINWTENDYQALYLNQLDERKVAQANAATRNYLKDFLGQINNSNSNLYCLNADVARSCNIKLGDDNLHTNPHSRNIQVGIREFGMSTIMNGMALHGGVKVMGGTFLAFADYSKPAIRLGALMNLPTFYVYTHDSYQVGGDGPTHQPYDQLPMLRAIENVQVWRPCDEKETAAGVNYGLLSQDQTNVLILTRQALPSLEQSDSVQTLKGGYIISNRKQPDVIVAASGSEVQLALQLEQALNEQQLKTRVVSVPNINMLLSQPQSYLQQLFDPNSVLLTLEASASMEWYALAKYVKKHTHLGAFSFGESNDGQVVYEHKGFNVTNLLKLIKTLKS

SEQ ID NO: 9214 - protein, 180 aa, Zea mays
SASAFHRLSPFPVFIAVDSARKAMEFLGLKDGGEEQAVDMVLTDYCMPEMTGYDLLKAIKALNPLEPIPVVVMSSEDEPQRISRCLSAGAEDFIVKPLQSKDVQRLRNCSAAARPSKGAAPCEAAVVAKRNQKPPHPAGAASPSGRRASLAGVAMVLHSSGVEYLRLLLKLVVLAYAALC

SEQ ID NO: 9215 - protein, 529 aa, Triticum aestivum
MKMSPERKGAEDKEEGSRMASAALPEPGAVHPRNKGNFKYAFTCALCASMATIVLGYDVGVMSGASLYIKRDLQITDVQLEIMMGILSVYALIGSFLGARTSDWVGRRVTVVFAAAIFTTGSLLMGFAVNYAMLMVGRFVTGIGVGYAIMVAPVYTAEVSPASARGFLTSFTEVFINVGILLGYVSNYAFARLPLHLSWRVMLGIGAVPSALLALMVFGMPESPRWLVMKGRLADARAVLAKTSDTPEEAVERLDQIKAAAGIPRELDGDVVVMPKTKGGQEKQVWKELIFSPTPAMRRILLAALGIHFFQQATGSDSVVLYSPRVFQSAGITGDNHLLGATCAMGVMKTLFILVATFQLDRVGRRPLLLTSTAGMLACLIGLGTGLTVVGRHPDAKVPWAIGLCIVSILAYVSFFSIGLGPLTSVYTSEVFPLRVRALGFALGTSCNRVTSAAVSMSFLSLSKAITIGGSFFLYAGIAAIGWIFFFTFIPETRGLPLEEIGKLFGMTDTAVEAQDTATKDKAKVGEMN

SEQ ID NO: 9216 - protein, 350 aa, Schizosaccharomyces pombe
MRKGAGDKYLLILALVFLYTKENSIYFTLHRVNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 9217 - protein, 491 aa, Erwinia carotovora subsp. atroseptica SCRI1043
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 9218 - protein, 416 aa, Streptococcus pneumoniae TIGR4
MKTPFINREELEAIVAEFPTPFHLYDEKGIREKARAVNQAFSWNKGFKEYFAVKATPTPAILKILQEEGCGVDCSSYVELLMSHKLDFLGSEIMFSSNNTPDKEYAYARELGATINLDAFEDIEHLERVAGIPEIISCRYNPGGVFELGTDIMDNPGEAKFGMTKDQLFEAFAILKEKGAKTFGIHSFLASNTVTHLYYPELARQLFELAVEIKEKLGISLDFINLSGGIGVNYHPDQEPNDIALIGEGVRKVYEEVLTSAGLGQVKIFTELGRFMLAPHGALVTRVTHKKETYRTYLGVDASAVNLMRPAMYGAYHHISNVTHPDGPAEVVDVVGSLCENNDKFAVNRELPHTEIGDLLVIHDTGAHGFSMGYQYNAKLRSAEILYTEEGKARQIRRAERPEDYFATLYGFDFEE

SEQ ID NO: 9219 - protein, 468 aa, uncultured bacterium 578
MIKTQVLVIGSGPGGYTAAFRAADLGKEVVLVEKYKSLGGVCLNVGCIPSKSLLHTAQIINEAKHASQLGISFGDTKIDINGVRKNKESIVNKLTAGIQALAKARKVKVVTGHAKFLSKNQVGLEGTDEVIEFEHCIIAAGSRVTKLPMFPFNDERVMDSTDALMLDDIPKRLLVVGGGIIGLEMATIYDALGSEITIVELEGQIIPAADKDIVSPLLKRIKKNYANIFLNTKVTKMTASKKRIKVNFEGKDAPKTDTFDKVLVAVGRSPNGQMIGAENAGVNVDQNGFISANNQMQTNVDNIFAIGDIVGQPMLAHKATHEAKVAAEVICGQKSGFDALTIPSVAYTDPEVAWTGKTEKELTEEGIKFDKGVFPWAASGRSLSIGRSEGVSKGLFDAKSGKILGMGICGTNAGDLISEASLAIEMGCDMSDIALTIHAHPTLSETTAFAAEMVEGTITDLMPPKKKK

SEQ ID NO: 9220 - protein, 328 aa, Oryza sativa (indica cultivar-group)
MDNYVNLLGSNIDVENWDPSQNFPPTGQQPQHSPMVGEQPSAEVGGSSRPNNKRSKNFSTAEDQMLVSAWLNTTLDTITGVEQHRDSYWARIHQYFHENKNFPSDRNQNSLNNCWGTIQEQVNKFCGYYEQILNRPQSGMVVQDYITQAFTLYKSAEKKTFSLMHCWEILHHHPKWNDRLFQKRQKAHVDPLVRPSASTNSSEFHYSPDINTSDPLVRPPGKKVEKAKCPRGNTSSCSSESSPVVIALNNMWSEKKEMSAQSREERNDRLVEVISLEKERLKVEKRKLDIETHEREERIMNMDLSAMDGPRKTYYLRLQQEIIKAHMD

SEQ ID NO: 9221 - protein, 146 aa, Brassica napus
TIRSSTLRKFYHQRNVETLLLLSLLFCNDLTVAKATASTQLILLPSQHGDRTCSAPDPNLNDKPIIGILTHPGVGTFDAPHDHSLSYYEKNVSYIAASYVKFAETGGARVIPLIYNEPQERLFQVALMIYLSLEPDHLPTVITSST

SEQ ID NO: 9222 - protein, 365 aa, Candida albicans SC5314
MLSRRIIGLCCLVVLMSMLLTILSKKNGVSLGSSFIKTSARSFASSSRSYWGGYGKGSARDYSTAASPSATASAASMNYDSALTSVSHYNIAVAFQPKDREESNLFKKKQPSPSLQSPSGEDNLFVSNEKAGCIAVGVADGVGGWSEAGYDSSAISRELCASLRRQFESGTESNPKQLLSLAFKEVLSSPQVEIGGTTACLGVLTSDLKLHVANLGDSWCGLFRDSKLINETNFQTHNFNTPFQLAKIPEEIVRQAKLQGRRYIIDSPEAADEYTWDLKSGDVVMFATDGVTDNVIPQDIELFLKDHEETNQLDDVANKFVKEVVKVSKDSNFPSAFAQELSRLTGQKYLGGKEDDITVVLVKVK

SEQ ID NO: 9223 - protein, 561 aa, Nocardioides sp. JS614
MQIHPSHSTVHRTGSRADIRVPFTRVALTNGETFDRYATAGPGSDPEVGLPPLRADWIAQRGDTEEYAGRETQLLDNGRAAIRRGEARDQWRGTRSRPRRGTSTVTQMHYARQGVVTPEMEYVAIREGCNVDLVRSEVAAGRAIIPANLNHPEAEPMIIGRRFLVKVNANIGNSAVTSSIAEEVDKLTWAVTWGADTVMDLSTGDDIHTTREWIIRNSPVPIGTVPIYQALEKVDGDASRLTWEIFRDTVIEQCEQGVDYMTIHAGVLLRYVPLTAQRITGIVSRGGSIMAGWCLAHHQENFLYTHFDELCEIFARYDVSFSLGDGLRPGCTADANDEAQLSELRTLAELTQRAWEHDVQVMVEGPGHVPLNLVEENVVLQQDWCHGAPFYTLGPLATDIAPGYDHITSAIGAAAIAMHGTAMLCYVTPKEHLGLPNRDDVKTGVITYKLSAHAADVAKGHPGARDWDDALSKARFEFRWHDQFALSLDPHTAESFHDETLPAEASKTAHFCSMCGPKFCSMRISQDVRDYVTSGMAEKSAQFLELGSSVYVEGDTYTAAP

SEQ ID NO: 9224 - protein, 451 aa, Escherichia coli
GSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQELVPR

SEQ ID NO: 9225 - protein, 220 aa, Petunia integrifolia subsp. inflata
RVVNKMACEEILKAVFPFLEGTDLVTCMGVCKQWRDIARDDYFWKCLCSKKWPSICKRPSPPTITYYKLFQNFHKRQYRRTVLPPSLSFNDLEFYIDIWTEEKIIFSDVVPGPVLQKGIWIPPPGICDVLRFHLEGPEYKMTLPVEPRFTIPLCQTVSVSVLVGRKDTNKVACIIKKSLFDYIDRTAYRALAYDYLDLASPICLFVSGVRAWISLLSWTM

SEQ ID NO: 9226 - protein, 351 aa, Xanthomonas campestris pv. vesicatoria str. 85-10
MATMAAHFLHRLPVPMSRPSLTRFLIEEQHAGRIDAELRQLITIVSRACKRISIAVSKGTLGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 9227 - protein, 175 aa, Triticum aestivum
MPPTMMASSATSVGPFQGLKSTAALPVSRRSNGASLGSVSNGGRIRCMQSWPIEGIKKFETLSYLPPLSTEALLKQVDYLIRSKWVPCLEFTKVGFIFREHNASPGYYDGRYWTMWKLPMFGCTDATQVINEVEEVKKEYPDAYVRIIGFDNMRQVQCVRFIAFNPPGCEESGKA

SEQ ID NO: 9228 - protein, 1058 aa, Streptococcus pyogenes serotype M6
MPKRKDIQKIMVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQSLSDAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 9229 - protein, 369 aa, Novosphingobium aromaticivorans DSM 12444
MTSRRKKTPEKTDEGVSMKIAVLPGDGIGPEVTREAVRVIEALGLGDIEMKEAPVGGAAYKAYGHPLPPETLEIARLSDGILFGAVGDPDCDSLERHLRPEQAILGLRKALTLFANLRPARVFKGMEDFSALRPEVAGAIDLLIVRELNGDVYFGEKGFRTAANGDREGYDVMSYSESEVRRIAHVAFRAAMGRKKRLCSVDKANVLETSQLWRDVMLEVAKDYPEVALEHMYVDNAAMQLVRAPGNFDVVVTGNLFGDILSDQASMCVGSIGLLASASLGERETEYGTFGLYEPIHGSAPDIAGKGLANPMATILSAAMLLRHSLGLEVAADRIEAAVAKALADGVLGRDLGGTAGTTEIGDAVLARL

SEQ ID NO: 9230 - protein, 402 aa, Novosphingobium aromaticivorans DSM 12444
MKRTTGQDRSITRKWRPATQAIRGGTWRSEMGETSEALFLTSGFTYDDAATVAARFAGEAEGMTYSRLQNPTVQMLEERIALLEGAEACRTQATGMAAMTTALLCQLSAGDHIVAAKAAFGSCRWLVDNLLPRFGVQGTTIDASDNAAWEAAIRPNTKVFFFESPANPTMDIVDLEFVCGLAKKHGITTVVDNAFATAALQRPMDFGADVVAYSATKMMDGQGRVMAGAVCGSADWINNVLLPFQRNTGPNIAAFNAWVVLKGLETLDLRIHRQSENALKVASFVEKRVPRLLYPGLPSHPQHALAQKQMKAGGTIFSFDLDGGRAQAHALLDALQLIDISNNIGDSRSLMCHPASTTHHGVGPETRADMGVGEGMLRLNVGLEDADDLIEDLDQALRKAGL

SEQ ID NO: 9231 - protein, 138 aa, Cryptococcus neoformans var. neoformans JEC21
MARTKQTARKSTGGKAPRKQLATKAARKQTTTSAAGGVKKPHRYRPGTVALREIRRYQKSTELLIRKLPFQRLVREIAQDFKTDLRFQSSAVMALQEASEAYLVSLFEDTNLAAIHAKRVTIQPKDLQLARRLRGERS

SEQ ID NO: 9232 - protein, 432 aa, Myxococcus xanthus DK 1622
MTEISQILAREVLDSRGNPTVEAEVQLAGGARGRAAVPSGASTGEHEAIELRDGDKHRYLGKGVQKAVKNVVDVLAPALVGMDAADQFAVDQRMLELDGTATKGKLGANAILAVSMAAARAAADAHGLPLYRYVGGVQARTLPVPLMNILNGGAHADTRVDVQEFMVVPAGASSFAEGLRWGAEVFHALKKILKGRKLATGVGDEGGYAPDLPANEEALKLIMEAIDQAGFKAGEQLFLALDVAASEFFDKGSKKYKLKGEGKEYDSTGLLEYYRGLSERYPIISIEDGMAEDDWEGWKKLTDALGSRMQLVGDDLFVTNVERLGRGIETGTANSILVKVNQIGTLTETFDAVRMAHRAGYTSVMSHRSGETEDTTIADLAVALDCGQIKTGSASRSDRVAKYNQLLRIEGELGAAARYAGKSVFRALNQKK

SEQ ID NO: 9233 - protein, 134 aa, Cryptococcus neoformans var. neoformans JEC21
MSTGERIANKVAGIAPPLPVFSPAIISNGFVYTSGQIGAGPDGELVKGPITNRVNQIMDNLDAVLKAHGTSLEHTVKFTIFITSYETFAELNEAYSKRIPSPAPARSCIGVASLPKGTDVEIECVAVLPNKAKL

SEQ ID NO: 9234 - protein, 756 aa, Mesorhizobium loti MAFF303099
MRDQASGPRVLLKRLRELMQEPLEPQERLDRIVRDIASNMVAEVCSLYVLRADSVLELYATEGLNPNAVHLAQLRLGQGLVGTIAASARPLNLSNAQEHPAFAYLPETGEEIYNSFLGVPVLRAGRTLGVLVVQNKTMRHYRDDEVEALETTAMVIAEMIATGDLARLTRPGLELDLRRPVSFTGLSFNDGVGLGHVVLHEPRIVVTNLFNEDSEEEVRRLETSLGSLRLSIDDMLERRDVAFEGEHRQVLEAYRMFANDRGWVRRLEEAIRNGLTAEAAVEKVQSDMRARMLHMTDPYLRERMSDFDDLANRLLRQLMGRGPEDVAASLPKDAIIVARSMGAAELLDYPREKMRGLVLEDGAATSHVVIVARAMGIPVAGQMKGAVSMAENGDAIIVDGEEGVIHLRPQSDLEAAYAEKVRFRARRQEVYRELRKKPSTTRDGVQVDLLMNAGLAVDLPQLAEAGAAGIGLFRTELQFMVASTFPRAEAQEKLYRDVLEAARGKPVTFRTIDIGGDKVLPYFKGAIQEENPALGWRAIRLTLDRPGLLRTQIRALLKASGGRELKLMLPMVTELSEIAQAREIIDREVRHLSRFAHHLPTSLKLGAMLEVPSLLFQLDELMKAVDFVSVGSNDLFQFVMAVDRGNTQLANRFDTLSAPFLRVLKQIADAGIRNHTPVTLCGELAGKPISAMALIGLGFRSISMSPASIGPVKAMLTELPLDELTAFFDDNLMAPAQGLPMRALLQAFADDRSIPL

SEQ ID NO: 9235 - protein, 400 aa, Bdellovibrio bacteriovorus HD100
MIQLSKRAQNLKPSPTLFLVAKAKELAAQGHDVISLTVGEPDWPTFKGASDAGIEAIQKGITKYTPANGTVELRKSISEKLKSELGFEYSPKEITVASGAKYIIFSALQMICSPGDEVVIATPYWVSYPAMVELADGVPHIVECGEMENFKITPEKLEAAINAKTKGFLFCSPSNPTGLQYSADELKALAEVLRKHPQVVIISDDIYNRLVFDGTKVAPHILTVAPDLKDRTVLVNGGSKAYSMTGWRIGWASGPERLITAMADYQSQSTGSPSSISQHALLAAIKTSEADIKGVVDKLVARKNSGLKELETVPGFKTAEPQGAFYFWVDIRAHLGKSYQDRVIRTSKDFCDVLLEKFFVATVPGAECGTEGFMRLSFAVSEETMKRGVARMKDLVSQLV

SEQ ID NO: 9236 - protein, 400 aa, Bacillus cereus E33L
MMTYTLATRMKAFQSSIFSELGTYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKENDFLPNLELIPEEIADQAKMMILNFPGNPVPAMAHEDFFKKVIAFAKKHNIIVVHDFAYAEFYFDGNKPISFLSVPGAKEVGVEINSLSKSYSLAGSRIGYMIGNEEIVGALTQFKSNTDYGVFLPIQKAACAALRNGAAFCEKNRGIYQERRDTLVDGFRTFGWHVEKPAGSMFVWAEIPKGWTSIDFAYALMDRANVVVTPGHAFGPHGEGFVRIALVQDKVVLQQVVENIRNSGIFSLEKSEELVKN

SEQ ID NO: 9237 - protein, 116 aa, Petunia integrifolia subsp. inflata
MASPDIDVPMVPAGEGSTGVGPSTKKPKRFEIKKWNAVSLWAWDIVVDNCAICRNHIMDLCIECQANQASATSEECTVAWGVCNHAFHFHCISRWLKTRQVCPLDNSEWEFQKYGH

SEQ ID NO: 9238 - protein, 160 aa, Pyrococcus horikoshii OT3
MFQMSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 9239 - protein, 217 aa, Zea mays
  misc_feature (69)..(69): Xaa can be any naturally occurring amino acid
FLRGVSKGVFSSEFCGAEGPWGGPLAPSTLRERYTCPKNLLFLSSIIPLQPLQKVVVVDSHECATTVAXQSMIAEAPQDSSTQKKHAAAALGSFVGVQPYIELSNGRWAMLGSGEGMSAGYAAGSGLVVQGEIGLADFGIGGLESDGGFKQKECCWRRGSSSKDSICSIFFCLEKSSSCRSIPQRSLIQRALEVFIRYIRSKDIIRMMYGWRKKKKK

SEQ ID NO: 9240 - protein, 335 aa, Petunia integrifolia subsp. inflata
MALPHHHLQLHIQQQPQQQSKSYRDIYNNMDGQISTPVAYFNGSNLPEQSQHPPYIPPFQVVGLAPGLVDDGGLDLQWNYGLEPKRKRPKEQDFLENNNSQISSIDFLQPRSVSTGLGLSLDNGRLASSGDSAFLGLVGDDIERELQRQDAEIDRYIKVQGDRLRQAILEKVQANQLQTVTYVEEKVIQKLREKETEVEDINKKNMELELRTEQLALEANAWQQRAKYNENLINTLKVNLQHVYAQSRDSKEGCGDSEVDDTASCCNGRATDLHLLCRDSNEMKELMTCKVCRVNEVSMLLLPCKHLCLCKECESKLSLCPLCQSTKYIGMEIYM

SEQ ID NO: 9241 - protein, 209 aa, Ralstonia eutropha JMP134
MTQARTKKNPPLRVGVGGPVGSGKTTLLEMLCKAMRDRYDLVAITNDIYTKEDQRLLTISGALPAERIMGVETGGCPHTAIREDASINLEAVERMLAKFPDADVVFIESGGDNLAATFSPELSDLTIYVIDVAGGEKIPRKGGPGITKSDLLVINKTDLAPYVGASLEVMESDARKMRGGRPFVMGSVKSGQGLDEVIRFIEQQGMLGV

SEQ ID NO: 9242 - protein, 210 aa, Bacteroides fragilis NCTC 9343
MDKIKAVIFDMDGVLIDAKEWHYEALNKALRLFGFEISRYDHLVTFDGLPTAKKLEMMTVERGLPKSLHQLINDMKQIYTMEYVYMKCKPLFVHQYALSRLKSEGFRLALASNSVRVTIDMMMEKADLNQYLDFSLSNQDVKKSKPDPEIYITAINRLGLSPEECLVVEDNQNGVKAALASGANLLKVETINDVTYSNIINRINEIENNI

SEQ ID NO: 9243 - protein, 509 aa, Xanthomonas campestris pv. vesicatoria str. 85-10
MNAQPATKPLNTDPQSIFKPRYDNFIGGKWVAPKDGQYFDNTTPINGKVFTSIARSTAPDIEAALDAAHAAKEAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDRFMEKALARVAAIKQGNPLDPNTMVGAQASSEQLEKILSYIDIGKQEGAQVLIGGERNTLEGDLAGGFYVKPTVFKGHNKMRVFQEEIFGPVVSVTTFKDEADALAIANDTLYGLGAGLWSRDASRLYRMGRAIQAGRVWTNCYHAYPAHAAFGGYKQSGIGRENHKMMLDHYQQTKNLLVSYSPKALGLF

SEQ ID NO: 9244 - protein, 434 aa, Nocardioides sp. JS614
MSTALVAEPAERTTLAGLLAFDRAHVWHPYASMTDPTPVRLVTGAHGVRLTMADGSQVIDGMSSWWSAIHGYRVPELDAALVAQSQRMSHVMFGGLTHAPAIRLAQRLVAITPDALQHVFLADSGSVSVEVAIKMVLQYQRGVGRPERTRLLTVRGGYHGDTFGCMSVCDPIGGMHAMFAAVHHSQVFADRPPGPGGDVDGWADGVRRLAATHARELAGIIIEPLLQGAGGMHVYDAACLRILREIADEHDLVLVFDEIATGFGRTGHLFVSDHVTPDILCLGKALTGGYLTLAAVLATAEIAHGISGSESGVLMHGPTFMGNPLACAVALASLDLLQTRDWGADVRRLHAALTTGLEPLRAAPGIADVRVLGAVGVVQLDHEVDVAKATDAALAEGVWLRPFRDLVYTMPPYPTQQADAAHICAAIAHAAAVA

SEQ ID NO: 9245 - protein, 119 aa, Triticum aestivum
MASLSVATLPQLAGAPAAAAAKKRSGVTYVEGMNAYSGLKGLNKVTMLGVRKSADYKFARIVASLSPAGKRRGGSFGAQCNAAGEIFQIAVVMNALTLVGVAVGFVLLRAEAAYEESEE

SEQ ID NO: 9246 - protein, 89 aa, Triticum aestivum
  misc_feature (13)..(13): Xaa can be any naturally occurring amino acid
  misc_feature (17)..(18): Xaa can be any naturally occurring amino acid
  misc_feature (22)..(22): Xaa can be any naturally occurring amino acid
  misc_feature (24)..(24): Xaa can be any naturally occurring amino acid
  misc_feature (29)..(29): Xaa can be any naturally occurring amino acid
  misc_feature (34)..(34): Xaa can be any naturally occurring amino acid
  misc_feature (36)..(36): Xaa can be any naturally occurring amino acid
  misc_feature (38)..(38): Xaa can be any naturally occurring amino acid
  misc_feature (50)..(50): Xaa can be any naturally occurring amino acid
  misc_feature (59)..(60): Xaa can be any naturally occurring amino acid
  misc_feature (72)..(72): Xaa can be any naturally occurring amino acid
  misc_feature (76)..(76): Xaa can be any naturally occurring amino acid
  misc_feature (78)..(78): Xaa can be any naturally occurring amino acid
  misc_feature (83)..(83): Xaa can be any naturally occurring amino acid
MAEPPPPPSQSPXPTQXXTPAXTXRDEMXACVAXLXAXLLPCLPARELQXVDRSLQSSXXIDVERYAMDFMXAAKXLXSCFIXMQRGNH

SEQ ID NO: 9247 - protein, 121 aa, Malassezia sympodialis
MRGSHHHHHHLVPRGSVQVISSYDQFKQVTGGDKVVVIDFWATWCGPCKMIGPVFEKISDTPAGDKVGFYKVDVDEQSQIAQEVGIRAMPTFVFFKNGQKIDTVVGADPSKLQAAITQHSA

SEQ ID NO: 9248 - protein, 367 aa, Novosphingobium aromaticivorans DSM 12444
MASTADTTGLTFTRNPHPAPVAADARAQVLANPGFGTTFTDHMVEIDYAEGQGWHDARVVPYGPIALDPAAAVLHYAQEIFEGLKAYRLADGGIALFRPEANAQRFNASARRLAMPELPEDLFVEAVRQQVLADKDWFPTVEGGSMYLRPFMFASEAFLGVRPARQYKFMVIASPAGNYFKSGAPAVSIWVSDYTRAAPGGTGAAKCGGNYAASLVPTAEAFSRGHDQVLFLDAAEHKWVEELGGMNLFFVFDDGSILTPELTGTILPGITRSSLLTLAAEEGLTVREGRYSLDQWKADAASGKLIETFACGTAAVVTPVGKVASRDGEFTIGSGGPGQLTQKLRQKLVGIQRGEIADTHGWVSRIA

SEQ ID NO: 9249 - protein, 802 aa, Cryptococcus neoformans var. neoformans JEC21
MAAITPSWALETTADGEVKEKTSGPGGQWRALNVGPDLIRSLLIRKFKTPTPIQRAAIPPALSTPPRDILGMARTGSGKTLAYLIPLLQRTGSTHHGQGPRALILCPSRELAVQIYTVGKDLARGMNKGKGKGKNKNEDEEDEEGKGKEGLRWALIIGGEGMDAQFEKMSSNPDIVIATPGRFLHLIVEMHMDLRHLQTVIYDEADRLFEMGFDVQLQEILHRLPSTRQNLLFSATLPSSVAEFAKAGLVNPLLVRLDAEQKISPDLALKFFSVKPGEKEASLLVLLREVIGKPNQPEPADPSSAPQAIVFVATKHHVDYVAELLRTTGYRTSLIYSSLDQVARQQQLAGFRSHQSDVLVVTDVAARGLDIPIMDHVINYDFPAGPRIFVHRVGRTARAGRKGTAYSLIVKEDFPYLCDLHTFLGTERMGEPADVLRSLPIEQLSENVEYVFHNLDETAPHITALRNVMRKGQGMFERSRTKANPTSYRQAKSLASALSNNPPRIDDMFEDAMEVEVNEEKARLLAKVAAFTPSETVFEVGKRESESAIIMKKRRKTVDERQKRVSKAEAEKSTASGMEKAPVKELPAPQLPSKNFKDPSFYLDHTQRGAEAEKGYSLKSGVESLSGAITDMTADEGTGPKAQKASQLSWDRKKHKFIKKNGSADGEKMIKSESGALLPASYSSGKYQEWKSKRRHMPDGPVEALALGGGRRGRHGPPGQKRKAEDGDGGEDAGGKGRKDQGKSKGTGKGKDDFKQKSPGKPGKKGIKQSSGLKSAMDIRKQREIAQKRKEKNARKPQKFRK

SEQ ID NO: 9250 - protein, 419 aa, Novosphingobium aromaticivorans DSM 12444
MDHFEVSNGVLHAEDVALPVIAAEVGTPVYVYSRATLTRHARVFRDALSILPAVKIAFAVKSNPNLAVLKVLAAEGYGADVVSGGEMERALAAGMKPDGIVFSGVGKTEAEMRRGIEAGIGQFNLESEEEGLELAEIAASMGKVASAALRVNPDVDAGTHGKISTGKAENKFGVPFDRAAAIYARLADTPGLNMRGLALHIGSQLSKLDPLEAAFTKVGGLMRAIREGGHAVTHMDLGGGVGVPYKAGEVFPQPAEYAAMVAKVTADWGVTLMFEPGRVITGNTGVLMTQVVRVKEGAGHPWVVVDAAMNDLARPALYDAWHDFAAVEPTGETFVANIVGPICESSDTFAMARTIDKVGRGDLAVFRTAGAYGATMANTYNSRPLVPEVMVDGEKWAVVADRIDPATILAAERVPDFLK

SEQ ID NO: 9251 - protein, 506 aa, Oryza sativa (japonica cultivar-group)
MASAEAECAAAAVGGGGRAEIDTSAPFESVREAVDRFGGSAAWSSHLIRRMFAPPNPKEQSEESKQPVDIKEQAAQLEHDLIIKEKETLDVLKELESTKKIIADLKQRIQKESNETSPSAVKSDDQSEIPITESEEQKPENVNIDMDMEGLDEHPQPLSGSVLLELEQAKANLNRTTGDLAAVRAAIELLHNSIAKEKLLLERSREKLSSNTALASSLEDELDQTTQKLQTLKDLQARREDPSDIFIEIKKMASEVQQLRGMANASKSEAMMLAAEIEQTKASIGTAEIRCIAAKKMEEAARAAEALALAEIKALLSSESSSECGSSVCDGVTLSAEEYFTLCSKAQEADENSRKKVEEAMLQVDVANSSETDSVKKWKSENGHKRRSIGGSPKFKNAAQRRKDSHSMDIISDASTNSCKQTLSIGQILSMKLMGPEGYDKTIWDDKTSEMPNVSLGQILNRGRVLSREETAVRKRVSGKRKKFALTGLSVLLAKQAKNKKKRESL

SEQ ID NO: 9252 - protein, 929 aa, Aspergillus oryzae
MPHRAASPAASENEFDITNALFQNDSDSDNDTSLKQTKRPQKAAPPQALDFLGGDIDDDEDDEAFIAGQQASANRKASNLKGRTVKKGGGFQAMGLNAHLLKAITRKGFSVPTPIQRKTIPVIMDGQDVVGMARTGSGKTAAFVIPMIEKLKSHSTKVGARGLILSPSRELALQTLKVVKELGKGTDLKSVLLVGGDSLEEQFSLMAGNPDIVIATPGRFLHLKVEMNLDLSSIRYVVFDEADRLFEMGFADQLTEILYGLPANRQTLLFSATLPKSLVEFARAGLQEPTLIRLDTESKISPDLENVFFSVKSSEKEGALLHILHEVIKMPTGPTEAAQRQKEQGDGKNFKNFKKRKRGDDKAINFQESPTKYSTIVFAATKHHVDYLYSLLREAGFAVSYAYGSLDQTARKIQVQNFRAGLSNILVVTDVAARGIDIPILANVINYDFPSQPKIFVHRVGRTARAGRKGWSYSLVRDADAPYMLDLQLFLGRRLVIGREHGDQVNFAEDVVVGSLPRDGLSTSCEWVTKVLENEADIYSQRTIAGKGEKLYMRTRNSASLESAKRAKQVVSSDNWTAVHPLFNDQGSQMELEREKMLARIGGYRPQETIFEVHNRRNGKHEGDEAIDTIKRIRTTVDYKKKKREMAEKQSDFVEDASSGNKGEANETEETGAQPDEDEEDIGEGVPDNMSMASESDLEVTFSSYNGGKAKKDSAASFQNPEYFMSYTPSSTNLAEDRAYGVHTGTNANFTQASRSATMDLLGDEGARGFAEPRTMMRWDKRHKKYVSRQNDEDGSKGTHLVKGESGAKIASTFRSGRFDAWRKGKRLGRMPRVGEEETPALVHDLNTAMRRRRFQHRKEQAPKAADRLRGDYEKMKKKGEAAKQRQLSKAGGAAAGGKSELKSTDDIRLARKLKQQRREKNARPSRKK

SEQ ID NO: 9253 - protein, 747 aa, Candida albicans SC5314
MSKEAEFVKTISKEGDPQVDVLERDAESNSENALEPDVEELPKVVREIVPLEDDPTIPVLTFRYFILSIIFIIPGAFIDTMNSFRTTSAAYSIFFVQIASHWCGKWLARILPKKQVGFGRLSFNLNPGPWSIKETALITITANSGATGSMGTNPLALAELFYGETVNPAVAIFFMWMIVFIGYSFAGIARNFLLYDPQFTWPQALMQTTLFQTQSKSDKDAKQASKQMKVFFFVLIGLCIWQFFPEYIFPMTSSLAFLCWVAPENYTANFIGSGLGGMGFLNLSLDWSNITSSIMLYPYWVQVVQFAAFVLGAWILIPAAKWGDLSSYPYGLMSNSLFLGNGTKYPTTELLTPNLRLNETRYEELGPVHLGAQRAWNMFFDYAAYVSGFMWVVAFGYKSLSGSLKRLVKSRKQKGSINLQYTDRLNKLQAAYEEVPLYWYAILFLCAFVTLLVIFATNSLFMPWWCLLVGVAFGAVIVTPLVWLYALSNFQLPIGTFNELLYGYMIQNKTSRHPAGAMVYGAVGGDLFYRAQYILNDQKIAHYMHISQRAVFFSQIFGELIGVPINYAALRWVISSKRDFLDGTKVDKLHQWTGQTIVSYNTNAVQYVILGPDRLFKNYPVLPYGFLLGAGAPLVLYLLHRLFPKSKLKFHLWNTTVFFSTMSTFYGNLSTGYFSRFIGGTITMFWAFRYKHSLWKKYNYLLAAALDTGLNLSILLIFLFFSAGKTVNFPEWWGNNGKSVERCFAMS

SEQ ID NO: 9254 - protein, 459 aa, Emericella nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDLPAGDIGVTGREVGFLFGQYRRIRNQWEGVLTGKGGSWGGSLIRPEATGYGVVYYVQHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 9255 - protein, 390 aa, Ralstonia eutropha JMP134
MSADSTLAPLTPPVSRLPSVGTTIFTVMSALAAEKNAVNLGQGFPDFDCDPRIVDAVTHAMRTGHNQYPPMAGVPRLRQAIADKIATLYGHRYSWESEITVTAGATQGILTAILCAVHPGDEVIVLEPCYDSYLPAIELAGATAVPVTLEAPDFRVPFDRLAAAITPRTRMILINTPHNPTGTIWRAADMDKLAQLLAGTDILLLSDEVYEHMVYDREPHASVSRHPELARRSFVISSFGKTYHVTGWKVGYVAAPAALSAEFRKVHQFNVFTVNTPVQHGLADYMADPAPYLELSAFYQAKRDYFRAGLANTRFKLLPSEGTYFQCVDYSAISDLSEAEFSMWLTREIGVAAIPVSAFYTQPRESGVVRFCFAKKEETLSRALERLAKL

SEQ ID NO: 9256 - protein, 296 aa, Solibacter usitatus Ellin6076
MFTGCGTALVTPFRRDLSLDEATLRGLVRRQIEAGINFLVPCGTTGESPTLSRAEHLRVVEITLEEAKGKVPVLAGAGGYNTHEVIELARELESMGADGILSVTPYYNKPTQEGLYQHYCAIADGTRLPIVVYSVQGRTGVNVEPGTLARLAKIGNIVAVKEASGNIGQMATILNEVPGDFIVLSGDDAITIPLAALGGRGIISVASNEIPAEMTQIAQACLRGDFAAARAIQAKFLPLMNVNFVESNPIPVKAAMALMGLLEPVWRLPMVPPTPASLAKIENVLESVGLLVHHAS

SEQ ID NO: 9257 - protein, 309 aa, Clostridium tetani E88
MAKISILGSINMDIVLKVDRMAKVGETLLTRSLDKVAGGKGANQGVAAARLGSKVYMIGKLGKDDNGDILYRNIENDNINVEYILKDDKEPTGMAIVTVDKDGNNSIVVVSGANMSLKKEDIYQFKEAIKDSNILITQFETPIDVAEDAFKLAKSFGVTTILNPAPAKEITENLLKNTDIIIPNEMEAFEITKIKIKNENDIKKSAQVFLERGIKFVIITLGEKGAAIISKYKFEIIPAYKVNAIDTTAAGDSFIGALAHKLGEKELSFENIKEGVLYGNKVSSIVVQKEGAQSSIPYLSEVKEVFKEN

SEQ ID NO: 9258 - protein, 428 aa, Pseudomonas aeruginosa
MADKKAQLIIEGSAPVELPVLSGTMGPDVVDVRGLTATGHFTFDPGFMSTASCESKITYIDGDKGVLLHRGYPIEQLAEKSDYLETCYLLLNGELPTAAQKEQFVGTIKNHTMVHEQLKTFFNGFRRDAHPMAVMCGVIGALSAFYHDSLDITNPKHRQVSAHRLIAKMPTIAAMVYKYSKGEPMMYPRNDLNYAENFLHMMFNTPCETKPISPVLAKAMDRIFILHADHEQNASTSTVRLAGSSGANPFACIASGIAALWGPAHGGANEAVLRMLDEIGDVSNIDKFVEKAKDKNDPFKLMGFGHRVYKNFDPRAKVMKQTCDEVLQELGINDPQLELAMKLEEIARHDPYFVERNLYPNVDFYSGIILKAIGIPTSMFTVIFALARTVGWISHWQEMLSGPYKIGRPRQLYTGHTQRDFTALKDRG

SEQ ID NO: 9259 - protein, 431 aa, Arabidopsis thaliana
MGGSDENRHGVIGPMNRQQGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNECRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 9260 - protein, 335 aa, Streptococcus pneumoniae TIGR4
MVVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 9261 - protein, 314 aa, Solibacter usitatus Ellin6076
MRRQPRIVVIGSANIDLVTYTDQFPRPGETIFGREFSLGFGGKGANQAVAARLCGAEVAMVARVGDDLFGPANIQNFTSRGIDVRHVMTTAGVSSGVAPIFVESSGQNRIWVVKGANDRLLPADVAAASDVLAGADFLVMQLEIPTETVYYALRFARERGIRTILNPAPGQALDLAQIASADYVIPNETEAEALAGTPVHALEDAQRCAQKLLDGGLRRVIVTLGANGALLATHDGMHHVAPFPVQPIDTTGAGDAFIGSFACFCAEGFDELAAIARANLYAALSTLGPGTQKSFVSRERFNTEWAARSVSVTP

SEQ ID NO: 9262 - protein, 301 aa, Oryza sativa (indica cultivar-group)
MRAAAAPDPSPAPARSMLKRLFDRQLLRVSPAERIVAVGGGEKDEVEPSSVCLDGMVRSFLEDGSGVGAAVERAGGHGVRRCNCFHGGGSSDDDDDEDDAAASSDVAETIKGLVHCATLRERNLLADVCGHVERHRAGGARRRELLGLVAASLRAAGHDAAVCVSRWDKSPTHPAGEHAYVDVLLPPASDRGARERVLVDVDFRSAFEVARPTKAYRALLQRLPAVFVGKDDRLRLLVAASADAARASLRKRGLHLPPWRKPEYMRAKWLSPYDREPAPPDEASASAAAAEVAGEEAPAAA

SEQ ID NO: 9263 - protein, 183 aa, Zea mays
  misc_feature (82)..(82): Xaa can be any naturally occurring amino acid
MYVSSETPVQTNQIKHSMQGITKALRLHGRQLRHAVLQHMNMNQGIFFWATLISRIQSESPAVIIPHMGLENITVNEILRAXGRPRPERSTDFARKILLPGRPSQQTRVEDIMTEEDKVITVSGRTNILRAMEVMTDKRIRHVPVFDDKVVGMISIGDVVRTIVDQQHQEVKQLKKYIRGDYY

SEQ ID NO: 9264 - protein, 503 aa, Burkholderia thailandensis E264
MSVSWPRSARLFGFLACINAQVNIDIAIFKRLFVDSTMRNIFIHPRIATPTDMNALTEPTTPDTTVRTDAEWLDAHWMPFTANRQFKRDPRIIVEGKGAYYTAADGRKIFDGLSGLWCCGLGHGRAEISEAVARQIARLDYSPAFQFGHPQSFELANRIKAMTPAGLDYVFFTGSGSEAADTSLKMARAYWRAKGKGTKTRLIGREKGYHGVNFGGISVGGIGPNRKLFGQGIDADFLPHTQLPENRFSRGLPEHGAELADRLLDLIALHDASNIAAVIVEPFSGSAGVVVPPKGYLQRLREICTAHDILLIFDEVITGFGRTGAMTGADAFGVVPDLMNVAKQVTNGAQPLGAVIASKDIYDAFMAAGGPDYMLEFPHGYTYSAHPVACAAGVAALDLLVAEDALGRVRELAPHFEAAVHGLKGVRHVADIRNCGLAAGLTIEHAPGEPARRPYEIAMHCWRNGFYVRYGGDTIQLAPPFVAEKHEIDSLIGALNDALLATD

SEQ ID NO: 9265 - protein, 472 aa, Zea mays
MAFYRGLTAVSRLRSRMAQEATTLGGVRWLQMQSASDLDLKSQLQELIPEQQDRLKKLKSEHGKTQLGNITVDMVLGGMRGMTGMLWETSLLDPEEGIRFRGLSIPECQKVLPTAVKGGEPLPEGLLWLLLTGKVPTKEQVDALSKELLARSTVPAHVYKTIDALPVDAHPMTQFTTGVMALQVESEFQKAYDNGLPKSKFWEPTYEDCLNLIARLPPVASYVYRRIFKSGKSIEADNSLDYAANFSHMLGFDDQKMLELMRLYVTIHTDHEGGNVSAHTGHLVGSALSDPYLSFAAALNGLAGPLHGLANQEVLLWIKSVIEETGSGVTTDQLKDYVWKTLKSGKVVPGFGHGVLRKTDPRYSCQREFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCKNKAA

SEQ ID NO: 9266 - protein, 282 aa, Bdellovibrio bacteriovorus HD100
MEKANDPVRILKKSTARKLLPAVSAHDNKATRGRSLLLAGSAQYPGAGILAARGALRMGSGYVMLAPQGVTVSSLENPDFLVLDLKKDSWQQQKFDALLCGPGFGVTPFTAEVIRELKARKVERVVLDADALTVCAEQDLFPLPATWIVTPHTGELARCLGVEAEEIAANRYGFVRVAQEMMGCVVLLKGPQTLVAGPNRVYGISTGNAALAKSGTGDVLAGIITALRAQKVPALRAALLGAYVHGATANLWKSRKRDLLSMTASDVVESLPQVLYNLREGF

SEQ ID NO: 9267 - protein, 141 aa, Halomicrobium mukohataei
ERTFVMVKPDGVQRGLIGDIVSRFEDRGLKLVGAKFMQIDRKLAEEHYGEHEGKPFFEGLVEFITSGPVFAMVWEGQDAVRQVRSMMGETDPAESAPGTIRGDFGLDLGRNVIHGSDHEDEGSNEREIELFFDDAELVDWD

SEQ ID NO: 9268 - protein, 394 aa, Bacteroides fragilis NCTC 9343
MQKENQTYKVAPADRLAGVSEYYFSKKLKEVARMNAEGKDVISLGIGSPDMPPSEQTIETLCNNAHDPNGHGYQPYVGIPELRKGFADWYKRWYGVELNPATEIQPLIGSKEGILHVTLAFVNPGEQVLVPNPGYPTYTSLSKILGAEVVNYNLKEEDGWMPDFDELEKMDLSRVKLMWTNYPNMPTGANATPELYKRLVEFARRKNIVIVNDNPYSFILNDKPISILSVPGAKECCIEFNSMSKSHNMPGWRIGMLASNAEFVQWILKVKSNIDSGMFRAMQLAAAKALEADSTWYEGNNVNYRNRRHLAGEIMKTLGCTYDEKQVGMFLWGKIPASCADVEELTEKVLQEARVFITPGFIFGSNGARYIRISLCCKDAKLAEALERIKSIMK

SEQ ID NO: 9269 - protein, 212 aa, Candida albicans SC5314
MTSETVIAPSLSTAQNDGTFTYDKVKSTAKERKHLNLKNPSDANEIKSKIWNYYSLSELIQYLGQKENDDFKYKRITLQFPDNLICDSATIVHELQRELNIVPQANQDTGESNTAQRVWILADTSYSACCVDEVAAEHVRSDLVVHFGDACLNEIDKLQAVFVLGKPTLDVDAIVKQIKTAYSTEQKVVLMSDAPHTYLLPEIANELPDYDI

SEQ ID NO: 9270 - protein, 141 aa, Haloarcula hispanica
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDDAELVDWD

SEQ ID NO: 9271 - protein, 141 aa, Haloarcula sinaiiensis
ERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDDAELVDWD

SEQ ID NO: 9272 - protein, 398 aa, Cryptococcus neoformans var. neoformans JEC21
MSGVVNGVRVATDDPNRVITVSAQWGKTGADTTISYTNCKAVGNGSFGVVFAAKMSPVKHEDGSEEPESDIAIKKVLQDKRFKNRELQIMRLVHHPNIVDLRAFFYSNGDKKDEVYLNLVLELVPETVYRASRHYAKLKQAMPMLQVKLYMYQLFRSLAYIHSIGICHRDIKPQNLLLNPATGVLKLCDFGSAKILVAGEPNVSYICSRYYRAPELIFGATNYTTNIDIWSTGCVMAELMLGQPLFPGESGIDQLVEIIKVLGTPTREQIKTMNPNYMEHKFPQIKPHPFTKVFRPRTPADAISLISTLLEYTPSARYTAPEALVHPFFDELRVEGARLPNGKDMPELFNFTHEELSSRPDLIRQLVPTHAEEELRSRGIDVNDFKPIPPEQLRVTLD

SEQ ID NO: 9273 - protein, 182 aa, Brassica napus
  misc_feature (57)..(57): Xaa can be any naturally occurring amino acid
MAYSMLSSAAVVTSPAQATMVAPFTGLKSSSAFPVTRKANNDITSIVSNGGRVSCMXKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 9274 - protein, 229 aa, Robinia pseudoacacia
AHRAHASTEGVAKYVRPAVAGFLMQKELDYLVGAVSNPKKPFAAIVGGSKVSTKIGVIESLLAKVDILLLGGGMIFTFYKAQGHSVGSSLVEEDKLDLANSLMEKAKAKGVSLLLPTDVVIADKFAADANSKVVPASSIPDGWMGLDIGPDAIKTFSETLDKTQSIIWNGPMGVFEFDKFAAGTEAIAKKLAELSGKGVTTIIGGGDSVAAVEKVGLADKMSHISTGGG

SEQ ID NO: 9275 - protein, 626 aa, Pisum sativum
MAFCYRLDNFIISAFKPKHSNVPLSIHHSSSNFPSFKVQNFPFRVRYNSAIRATSSSSSTPTTIAEPNDIKINSIPTKPIEGQKTGTSGLRKKVKVFKQENYLANWIQALFNSLPPEDYKNGLLVLGGDGRYFNKEAAQIIIKIAAGNGVGKILVGKEGILSTPAVSAVIRKREANGGFIMSASHNPGGPEYDWGIKFNYSSGQPAPESITDKIYGNTLSISEIKIADIPDVDLSNVGVTKFGSFSVEVIDPVSDYLELLETVFDFQLIKSLISRPDFRFTFDAMHAVAGAYATPIFVDKLSASLDSISNGIPLEDFGHGHPDPNLTYAKDLVKIMYAENGPDFGAASDGDGDRNMILGTSFFVTPSDSVAVIAANAKEAIPYFKDSIKGLARSMPTSGALDRVAEKLNLPFFEVPTGWKFFGNLMDAGNLSICGEESFGTGSDHIREKDGIWAVLAWLSIIAHRNKDTKPGEKLVSVSDVVKEHWATYGRNFFSRYDYEECESEGANKMIEYLRELLSKSKPGDKYGSYVLQFADDFTYTDPVDGSVVSKQGVRFVFTDGSRIIYRLSGTGSAGATVRVYIEQFEPDVSKHDVDAQIALKPLIDLALSVSKLKDFTGREKPTVIT

SEQ ID NO: 9276 - protein, 293 aa, Oryza sativa (japonica cultivar-group)
MQRNGVMECSVCHSKVVAPSPRSVSRAYDKHRSKISSKYRALNFLLVSGDCILVGLQPILVFMSKVDGKFQFSPISVNFLTEVTKVIFAIVMLIIQSRKQKVGEKPLLSLSTFVQAARNNALLAVPALLYAINNYLKFIMQLYFSPATVKMLSNLKVLVIAILLKFIMRRKFSIIQWEALALLLIGISVNQLSSIPDGTKSFGLAVTTIAYIYTLIFVTVPSLASVYNEYALKSQFDTSIYLQNLFLYGYGAIFNFLGILGTVIFQGPQCFSFVTMLHKAFSLHSSLSMQTQF

SEQ ID NO: 9277 - protein, 541 aa, Oryza sativa (japonica cultivar-group)
MASPPTASASASEAAESGRRSAPGPIDVPSPRDHLHHLLDRRDTPRVVHVEGTTMQRQRGEAAGDAGAAAAAKPEVKLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIGGYRGFYACNTIDLSPKSVNDIHKRGGTVLGTSRGGHDTMKIVDSIQDRGINQVYVIGGDGTQRGAGVIFEEIRRRGLKVAVAGIPKTIDNDIPVIDRSFGFDTAVEEAQRAINAAHVEAGSAENGIGLVKLMGRHSGFIAHYATLASRDVDCCLIPESPFYLEGEGGLFRYLEKRLKENGHMVIVVAEGAGQKLINETKESMGKDASGNSILLDVGLWLSQKIKEHFKKIKTTINLKYIDPTYMIRAIPSNASDNVYCTLLAHSVVHGAMAGYTGFTVGQVNGRHCYIPFYRITEKQNKVSITDRMWARLLSSTNQPSFLSKKDVEDAKMEEERASKFFDGPPPNPKVEDKVASNGKAVK

SEQ ID NO: 9278 - protein, 436 aa, Archaeoglobus fulgidus DSM 4304
MAIEVELHKLREWMWKYSLGRDGGNNSDHFLRIKIPGGIISPDRLRGVAELSDKYGRGYAEITTRQDIQLHWIEAEDALEIFAEMEKLGFTTDLCSQAFAETCHGDVRNAVCCPLSGKKGYDAYWLVREITDFFSGNPDYVSLPHKFKIGISTCESNCIREEAQDLAMQWNGEGFVPLVGGGLGASKPGVRKAKSLRIVVYEEDAFDFIRTVIDIYKDFRAERKAEARFKNFFETAGCEWLRREIELRMGVKFDLADDFNCNPPSEHTEGLQDDGSNYYTLPVFAGILDSERLSFIAEVAEEFDGGIRLTPWQNVVFTDIDDLKALKERLSEQFDLSAPRMHIACASNFCGKTLVHAKDVLRHIPASDRFVGVSGCSNACACHPLAEIGLCGKVKAGKQLYDVFIHGWKEAENLSVEEAVELIKKHLGDGYGAKAD

SEQ ID NO: 9279 - protein, 141 aa, Halobacterium salinarum
ERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDAELVDWD

SEQ ID NO: 9280 - protein, 141 aa, Halogeometricum borinquense
ERTFVMVKPDGVQRGLIGEIVSRFEDRGLKMVAGKFMQIDEELAHEHYGEHKDKPFFDGLVDFITSGPVFAMVWEGQDATRQVRRMMGETDPAESAPGTIRGDYGLDLGRNVIHGSDHEDEGANEREISLFFDDAELVDWD

SEQ ID NO: 9281 - protein, 141 aa, Halorubrum saccharovorum
ERTFVMVKPDGVQRGLIGEIVSRFEERGLKLVGGKFMQIDEDLAHEHYGEHEGKPFFDGLVDFITSGPVFAMVWEGADATRQVRAMVGETDPAESAPGTIRGDFGLDLGHNVIHASDHEDEGANEREIDLFFDDAELVDWD

SEQ ID NO: 9282 - protein, 141 aa, Natrialba asiatica
ERTFVMVKPDAFARGLVGEVISRLEDRGLKLVGIKVENMPRGRAEEHYSEHEDKPFYDDLVDFITGGPVVPMVWEGQDATRQVRQMIGETDPLEAAPGTIRGDYALDLGRNVVHAADHEDEGANEREISIHFDDAELVDWD

SEQ ID NO: 9283 - protein, 470 aa, Xanthomonas campestris pv. campestris str. ATCC 33913
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVNLPHALIAGPHAGGIVNLPAVVITFLVAGMLMAGTKESATLNAVLVVLKIIALGVFVAIALPAFNSANLQPFMPYGFSKAMGPDGVERGVMAAAIIFFAFYGFDAISTAAEETKNPGRDLSIGIVGSMIGCTLIYVLVALSAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPTRARAFRTPLAWVVGPVAILGCLYLFWSLPSTTQGWFLVWNALGVVVYLAYGRRNSRLGKVG

SEQ ID NO: 9284 - protein, 390 aa, Deinococcus radiodurans R1
MSRARCCRRLPTARRCAGCICVRAPRLPVAAFTACAGSTRHERRWQTSSASGSKAALSRAGPHKIRLRPLQPATPPASAHWAAGDLMTNDDKTKQANGQPETAATENMPQEVPAETQEQQPGSEAEMSLAPVVIRDDYRGSDKLKGKVALISGGDSGIGRAVAVHFAREGADVAILYLDEHQDARDTLKMVQAEGRQGLIIAGDIGDPKFCQDAVAQVMKELGKLDILVNNAAEQHPQENLTDITPEQLERTFRTNIFGMFYLTQAALPHLQKGAVIVNTTSVTAYKGSPELLDYSSTKGAILAFTRSLSQNLADKGIRVNAVAPGPIWTPLIPSTFDQKRVAEHGKKTPLERPGQPAEVAPSYVFLASEDSSYITGQVLHPNGGDVVNG

SEQ ID NO: 9285 - protein, 158 aa, Clostridium tetani E88
MINSLTNRRKLVKVSGKPGKTRLINFFLINNDFYFVDLPGYGYARVSKEEKKNWGKTIETYLTDREQLKKIILLVDSRHKPTNDDVLMCNWIKYYGYDISVVATKSDKLKRSELKKNEKIIRDTLDLSEEIKIIFHSTLNKSGREELLEDIFKTCNID

SEQ ID NO: 9286 - protein, 191 aa, Hordeum vulgare subsp. spontaneum
MEYQGQQQHGQATNRVDEYGNPVAGHGVGTGMGEHGGVGTGMGAHGGVGTGAAAGGHFQPTRKEHKAGGILQRSGSSSSSSSEDDGMGGRRKKGIKDKIKEKLPGGHGDQQHAAGTYGQQGTGMAGTGSTYGQQGHTGMTGTGATGTVATGGTYGQPGHTGMTGTGTHGTDGTGEKKGIMDKIKEKLPGQH

SEQ ID NO: 9287 - protein, 696 aa, Phaeosphaeria nodorum
MAEQLDMGRLNLNDSQHAPQNGFNGERSAYIPPHLRGRPQGGPPPMNAAPPMMNGGGGVGGSAWGPAPGGPSPAPPARFDGPPPGQMNGGGNWANANAQAFTPRGRDGPQGGGGWGGAAPGKFDPSAYGKPGGGGGGSARGSGDGQWKDGKHVPGPSNPRVERELFGVPNDPSKQQTGINFEKYDDIPVEASGQGVPEPVTRFTNPPLDDHLLSNIELSGYKVPTPVQKYSIPIVMGGRDLMACAQTGSGKTGGFLFPILAQAFQNGPSPPPTAQAGGYGRQRKAYPTSLILAPTRELVSQIFDEARKFAYRSWVRPCVVYGGADIGSQLRQIERGCDLLVATPGRLVDLIERGRISLASIKYLVLDEADRMLDMGFEPQIRRIVEGEDMPPTAGRQTLMFSATFPRDIQMLARDFLKEYIFLSVGRVGSTSENITQKIEYVEDADKRSVLLDILHTHGAGLSLIFVETKRMADSLSDFLINQGFPATSIHGDRTQREREKALEMFRSGRCPILVATAVAARGLDIPNVTHVVNYDLPTDIDDYVHRIGRTGRAGNTGIATAFFNRGNRGVVRDLLDLLKEANQEVPSFLESIAREGSGFGGGGGRGGRGGGRGRGNAATRDVRRMGGGGGAGGFGGGGWGGAPQGGYGGGYGGAPAGGYAPPSGGAYGGGGGGGGGGGYGGGYGNPSGPGGNSWW

SEQ ID NO: 9288 - protein, 282 aa, Acidovorax sp. JS42
MTAAADLYCVMGNPIAHSRSPWIHARFAQLTGQSLHYERRLVPLDGFAQALQSFAAEGGRGCNITVPFKLEAAQLATTRSERVQLAGAANTLVFDGGSIHADNTDGLGLVADITQGAGVPLAGRDVLLVGAGGAAAGVLGPLLRQHPRRIAVVNRTPARAQALVDSHAALAALQKTELLALDMQAPGADFDVIINATASSLEGGPVPVPASVLRPGSLAYDMMYGPAAQPFLDWATGHGATARDGLGMLVEQAAEAFLLWRGVRPPSAPVLQELRAAIAAGA

SEQ ID NO: 9289 - protein, 184 aa, Hordeum vulgare subsp. spontaneum
MEYQGQQQHGQATDRVDEYGNPVAGHGVGTGMGAHGGVGTGAAAGGGGGHFQPTRAEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 9290 - protein, 658 aa, Streptococcus pneumoniae TIGR4
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASAPAPKVLAEYGFTVENLVKVVRNLK

SEQ ID NO: 9291 - protein, 506 aa, Legionella pneumophila str. Paris
MDLLQRLNIKSVNPGAFSGHGWHSDNHAHTLESFNPSTGNKLAEIATCTMDDYEQVMQRAEHAAQAWRKVPAPKRGEIIRQIGQALRENKDSLGSLVSLEMGKSKQEGDGEVQEMIDIADFAVGQSRMLYGNSMHSERPNHRMYEQWHPYGIVGVISAFNFPVAVWSWNAFLSAICGNVTIWKPSAKTPLCAVAVQHICNQVLKENNCPEIFGLIIPNSHDVVEAMVDDKRIQLISFTGSTAVGKQVAAKVAARLGKSILELGGNNGIILDESADLNLAIPAIVFGAVGTAGQRCTTTRRLFVHESKYQDVIKRLRHAYEQITIGDPLDTRNLMGPLIDQQAVEQFKKAINRIKAAGGQIVYGGEILKQAGSFVQPTLVCDVKNDWDIVQEETFAPILYVMSYRTLDEAIALHNGVPQGLSSALFTQNLKNAELFLSACGSDCGIANINIGTSGAEIGGAFGGEKETGGGRESGSDSWKAYMRRQTNTINWGDELPLAQGIRFNLS

SEQ ID NO: 9292 - protein, 243 aa, Triticum aestivum
  misc_feature (84)..(84): Xaa can be any naturally occurring amino acid
MAPWALFRGPFRPIFPKKPGWYRSRNSPDIVDPRVRDWSTRTLTWTEGVEKARVPPPSKLYTYIVQPWPPTVMASSATSVAPFXQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 9293 - protein, 607 aa, Rhodococcus sp. RHA1
MTQTVQPAAVQTSLTPQERVDLWLASFESALAARDVDRAAGMFAVDSFWRDLVAFTWNLKTVEGRDAVAAMLHARLDDTDPVNFRTTETPDEADGVTSAWIEFETATGRGKGHLRLKGDEAWTFLTTMQELKGHEERRGRNRVKGAVHGSGGDTLSWAEKREIEERELGYTRQPYVLVIGGGQGGIALGARLRQLGVPAIVVDKNERPGDQWRNRYKSLCLHDPVWYDHLPYMPFPDNWPVFAPKDKIGDWLEMYTKVMEIPYWSSTTCTSATFDDETKEWTVVLDRDGEDVVLHPKQLVLATGMSGKPNVPSFPGQDVFRGEQHHSSRHPGPDAYVGKRVVVVGANNSAHDICKALFENGADVTMLQRSSTHIVKSDSLMDLGLGDLYSERAVAAGMTTEKADLTFASLPYKIMHEFQIPIYQKIAERDRDFYDRLEKAGFKLDFGDDGSGLFMKYLRRGSGYYIDVGASELVADGSIHLVSGQVDHLTEDAVVLTDGTELPADLVVYATGYGSMNGWAADLMGQEVADKVGKCWGLGSDTTKDPGPWEGEQRNMWKPTQQEALWFHGGNLHQSRHYSLYLALQLKARHEEIPTPVYGLQEVHHLS

SEQ ID NO: 9294 - protein, 287 aa, Arabidopsis thaliana
MAYHQPYDPFYVYQLHSHPHHLPPQLPLLADEPGAINTLFVSGLPNDVKAREIHNLFRRRHGFESCQLKYTGRGDQVVAFATFTSHRFALAAMNELNGVKFDPQTGSNLHIELARSNSRRKERPGSGPYVVIDNRNKEISKSQDDQSDEGDSDPDEVQEPGNSDSPKENDTTKSEADSEPDSKAPSANGHLEKASEGGSGARACSTLFIANLGPNCTEDELKQLLSRYPGFHILKIRARGGMPVAFADFEEIEQATDAMNHLQGNLLSSSDRGGMHIEYARSKMRKQ

SEQ ID NO: 9295 - protein, 647 aa, Oryza sativa (indica cultivar-group)
MVSPNIDNLTANTFSITMPAHYPAVEFYYNGVGGEQNIEEFYYNGTSGEQIMVSPNMDNLTTNTFNLATQAHYPAVEFYYNGVDGEQNIEEFYYNGASTEQNMAFPTMDTHAANIFSFDASINHSAEEFRQISAGGELNTVCPNIDTPLAANAFSFVAPVHYSDANADLHLHVVDAGGEQDTVAAIVDVIGIPASPPSPAPASITNATVKSVWRENYTEQFKLVVDALHQPRRHLYIAVDTEFAADATTNIRRRPVTSTGCYHHLREFVNRGDIVQMGLAFVFVGGGEQSSSSSSPPPITLEINFKINIKARKYNKKSIAFLSRQGHDLREHRRRGVSPRRFYEGLLRHLPFGDGRSVTWLAYHSDYDLGFLLRLLQCGGRRRGGGDLPRQLAAFLRRLRENFPAFYDVRVIRQMLEDHGFSGKLTGLAEHLGIRRTGGAAHHAGSDALLTLSCFFKIFRSLSGQQLHQLDARRGLLAGLEEWNMAIKCARHIDDHTRNIKVIEVVAENLDEEARRIGELVASNFSIIGVDVNQLAELMQSCGATNNPDVSWVTFQGSDVIYRLIRSANGGVIPSLISGESYFPSLYDVALIVGGFHGIGTLATTDRKVGIFDVARALKLKAIKADKEAERVLLTLRCFMRLAELIP

SEQ ID NO: 9296 - protein, 355 aa, Glycine max
  misc_feature (182)..(182): Xaa can be any naturally occurring amino acid
MGQALSRIHRMIVSSSVKEKKKNTAISRVQPLAMASNCSIEGPLVEEFTYQAGSAPFKSCHASTIVEVDKDHFLVAYFGGTFEGAPDVKIWVQTYKNGRWQAPVIADEEPNVPMWNPALFKLPSDELLLFYKIGQEVQKWSGFMKRSYDKGKTWTGREQLPPGILGPIKNKPILLENGNLLXCGSSVESWNSWGAWVEVTTDFGRSWSKYGPIYIENKPLSVIQPVPYQTADGKLRVLLRSFDGIGRVCMSESSDGGKTWGYAKPTQLPNPNSGIDGVKLRDGRLLLAYNTVSRSVLKVALSKDDGDSWCEVLTLEDTSGMEFSYPAVIQDSDGRIHITYTYNRTQIKRVVLRPS

SEQ ID NO: 9297 - protein, 1026 aa, Pseudomonas aeruginosa UCBPP-PA14
  misc_feature (197)..(197): Xaa can be any naturally occurring amino acid
MDMNRRQFFKVCGIGLGGSSLAALGMAPTEAFADQVRHFKLAHTVETRNTCTYCSVGCGLIMYSQGDGAKNVAQNIIHIEGDADHPVNRGTLCPKGAGLLDYIHSPNRLKYPEVREAGSSEWKRIEWDEALERIAKLMKEDRDANFVEKNEQGQTVNRWLTTGFLAASASSNEAGYITHKVMRSLGILGFDNQARVXHGPTVASLAPTFGRGAMTNHWTDIKNADLVLIMGGNAAEAHPCGFKWVTEAKAHNKARLLVVDPRFTRSASVADYYAPIRTGTDIAFLGGLINYLLENDKIQHEYVRNYTDVSFIVKEGFSFEDGLFNGYDAEKRTYPDKSSWGYEIGEDGYAKVDPTLTHPRCVFNLLKQHYSRYTPDVVSNICGTPKDMMLKVWAEIAETSKPGKVMTIMYALGWTQHSVGAQMIRTGAMVQLLLGNIGMPGGGMNALRGHSNIQGLTDLGLLSNSLPGYLTLAMDAEQDYDAYIAKRTAKPLRPGQLSYWQNYGKFHVSLMKAWFGKSATKENNWCYDWLPKLDMPGAGYDVLRYFDMMYQGKVNGYFCQGFNPIASFPNKAKVGAALARLKWMVVMDPLVTETSEFWRNVGEYNDVDTASIKTTVFRLPTSCFAEEDGSIVNSGRWLQWHWKGAEPPGQARPDIAIMAGLFHRLREMYRKDGGAFPDPILGLDWSYLKPDEPGPDELAREFNGKALSDLVDPANGMILAKAGEQLPGFALLRDDGSTASGCWIFAGSWTQQGNQMGRRDNSDPYGMGQTLGWAWAWPANRRILYNRASADVSGKPWDPEKKRLVWWNGKSWGGTDVPDYKADVPPEAGMNPFIMNPEGVARLFAVDKMAEGPFPEHYEPFETPIGVNPLHRDNRKAISNPAARVFKNDMELFGTADEFPYAATTYRLTEHFHYWTKHCRLNAITQPEQFVEIGEALAKELGINAGDKVKVSSNRGYIKAVAVVTKRIRPLQVDGKTVHHVGIPIHWGFAGMARNGFLANTLTPFVGDGNTQTPEFKSFLVNVEKA

SEQ ID NO: 9298 - protein, 418 aa, Magnaporthe grisea 70-15
MSLSNKLSITDVDVKGKRVLIRVDFNVPLDDNKNITNNQRIAGAVPTIKHALDNGAKTVILMSHLGRPNGSPNPKYSLKPVVSELEKLLGGKKVTFAPDCVGPEVEEIVNKAGEGDVVLLENLRFHIEEEGSAKDKEGNKTKADKAKVEEFRKGLTKLGDIYINDAFGTAHRAHSSMVGVDLPQKAAGFLMKKELDYFAQALESPKRPFLAILGGAKVSDKIQLIDNLLDKVNTLIVCGGMAFTFKKVLDNMAIGNSLFDEAGSKTVPELMKKAQEKGVKVVLPVDFITADKFAADAKTGSATDKEGIPEGWMGLDCGEKSVELFQSAIDESQTVLWNGPAGVFEFDAFAKGTKATLDAAVSGCGKGKIVIIGGGDTATVAAKYGVEDKLSHVSTGGGASLELLEGKELPGVTALSSK

SEQ ID NO: 9299 - protein, 746 aa, Oryza sativa (indica cultivar-group)
MDTLNHIGAGDKLYGDNGTLAVVLHHGGASCKKNSSIPQTGTLSHIGAGSGVSSDESMLYDAVIAKPGAGSGDELYGDNSALAVVLHHGGASCKKNSSIAQTGTLSHIGAGSGVSSDESMLYDAVIAKPGVGSGDKLYGDNGALAVILHHIGAGHEKNKAYDVIDHTGADGKDSMVNDHVGAGGDQNKVFDNIGALGMPAAQQAPPSTGKVNHYQSSDHLGNNYHHDESSVRQLLHTRGRLCTRPGRILVPGGRGAHLYAAPSYTLAAADQIHNLQLFGVNNFAATGIIDYFGAGADDLGTASSVFDAADDITLAHYLAMATVQSVWQENCMEQFKLVLEALHQPHRNLYIAVDMEFTADAATNMSHRPVTSTSCYQHVRRYVNGGDIVQMGLTFAFVGDVEGEQAPSPPIALEINFDFNVNSPKYHGESIHFLSSQGHDLTQHSKRGVTPEFVYEGLLRHLPFGDGSVTWVAYHGDYDLAFLLRLLQGGDHGGNCLLPPKLATFLQKVREKFPVFYDVRVLGKLVKDGFNGSLTALAEYLGIPRNGDEHHAGSDALLTLSCFFKIVSLSGHQMHRMDARRGLLAGLEEWNMAIKCARHIDDHTGSIYVVKMLPHKLDEEARRIEELVATNFNIVGVEFAKFMASCGALGDPNISWVTFHGAHGIARMIRSSDIVTIPWIECKGGLFDVAQALNLKEIEADMEAARVLLTLRCYMRLAERPDFPGTKMAVQGLLKESCCWKCPANC

SEQ ID NO: 9300 - protein, 607 aa, Bacillus thuringiensis serovar konkukian str. 97-27
MNKEERAKRQSKIRNFSIIAHIDHGKSTLADRILEKTNALTQREMKAQLLDSMDLERERGITIKLNAVQLNYKAKDGEEYILHLIDTPGHVDFTYEVSRSLAACEGAILVVDAAQGIEAQTLANVYLALDNNLEILPVINKIDLPSADPERVRQEVEDVIGLDASEAVLASAKAGIGIEEILEQIVEKVPAPTGDSEEPLQCMIFDSLYDPYRGVIAYIRVVNGTVKVGDKVRMMATGKEFEVTEVGVFTPKTTQRDELTVGDVGFLAASIKNVGDTRVGDTITHAKRPAAEPLAGYRKLNPMVFCGLYPIDSARYNDLRDALEKLELNDSALEFEPETSQALGFGFRCGFLGLLHMEIIQERIEREFKIDLITTAPSVIYKVFLTNGEDMIVDNPSNMPDPQIIDRVEEPFVKAAIMVPNDYVGAVMEICQGKRGTFIDMQYLDETRVTLTYEIPLSEIVYDFFDQLKSNTKGYASFDYELIGYKPSKLVKMDILLNSEQVDALSFIVHRDSAYDRGKVIVEKLKELIPRQQFEVPIQATIGNKVVARSTIKAMRKNVLAKCYGGDISRKRKLLDKQKEGKKRMKSVGSVEVPQEAFMAVLKMDDN

SEQ ID NO: 9301 - protein, 857 aa, Brassica oleracea var. alboglabra
MKGVRNIYHHSYTSILLVFVVMILFHPAFSIYINTLSSADSLTISSNRTLVSPGNIFELGFFRTTSSSRWYLGMWYKKLSDRTYVWVANRDNPLSNSIGTLKISGNNLVILGDSNKSVWSTNITRGNERSPVVAELLANGNFVMRDSNNNDGSGFLWQSFDYPTDTLLPEMKLGYDLITGLNRFLTSSRSLDDPSSGDYSYKFESRRLPEFYLLKGSGFRVHRSGPWNGVQFSGMPEDQKLSYMVYNFTQNSEEVVYTFRMTNNSIYSRLTISSEGYLERLTWTPSSGMWNVFWSSPVDLQCDVYKICGPYSYCDVNTSPVCNCIQGFNPLNVHQWDLRDGTSGCIRRTRLSCSGDGFTRMKNKKLPETTMAIVDHSIGLKECKKWCLSDCNCTAFANTDIRNGGTGCVIWTERLEDIRTYFTDGQDLYVRLAAADLVKKRNANGKIASLIVGASVLLLLIMFCLWKRKQNRVKASAISIANRQRNKNLPMNGMVLSSKKQLRRGNKTEELELPLIELEAVVKATENFSNCNKLGEGGFGIVYKGRLLDGQEIAVKRLSKTSVQGTDEFMNEVTLIARLQHINLVQIFGCCIQADEKMLIYEYLENSSLDSYLFGKTRSSKLNWKERFEITNGVARGLLYLHQDSRFRIIHRDLKVSNILLDKNMIPKISDFGMARIFAREETEANTMKVVGTYGYMSPEYAMHGIFSEKSDVFSFGVIVLEIVTGKRNRVFYNLNYEDNLLNYAWNNWKEGRALEIVDPAILDSLSSLPSTFQPQDVLKCIQIGLLCVQDLAENRPTMSSVVWMLGSEATEIPQPKPPGYCLVRSPYEPDPSSNRQREDDESWTVNQYTCSVIDAR

SEQ ID NO: 9302 - protein, 325 aa, Yarrowia lipolytica CLIB122
MSSNSLEQLKAAGTTVVTDTGEFESIAKYKPQDATTNPSLILAASKKPEYAKLIDEAVSFAKTKSSDPKEQVNIALDQLLIEFGSEILKIVPGRVSTEVDARLSFDKDATIKKALQLIDLYKAKGISSDRILIKIASTYEGIQAAKELESKHGIHCNLTLLFSFVQAVACAEAKVTLISPFVGRILDWHKAATGKTYDAAEDPGVISVKNIFDYYKKFDYKTIVMGASFRNTGEIKELAGCDFLTISPGLLEELLNSTDPVPQKLFADKAKSLDIEKKAYLDEEPIFRRDFNEDQMATEKLSDGIRKFAADAVTLSKLIETKLSA

SEQ ID NO: 9303 - protein, 420 aa, Marinobacter sp. ELB17
MAIKNAFYAQSGGVTAVINASACGVIQTARRHPDKIGKVYAGRNGILGALKEELIDTSLESDSAIAALMHTPGGAFGSCRHKLKNISENRREYERLIEVFRAHDIGYFFYNGGGDSQDTAYKVSQISEKMGYPITCIGVPKTVDNDLPFTDCCPGFGSVAKYIAISTMEASLDIKSMCETSTKVFILEVMGRHAGWIAASGGLAGQGEGEPPHIILFPEIPFDREAFLARVDFCVKEYGYCVIVASEGAQYEDGRFLAEAGARDAFGHTQLGGVAPALANLMKQALGYKYHWAVADYLQRSARHIASATDVEQAYTVGKAAVEMAIAGKQALMPIIVREQSTPYRWRVGEAPLSEVANQEKKMPIHYITDDGFGITQDCRDYLSPLIQGESFPPFENGLPKVAKLKNQLVEKRLRTAFEL

SEQ ID NO: 9304 - protein, 446 aa, Mycobacterium tuberculosis
MNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSMTEIERLDAIAGEAGIVQDVLVRLTVGVEAHTHEFISTAHEDQKFGLSVASGAAMAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGMSDNIRTGLYGAQYDVRLVSRVSDAPPVPARLVGKHCESGDIIVRDTWVPTIFGPAIWLRLPPPALLLFAVESLQHGRPSRCGSGARGNARLVLRRETVDDLLSLEVR

SEQ ID NO: 9305 - protein, 276 aa, Zea mays
MSYYERRGGDRGSGRIQGSGGRGGHVLRGRSGLAPRGPLGVNSRPSARTIAKSFSRTKDMTWRPDLFSDSMAASGIETGTKLYISNLDYGVSNEDIKELFSEVGHLKRFAVHYDGYGRPNGTAEVVFTRRSDAIAALKRYNNVLLDGKAMKIEVIGNDLGLPMTPRINVVGASNGRATRTVVMTPEFSQRGRGSSSRPLSNPSNRFNNRGGFQAGRGPGRGRGQFQSWGRGRGQFQSRGRGRAQFQGRGRGRKPEKTADELDKDLESYHAEAMKTD

SEQ ID NO: 9306 - protein, 389 aa, Mycobacterium leprae
MAQREWVEKDFYKELGVSSDASPEEINRAYRKLARYLHPDANPDNSSGERFKVVSEAHNVLSDPVKRKEYDETRRLFAGGCLGGRRFDSSFGDFGMGGDGAEFNLNDLFDAASRTGGTNIGDLFGGLFGRGASVRPSSRRGNDLETEADLDFVEAAKGVAMPLRLTSPAPCTNCHGSGARPGISPKVCSTCNGSGVINRNQGAFGFSEPCTECRGSGSIIEHLREECKGTGVTTRTRTINVRIPSGVEDGQRIRLAGQGEAGLRGAPSGDLYVTVHVRPDKIFGRNGDDLTVTIPVSFTELALGSTLSVPTLDGTVGVRVPKGTSDGRILRVRGRGVPKRSGGHGDLLATVKVAVPLNLEGAAQKALEAYAAAERQVVSTLGRDGAGNR

SEQ ID NO: 9307 - protein, 459 aa, Pseudomonas putida GB-1
MTLRVAIIGAGPSGLAQLRAFQSAHAQGAPMPEIVCFEKQADWGGMWNYTWRTGLDQHGEPVHGSMYRYLWSNGPKECLEFADYSFDEHFGRPISSYPPREVLWDYIQGRVKKAGVRDYIRFNTVVKNVSFNERTREFTVSAHDYSVGVGIEQVFDFVVVASGHFSTPHVPEFEGFERFTGRILHAHDFREAVEFKGQDLLIVGSSYSAEDIGSQCYKYGARSITTAYRTQPMGYKWPKGWEERPQLVRVENDLAFFADGSSKRVDAIILCTGYQHHFPFLPDELTLKTNNRLWPAGLYQGVVWEQNPQLLYLGMQDLWYSFNLFDAQAWFARDYMMGRIKLPSRAGMQADSQRWREDEEGLETTASMYEFQGRYIKHLIEQTDYPRFDIDAVNRIFLQWKQDKKHDIMGYRDKSYRSVLTGTKAVPHHTRWMQAMDDSLQEYLRETDGKKGEVKALRG

SEQ ID NO: 9308 - protein, 614 aa, Acidovorax sp. JS42
MNAPDKFASLLALTREPFPASTKSYLAGSQPGLRVPVRDIQLTNGEVVSVYDTSGPYTDPAVQIDVRKGLASVRGEWIAARGDTEGYEGRVRKALDDGQKAEDGDRLAQLRAEAAALQRQPLRARSGANVTQMHYAKKGIVTPEMEYVALRENGRREWMQQYMQDTAREQRLAGNPLGASIPKIITPEFVRDEVARGRAIIPANINHPEVEPMAIGRNFKVKINANIGNSAVTSSIEEEVEKLVWAIRWGADNVMDLSTGKNIHTTRDWIVRNSPVPIGTVPIYQALEKVGGIAEDLTWEIFRDTLIEQAEQGVDYFTIHAGVRLAYIQLTAARRTGIVSRGGSIMAKWCMAHHKESFLYTHFEDICDIMKAYDVSFSLGDGLRPGCASDANDEAQFAELHTLGELTQIAWKHDVQTMIEGPGHVPMHMIQANMTEQLKTCHEAPFYTLGPLTIDIAPGYDHIASAIGAAMIGWMGTAMLCYVTPKEHLGLPDRDDVKQGIIAYKIAAHAADVAKGHPGARARDDALSQARFDFRWQDQFNLGLDPDTAKEYHDETLPKDSAKVAHFCSMCGPKFCSMKITQEVREFAQQGLQSKAEEFNRTGGELYVPIHRAD

SEQ ID NO: 9309 - protein, 181 aa, Hordeum vulgare subsp. spontaneum
MEYQGQQQSGQATNRVDEYGNPVAGHGVGTGMGAHGGVGTGAAAGGHFQPMRKEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 9310 - protein, 398 aa, Pseudomonas putida GB-1
MKSNILIIGAGFAGVWSALSAARLLDQAQRDDLSISVLAPQAELRIRPRFYEANAHTLKAPVGELFEAVGVRFITGNAEAIDADARNVSYTDSHGQRQQISYDRLILAAGSQVARPAVPGLAEHTFDVDQMESAVRLEQHLAGLAALPASPARNTVVVCGGGFTGIETATEMPARLRAILGNDVRVLLVDRGVSVGAALGAGIKPSIVAASQLAGVEWLTGTSVVAVDAGGVTLDNGDYIASNTVIWTVGVKASPLTAQVAGERDNFGRLKVDDHLKVIGQQHIYATGDTAWAAVDEIGNHALMTCQHAIPMGRHSGNNAMADLLGVTPVVYRQPKYVTCLDLGEWGAAYSEGWERELKLQGQEGKDLKRQINSVWIYPPAADRALALAAADPMIAIV

SEQ ID NO: 9311 - protein, 191 aa, Hordeum vulgare subsp. spontaneum
MEYQGQQQHGQATNRVDEYGNPVAGHGVGTAMGEHGGVGTGMGAHGGGGTGAAAGGHFQPTRKEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 9312 - protein, 575 aa, Enterococcus faecalis V583
MSEMLKGIAASDGVAVAKAYLLVQPDLSFNKTSVEDTDAEATRLDDALAKSTEELQAIRDKAAQSLGEAEAQVFDAHLMVLSDPEMVGQIKQNIQDNKVNAEAALKEVTDMYIGMFEAMDDNAYMQERAADIRDVAKRILAHLLGVTLPNPSMINEEVIVVAHDLTPSDTAQLDRTYVKAFVTDIGGRTSHSAIMARSLEIPAIVGTKEITDKVKAGDILAVNGIIGDVIIDPTDAEKSEFEAEAKAYADQKAEWDKLKNAETVTADGKHVELAANIGTPKDLEGVHKNGGEAVGLYRTEFLYMDSSDFPTEEDQYQAYKAVLEGMEGKPVVVRTMDIGGDKELPYLTLPHEMNPFLGYRALRISLSELGDGMFRTQMRALLRASVHGNLRIMFPMVATLKEFRAAKAIFEDEKQKLVNEGVEVSNDIQVGIMIEIPAAAVLADKFAKEVDFFSVGTNDLIQYTMAADRMNERVSYLYQPYNPSILRLIKNVIDAAHAEGKWAGMCGEMAGDQTAVPLLLGMGLDEFSMSATSILKTRSLMKRLDTTKMAELADRALKECDTMEEVFALVEEYTK

SEQ ID NO: 9313 - protein, 274 aa, Streptococcus pneumoniae TIGR4
MKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 9314 - protein, 263 aa, Triticum aestivum
  misc_feature (213)..(213): Xaa can be any naturally occurring amino acid
  misc_feature (221)..(221): Xaa can be any naturally occurring amino acid
NEAAKFRYRSGNEFNCGGLTIRSPYGAVGHGGHYHSQSPEAFFCHVPGLKVVIPRSPREAKGLLLASIRDPNPVIFFEPKWLYRLSVEEVPEGDYMLPLSQAEVIRKGSDITLIGWGAQLAVLEQACEDASKDGISCELIDLRTLIPWDKETVEASVSKTGKLLVCCLFGLILCSIVIFLTENAPLSVNEVLSHHRLVMRPRSPEGFGAEIAXASIAERCXQRLEAPVARVWGLDTPFPHVYEPFYMPTKNKILDAIKATVNY

SEQ ID NO: 9315 - protein, 275 aa, Cucurbita pepo
MAGRSSPREEFVYLAKLAEQAERYEEMVEFMEKVSAAVDNEELTVEERNLLSVAYKNVIGARRASWRIISSIEQKEESRGNDDHVSIIRDYRSKIETELSNICGFRILNLLDSRLIPSAASGDSKVFYLKMKGDYHRYLAEFKTGAERKEAAESTLTAYKSAQDIANAELPPTHPIRLGLALNFSVFYYEILNSPDRACSLAKQAFDEAIAELDTLGEESYKDSTLIMQLLRDNLTLWTSDIRGSRDDIKEAAPKRDCTNSSEQIDLHVQDSTSP

SEQ ID NO: 9316 - protein, 336 aa, Glycine max
MLMPPSSFTLLLTLLLLFLTYEAESGETPPPTPPPPFRPGIAVLVCVLTTIISLTSLLLLYIKHCNGGIPDGGGGNSAPWTVAPFSGRKNSGIDRSVVESLPVFRFGALRGQKEGLDCAVCLNKFEAAEVLRLLPKCKHAFHVECVDTWLDAHSTCPLCRYRVDPEDILLVEDAKPFRQSHQQQRNKEEERVRLNLDLEKQEIVESRRRHSSVGVGEGETTEEQQQSRRWTTSFRRSLDSISATSRKKNESVGVGCFVRPRKDGMLLTQETERASVERRLEHRIIVSPGQGPGPGPGPGPCGLEQRWSDLQASDLLYLTSEMIMMRDSWNGRGSGV

SEQ ID NO: 9317 - protein, 738 aa, Oryza sativa (indica cultivar-group)
MGVHPFAKAANGFVMQADAPDAKLADVQAVADAIHGNTKLANIQAVADVIHGNAKLADVQAVPDAIQGNTKVFDIQAVADAIHGNTMLADIQAVADAKPNIQFVPDAIHGNTKVFDIQAVADAKPDVQAVPGAIHGNTKVADNSVVADAIQGNTKLTDVHPFMEGDCSIKLADAQVRNKAVDGFDATNMSPLVARCLAHHLAKVSVQRVWQGNYPEMFKPVLDAFGQPHRRIYIAFDFEFAADAFTNMHCWPGCTKTNYEYLRRYVNGGDVVQMGLAFVFEDEVDEEPTFTAMALEINFDFTVELRKYNGEAISFLSEQGHDLTEHRDRGVVPHFVYTGLLSHLPFGNSSVTWIAYHGDYDFGFFLRLLQGGCRGSSHLPLELPTFLHQLRLNFPRLYDIRVLGQLVQHGFRGSLTAIADLLGVNRFGRGHHAGVDALLTLSCFFQIVSCLSASGDHQLHRLDSRQGLLAGIAQVNKAIKDARHIGDRTSNIDVIKVQAGNLDEEAQRIQELVPSNFNIIGVEVMHPQLGNRSYAIGAQQNYESMKTYLKDADSFEIVIAFVNSEGMLAYDCVWKFCISSTPRSGCLHPRQFTRLMASCGATSNPNVSWVTFHGAHGIASLISSFSAPQDLPSDWPSYVEQRRAYFPGMYDVALIVHRYPDIGILPTTGCKGGLFDVARALDLNFIKDDNPVTRVLLTLRCYMRLADRGDFPDKQSAVQGQLMENCCWNCPAKRMEHA

SEQ ID NO: 9318 - protein, 684 aa, Methanobacterium formicicum
MDIKYVPTICPYCGVGCGMNLVVKDEKVVGVEPWKRHPVNEGKLCPKGNFCYEIIHREDRLTTPLIKENGEFREATWDEAYDLIASKLGAYDPNEIGFFCCARSPNENIYVNQKFARIVVGTHNIDHCARLCHGPTVAGLAASFGSGAMTNSYASFEDADLIFSIGANSLEAHPLVGRKLMRAKMNGAYFIVADPRYTPTAKQADQYIPFKTGTDVALMNAMMNVIISEGLEDKEFIEKRTKNYEELKEVVSKYTPEMAEEITQVPADVIRDIAIKYAKADKAAIVYSLGITEHSHGVDNVMQTANLAMLTGNIGRLGTGVNPLRGQNNVQGACDMGALPTDYPGYRKVADQEVMEDVTCTWGCSDLGCEPGLKIPEMIDAAAKGDLKVLYITGEDPVISDPDTHHVEEALNNLDFFVVQDIFMTDTAEFADVVLPAACWAEQEGTFTNGERRVQLIRKAVDAPGESKYDWEIFCDLAKKMGADPEMFTYESAQDIFEEVRTVTPQYAGMNRERLDRPEALHWPCPSEDHPGTAMMHIEKFAHPDGLGIFMPLEEQGPMETPDDEYPLILTTTRLLFHYHAAMTRRAATLDREVPTGYVEINTEDAAELGIANKEKVKVKSRRGEIEIAARVTDDIVKGIVNIPMHFRECSANILTNAAAIDPKSGMPEYKACAVAISKMEGSK

SEQ ID NO: 9319 - protein, 430 aa, Pyrococcus abyssi GE5
MTMENPYEIVAVIAREILDSRGNPTVEVDVHTPISMGRAAVPSGASTGTHEAVELRDGGKRYHGKGVRRAVENVNKIIAPELVGMDVRWQREIDRLLIELDGTENKSNLGANAILAVSLAVAKAAANALELPLYQYLGGVNAYVLPVPLSNVINGGVHAGNDLDFQEFMIMPIGANSFREAIRWVSETYHVLKKVIAEKYGKNAVNVGDEGGFAPPMKEVTEPLDVLIKAIEEAGYKPGEEIALALDAASSEFYKDGKYIVSGKEYTREELLELYKELTSTYPIVSIEDPFHEEDWEGFVMITRELGKKVQIVGDDLFVTNPKRLKKGIEMGAANALLLKVNQIGTLTEAMDAAYMAFRAGYGVVVSHRSGETEDATIADLAVALNAGQIKTGAPARSDRNAKYNQLIRIEEELEGVAVYAGKNFRKVFF

SEQ ID NO: 9320 - protein, 546 aa, Bacillus licheniformis
MKKYRVNVQGMTCTGCEEHVAVALENMGAKRIEVDYRRGEAVFELPNGLEVETAKKAIAEAKYQPGEAEEVQSQELIQLGDEGDYDYIIIGSGGAAFSSAIEAVKYGAKVAIIERGTVGGTCVNIGCVPSKTLLRAGEINHLAKNNPFVGLHTSADDVDLAPLIKQKNELVTDLRNSKYVDLIDDYGFELIKGERKFVDEKNVEVNGIQLSAKRFLIATGASPAVPNIPGLDEVDYLTSTTLLELKKVPKRLTVIGSGYIGMELGQLFHNLGSEVTLIQRSERLLKEYDPEISEAITKALTEQGINLVIGAIYERVEQDGDMKKVHIEINGKKRIIEAEQLLIATGRKPNTESLNLHAAGVEVGSRGEIIIDDYLKTTNSRIYAAGDVTLGPQFVYVAAYEGGVAAGNAIGGMNKKLNLEVVPGVTFTTPAIATVGLTEQQAKEKGYEVKTSVLPLDAVPRALVNRETTGVFKLVADAKTLKVLGAHIVAENAGDVIYAATLAVKFGLTVEDLRGTMAPYLTMAEGLKLASLTFDKDVSKLSCCAG

SEQ ID NO: 9321 - protein, 405 aa, Shewanella oneidensis MR-1
MSVDMKLNRAQFDAVMVPNYAPAAVIPVRGEGSRVWDQEGNEFIDFAGGIAVNCLGHCHPALVNALKTQGEKLWHLSNVMTNEPALELATKLVNSTFAERVYFANSGAEANEAALKLARRYALEKHGVEKDEIIAFDKAFHGRTFFTVSVGGQAAYSDGFGPKPQSITHLPFNDVAALEAAVSDKTCAIMLEPLQGEGGIIDADPAFLKAVRELANKHNALVIFDEVQTGVGRTGELYAYMGTDIVPDILTTAKALGGGFPIAAMLTTTEIAEHLKVGTHGSTYGGNPLACAIGNAVLDVVNTPEVLNGVKHREQLLRDGLNKINEKYHVFSEVRGKGLLLGAVLNEQYQGRSRDFLVASVAEGLMSLMAGANVVRFAPSLVIPEADIAEGLARFERAVASIAAA

SEQ ID NO: 9322 - protein, 314 aa, Oryza sativa (indica cultivar-group)
MVAGAAGCSSASPPPQPGGSEAGRLVLAGGRLLLHHRARMRWVGDVAPADLHATCSESVFFHFLVSDPALGDLVRAVFPQLQFKVYYFDPDRVRSLISTSVRQALEQPLNYARNYLADFLEPCVHRVIYLDSDLVVVDDVSKLWCTDLGSRTVGASEYCHANFTKYFTDRFWSDKQFAGTFAGRRPCYFNTGVMVLDLTRWRRTGYTRRIERWVEIQKSPAGRIYELGSLTPFLLVFAGHVAPIEHRWNQHSLDSDNVFGSCRDLHPGPASLLHWSGSGKPWARFGAGRPCPLDALWAPFDLYGPADSAAEGSR

SEQ ID NO: 9323 - protein, 341 aa, Oryza sativa (japonica cultivar-group)
MASESDSFVRMMSEETHVEAYSLPMQNEDLHTSTNGAKGRAKRSSNFNRTEDVQLCISWQSISSDSIIGNEQPRKAYWQRIAEHYHANRDFESDRNANSLEHRWGNIQKEVRKFQGCYDQIERRHPSGIPHQELVLEVEALYSSNAPKNRAFQFNHCWLKLRNSPKFQTLESHKRPRSRKSSTPIEIAGEEDEEGDDARKSTTPDLSQPSAKKRPIGRKQAKEKLKNGGEDGPYKEAMKVLEFVSNMCADGIRRGPAPVIGGGGFRGEQWCRLLRGEAAANLQGGGGDGPEKGARRGGGLQGRRASGGLAAEREGANRQGGGCPAGRWPVGQEGAREEATG

SEQ ID NO: 9324 - protein, 140 aa, Erythrobacter sp. NAP1
MAVTRTFSIIKPDATKRNLTGAVTKKLEEAGLRVVASKRIHMTREQAEGFYAVHKERPFFGELVEFMMSEPVVVQVLEGEDAVKRNRDVMGATNPAEADEGTIRKEYALSIGENSVHGSDSEENAAIEIAFFFNDDEIVG

SEQ ID NO: 9325 - protein, 122 aa, Triticum aestivum
RPVRVSSYRYELGSDTFIRNHLRRLYDAMLEQNLIKVIEPFSRVEIDHIANMVGLDTQQVERKLSQMILDKVIIGVLDQGAGCLIIFDETHRDESYDAALATIEKLSSVVDVLYTNQASMLE

SEQ ID NO: 9326 - protein, 366 aa, Bacillus thuringiensis serovar konkukian str. 97-27
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSAEEAISYSLSGANLRCTGVNWDLRKDEPYSIYDRFDFHIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 9327 - protein, 489 aa, Oryza sativa (japonica cultivar-group)
TPFLQLPPKPPPNLLFSSPLASVELRHRARARRRRRPSHPRRAPAMRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNIKVSDFGLSALPQNQRKDGLLHTTCGSPNYIAPEVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 9328 - protein, 493 aa, Pseudomonas putida GB-1
MTLVRFQMCIDGQWRDAQSGKTFDSLNPATAQAWAQLPDADEADVELAVQAAQRAFDSKEWRSITATARGKLLRRLGDLIAENKEHLAQLESRDNGKLIRETRGQVGYLPEFFHYTAGLADKLEGGTLPLDKPDLFAYTVHEPIGVVAGIIPWNSPLYLTAIKLAPALAAGNTIVLKPSEHASATILELARLALEAGFPAGVVNVVTGYGPTTGAALTRHPLVRKIAFTGGAATARHVVRSSAENFAKLSLELGGKSPNIIFADADLDSAINGAVAGIYAASGQSCVAGSRLLVQDEIFDEFVERLIARAKRIRIGNPQDDASEMGPMATAQQLAVVEGLVAAAKAEGAKLHLGGKRAEVEGDGWFYEPTLFECDSNSMTIMQEEVFGPVAAVIRFKTEEEALAIANDSQFGLAAGIWTRDLGRAHRLARDVRSGIIWVNTYRAVSAMAPIGGFKNSGYGRESGIDSVLAYTELKTVWINLSTAPMPDPFVMR

SEQ ID NO: 9329 - protein, 135 aa, Nocardioides sp. JS614
MSLRTLVLLKPDAVRRGLVGAILSRYEAKGLTIVAMEQRTIDAAVADQHYAEHVAKEFYPPLRDFVTGGPLVALVLEGDNSVDVVRLLNGATDGSKAAPGTIRGDFSLSNRENLVHGSDSPESAEREIGIWFPGL

SEQ ID NO: 9330 - protein, 750 aa, Oryza sativa (indica cultivar-group)
MASSSNPSNLPCSSDGVCMVCKVLTAEVEQLRCSTCATPWHTPCLSSTPPLTDVAHWVCPDCSGDVTASYLPSDVARPESSLIAAIRVIEADPVLSIQEKARRRQELLGHAGDAGAARTEAVGENVEDSESNNPLSMLNKNINCSFCMLLPERPVTTPCGHNFCLKCFRRWIENGKRACVNCRAPITQKVAQDLIINLALVQAIRMANAANNASTTGETTVYHYKENEDKPDRAFTTERAKRAGMANASSGQIFVTIAPDYFGPILEDHDPRRNRGVRVGDHWKDRMECRQWGAHFPHIAGIAGQSTHGAQSVALSGGYLDDEDHGEWFLYTGSGGRDLSGNKRTSKEQSFDQKFEKLNAALRVSCLNGYPVRVVRSFKEKRSPYAPESGVRYDGIYRIEKCWRKTGVQGTFKVCSDEHGDHPRPLPDIEELKNAIDITERKGNPAWDFDATDGWKWMITPPISTKAVVTGDPRGKKMQGAARHTNNLSMRERLLKEFRCSICRNVMEEPVTTPCAHNFCKKCLLGSYDNLSLTEERSRGGRILRARKIVKKCPSCPSDIADFIQNPQVNRDIMNVIESLQNEAEKEDHARVSGEGSSAALVDSDDENDTAWENQDDGNLDEGGCNNPEDMITESVDLDSVTNVDNTENKVEVQQPHKRTAGAGKGKGGKRARTSSPGDADARNIVTSTETLDGIAADENVADLVQTEDCTFTGVERADPNALEVDGKNMIPDFSEAEKVNPKQDQEVLP

SEQ ID NO: 9331 - protein, 184 aa, Hordeum vulgare subsp. spontaneum
MEYQGQQQHGQATDRVDEYGNPVAGHGVGTGMGAHGGVGTGAAAGGGGGHFQPTRAEHKAGGILQRPGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 9332 - protein, 620 aa, Oryza sativa (indica cultivar-group)
MASSSNPSNLPCSSDGVCMLCKVLTTEVEQLRCSTCATPWHTPCLSSIPPLTDVAHWVCPDCSGDVTASYPPSDVVRPESSLIAAIRVIEADPVLSIQEKARRRQELLGHAGDAGAAITEAVGENVEDSESNNPLSMLNKNINCSFCMLLPERPVTTPCGHNFCLKCFRRWIENGKRACVICRAPITQKVAQDLRINLALVQAIRMAKAANNASTTGETTVYHYKENEDKPDRAFTTERAKRAGMANASSGQIFVTIAPDYFGPILEDHDPRRNRGVRVGDHWKDRMEGRQWGAHFPHIAGIAGQSTHGAQSVALSGGYLDDEDHGEWFLYTGSGGRDLSGNKRTSKEQSFDQKFEKLNAALRVSCLNGYPVRVVRSFKEKRSPYAPESGVRYDGIYRIEKCWRKTGVQGTFKVCSDEHGDHPRPLPDIEELKNAIDITERKGNPAWDFDATDGWKWMITPPISRKAVVTGDPRGKKMQGAARHTNNLSMRERLLKEFRCSICRNVMEEPVTTPCAHNFCKKCLLGSYDNLSLTEERSRGGRTLRARKIVKKCPSCPSDIADFVQNPQFLSRYNAVVDLPPGLGRQLSRLYERKLSNWTDFSTKFGCYFIRISIELDCFD

SEQ ID NO: 9333 - protein, 184 aa, Hordeum vulgare subsp. spontaneum
MEYQGQQQHGQATDRVDEYGNPVAGHGVGTGMGAHGGVGTGAAAGGGGGHFQPTRAEHKAGGILQRSGSSSSSSSEDDGMGGRRKKGIKDKIKEKLPGGHGDQQHAAGTYGKQGIGMAGTGSTYGQQGHTGMTGTGATGTMATGGTYGQPGHTHMTGTGTHGTDGTGEKKGIMDKIKEKLPGQH

SEQ ID NO: 9334 - protein, 519 aa, Enterococcus faecalis V583
MNNDVHEIKQLDGTRIGFILKGIVVGILVGFVVSLFRLGIEKIGEQVVHLYQTFHEKTFWMIPWFLFSLVLAYLLGRLIKSEPAIKGSGIPQVEGQLQGQLEIHWFPVLWKKFIGGILAISPGLFLGREGPSIQLGAVVGQGYSQWRQSTKSEEKILISSGASAGLAAAFNAPIAGLLFVLEEVHHSFSPLVWLTSFSAAISANFVSLHFFGLQPVLYIGPVKSLPLEYYWTLVLLGVLLGLLGWIYQKTLLSLPKVYGKIKGLSSNYYGFVSFILILPIGYFFPHLLGGGNQIVLALGNQPTTIWALVGLLVLRFVFSMVSYGSNLPGGIFLPILTLGAIIGTLYGSLLVQYVGMDPIFVKNFLIFAMAGYFTAIGKAPLTAIILVTEMVGNFSHLMSLGVVALVSYITIDSLGGKPIYESLLERLVPSKVSNIRGHKTIIELPITAESSLDDTMVRDFVWPKQMLLTSIRRGESEILTHGDTVMHVGDVLIILTDEKLAYQVKKEIYQKTLPNDLVN

SEQ ID NO: 9335 - protein, 423 aa, Ralstonia solanacearum GMI1000
MARFRASFPPAIMTGLTTALLHADREAGIEHYAVHKPLHTSTTYGYADTRDLIDVFQGKPGYTYARQGNPTTAALEAKITMMEDGLATACFATGMAAIAAVFSTLLRAGDHVVSSAFLFGNTNSVFETLRNLGVEVTFVDATSAQAVADAVQPNTRLVFVETIANPRTQVADLGGIGALCKARGLLYVIDSTMTSPWLFRCRDAQAGLVVHSLSKYIGGHGNALGGAVVDTGLFDWTAYPNIFPAYRKVKPEMQGIQQIRKKGLRDLGATLIADAAHRIAIGAETMALRVDRTCSNALALARTLAAHPKVARVYYPGLADHPQHARATELFRHYGGLLSFELVDGADYVDMLNHLRYAVRATHLGDTRTLVIPVAPTIYWEMGAERRASMGIADSLVRVSVGIEDEVDLLADFTQALDATGIR

SEQ ID NO: 9336 - protein, 414 aa, Shewanella sp. MR-7
MDHFLYQDNTLYAEGCRVNDLAQQYGTPLYIYSRATLERHWHAFNNAVADHPHLVCYAVKANSNLAVLNVLARLGSGFDIVSGGELARVIEAGGDPAKVVFSGVGKTVAEMEQALNLGIYCFNVESSAELEQLNQVAGRLGKVAPVSLRVNPDVDAGTHPYISTGLKENKFGIAMDEAEVVFARAHALPHLQVKGVDCHIGSQLTEIQPFLDAMDRMLALIDRLAEQGIVIEHFDVGGGLGVTYDDETPPHPDVYAAALLARLGDRKLKLIFEPGRAIAANAGIFVTQVLYLKENSDKRFAIVDGAMNDLIRPALYSAWQNIIPVNPRDEQAQVFDIVGPVCETGDFLGKDRALAIAAGDLLVVRSSGAYGFAMASNYNTRPRAAEVMVDGDKAYLVREREKLAQLWQGEQLLP

SEQ ID NO: 9337 - protein, 188 aa, Glycine max
MDNMACNKGQRLRKAKKKQVKDELDRLKQAEKKKRRLEKALATSAAIISELEKKKQKKKEEQQRLDEEGAAIAEAVALHVLLGEDSDDSCNVVINDCECKTWNYNHKLGLFMDERRACFPHLDGGTWSVSAESGKWSFTSGPLEKNVYEPLYEEAGWGPTGFSVDLIAAQAVRSLHIAKEADEARIIF

SEQ ID NO: 9338 - protein, 715 aa, Escherichia coli
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVCHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 9339 - protein, 370 aa, Nocardia farcinica IFM 10152
MKSKAAVLWEPGAPWQIEELELDAPKYGEVLVELAASGLCHSDEHVRDGSVPVSFYPFIGGHEGAGVVREVGPGVTNLKPGDHVALGFIPACGRCRPCANGQSSICDLGAHLLDGYQVSDGTARHHVRGKDAGILCLLGTFAPYTVVNEASCVKITDDVPLDKAALVGCGVTTGWGSSVYAAGVSAGETVVVLGMGGVGCGAVQGAALAGARHVVLVDPSPVKREQAKVFGATHAVATVEEALPLVQDLTWGYLADKVLITVGVASGALIGQAMSLVAKGGVCVNVSVGDLETSDVTLNLFDLTAMRKTLKGAWFGNANIRFDIPHLLRLYMEGQLKLDEMITRTYTLEQVNEGYEAMRNAENVKGLIVY

SEQ ID NO: 9340 - protein, 480 aa, Zea mays
MPSPTIRRLDVASPVPADIDIANSVEPLPIADIAAELGLRPEHYDLYGKYKAKVLLSVLDELKAQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHENSQSDKALFNRLCPANKEGKRHFADIMFRRLTKLGVSKTDPNELTPDEIRRFARLDIDPESITWRRVMDVNDRFLRKITVGQGPEEKGMVRETGFDISVASEIMAVLALTTSLADMRERLGRMVIGNSKSGEPITADDLGVGGALTVLMKDAIHPTLMQTLEGTPVLVHAGPFANIAHGNSSIVADKIALKLVGKGGFVVTEAGFGADIGTEKFMDIKCRYSGLVPQCAIIVATIRALKMHGGGPEVVAGKPLDHAYVSENVALVEAGCINLAKHISNTRSYGVNVVVAINKFASDTEAEMKAVHSAAMAAGAF

SEQ ID NO: 9341 - protein, 352 aa, Streptococcus pneumoniae TIGR4
MKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 9342 - protein, 81 aa, Medicago truncatula
MVYHSSFVDDEGINRACGCPLLPLKSHIKGPAPVSDQDRTDIVDEAITFFRANVFFRNFDIKSPADKLLIYLTFYINVALK

SEQ ID NO: 9343 - protein, 679 aa, Oryza sativa (indica cultivar-group)
MATLARRSMVALGRRALCSGSDLEAAAREVVCSGAGSLDEVGGALDRLGVPVSPAMVARVIDACSERMGSGRRLLRFLSWCRSKDAGGIGDEALDSAIAALARMGDLTAMRIAVADAEKDGRRMSPETFTVVVEALVKLGKEDEAVRLFRGLERQRLLPQRDAGDGGEGVWSSSLAMVQALCMKGHAREAQGVVWHHKSELSVEPMVSIVQRSLLHGWCVHGNAKEARRVLDDIKSSCTPLGLPSFNDYLHCLCHRNLKFNPSALVTEAMDVLSEMRSYGVTPDASSLNILLSCLGRARRVKESYRILYLMREGKAGCSPDWVSYYLVVRVLYLTGRIIRGKRLVDDMLESGVLPTAKFFHGLIGVLCGTEKVDHGLDMFRLMKRCQLVDTHTYDLLIEKLCRNGRFENGKELWDDAKKNGFMLGCSEDLLDPLKTEEQQQDFGVLLKQGAEGRVFVSTFVGRKCVIKERFSKKYRHPLLDSKLTLKRLNAEARCMTKARKLGVPTPVLYAVDPLLHTLTFEYVDGLSVKDILLGFGSNGINEEQLIDIATQIGNAVGKLHDGGLVHGDLTTSNMIIKNNTNQLVLIDFGLSFISTIPEDKAVDLYVLERALISMHSSCGDVMEKILTAYRKASKQWCATTNKLAQACASIGKCDLTLTLTAVNGTRPTCVWAVLGPAG

SEQ ID NO: 9344 - protein, 111 aa, Rickettsia typhi str. Wilmington
MMENKNLKFIQNAIKKNKVVLFMKGTKEMPACGFSGTVVAILNKLGVEFSDINVLFDTSLREDLKKFSDWPTFPQLYINGELVGGCDIVKELYQNGELEKMLKDETKLIKN

SEQ ID NO: 9345 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPSVKNYAYFTDGSYTPEEVVQAEKYMLTILNFDLNYPNPMNFLRRISKADDYDVQSRTLGKYLLEITIVDYKFIGMRPSLCCASAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 9346 - protein, 486 aa, Pseudomonas aeruginosa UCBPP-PA14
MPTSGGVYRCRGLSLGDSGAVAATPIRVAFLNDDQTPAPLPVPRPSPCPGLLRIVQALDGGICRIKLDAGRLDAAQARAVAAAARDCASGVIEATNRSNLQLRGVRRGEEERLVRRLLDAGLGPRHGALAGADDVRNLMLSPAAGLDPHLSLDVRPLAARLLLRLQADSRYHALSAKFAIQLDGGEDLAMLEHPHDIWLSPMPAAPTATLVFGLAGCPARDRPLAALPAERGESLVLALLDLFLERAQPQQTRMRHLLQELAGESLLEALQARLDFPLRRDERVAAWRRPPGRAWSHLGVQPQRQPGLAMVGAAAPLGRLDSACLEGLAELVERHGDGSLRLTPWQGVLLPNLAQAEAHQALLGLRGLGLLTEPDAPLARLIACSGSSACARGLADTKGDALRLAERLGPRSDLPQLHLCGCERSCAAAHRAPLTLLARSGGFYDLYRRDPCHPGFGQLLASRLTFATAADYLAALPSQPTSGKPA

SEQ ID NO: 9347 - protein, 429 aa, Xylella fastidiosa 9a5c
MSDLDKVTLNAGETSLVLPVLKPTLGNGCVDIAKLTKETGLFTYDSGFTATASCKSAITYIDGEKGVLLYRGYPIEQLAEHSSFLEVAYLLMNGELPRKDEFAKFDDEITHHTMMHESLKNFLGGFHYDAHPMAMLAASVASLSAFYHDTLDLNDLEQRRLAAIRLIAKVPTLAAAAHRYSIGWPIRYPRNNLGYVERFLHMMFEVPSEPLQLNPVVTKALDLLFILHADHEQNASTSTVRLVGSTGANPYASVAAGITALWGPAHGGANEAVLKMLEEIGDAKNVDLVIAKAKTKDKNSPFRLMGFGHRVYKHFDPRAKIIREMAHTVLGELGVNDPLLEVALKLEEAALKDDYFVQRKLYPNVDFYSGIIYKAINIPLEMFTVMFAIARTAGWVSHWLEQQVDPEMKISRPRQIYTGHGERDYKDAR

SEQ ID NO: 9348 - protein, 565 aa, Gibberella zeae PH-1
MARAMGWHKPENFAGSSIRAILVGLFVSSGGLLFGYDVGVINGILAMDVFQNDFATDQTCRDENDHIDLCPIDSSLIVAILSGGAVVGSILAAPAGDSIGRRKTLFLAVVTFCIGAIFQVCAQATPMLLVGRALAGVAVGATSVLVPLYQSETAPKWIRGSIICAYQLSITVGILGATIINVITSGMNSAAAYRIPLGLQLVPGVILAFGIMLLPETPRFLVKKGRNDDAGISLSRFRRLDITHPALVNELQEIIANHQYEMTLGQDTYRALFTSNSSLGHRTLTGCVLQMLQQLTGINFVMYYGTTFFSRSGVSNPFIINLVMIIVNCVCTIPGLIVIESWGRRKLLMAGALGMAVCQFIIGAVSTANEKSSQDLGNASNMALIVCCAINVFFYASSWGPVTWVVTSEIFPLKLRAKAMSVSTTANWLLNFAVAYAPPFILGRRADAFGLKIFFIWGTFCILAIVFVWFMVYETSRMTLEQIDEMYERVSHAWESPGFNPSWSFQEMHNTGWAANGQAELQSATSTSNNISSSNTEDGGNDRHSIHSNAPPNSATPIANVDFSY

SEQ ID NO: 9349 - protein, 359 aa, Oryza sativa
MPAIADCAAEPPLADSYYALLRLGGDDDDDACTKVTTTPQPVSECELPMIDVGCLTAPTGAAAAAAVGQQHQAEERAACAAAIAAAAAEWGFFQVVNHGVAQELLEAMRREQARLFRLPFEAKSSAGLLNDSYRWGTPTATSLRQLSWSGAFHLPLAGISGKSCNYGDLTSLRDVTREVADAMSRLASALARVLAESLLGHAAGERFPEGCDDATCFLRLNRYPPCPFPPDDAFGLVPHTDSDFLTVLCQDHVGGLQLMKGSRWVAVKPIPGALIVNIGDLFQAWSNNRYKSVEHRVMTNATTERYSVAYFLCPSYDSPIGTCREPSPYKAFTFGEYRRRVQEDVKKTGKKTGLSNFLV

SEQ ID NO: 9350 - protein, 164 aa, Triticum aestivum
  misc_feature (52)..(52): Xaa can be any naturally occurring amino acid
VTLSNKFVQKSRLAPVRNSRDIVDPRVRAPHRARTRTAHRRPRRSGEERRRXVMEEAAAAAGVQLGTSKPQIATQAEMAEARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 9351 - protein, 225 aa, Brassica napus
  misc_feature (153)..(153): Xaa can be any naturally occurring amino acid
  misc_feature (157)..(157): Xaa can be any naturally occurring amino acid
  misc_feature (168)..(168): Xaa can be any naturally occurring amino acid
  misc_feature (181)..(181): Xaa can be any naturally occurring amino acid
  misc_feature (184)..(184): Xaa can be any naturally occurring amino acid
MGLEDEKKGGEASGETSDRENRLSRMNSESSLSPTEDDDDDDEDRKPELGPMIALKEQLEKDKDDESLRRWKEQLIGVVDLEDVGETPDPVVKILHLTVRSPDRDEMVLTIPDDGVPNPKGPWFTIKEGSKYTLVFNFRVTNNIVSGLRYNNXVWKXGVKVDSTKAMXGTFSPQGEPYQHXMPXETTPSGIFARGSYSARTKFIDDDNKCYLEINYTFDIRKNWQ

SEQ ID NO: 9352 - protein, 268 aa, Marinobacter sp. ELB17
MCLIAFTLGQNRHYPLVVAANRDEFFNRPTAAMEWWTGASHALASKPVLAGRDLQAGGTWLAVSANGVVSAVTNVREGSPEPGVISRGDLPLRALQQSRQALHRHLADNASRYSGFNLVTLDAGQKRAAGSGGWYFSNRDAHPGRSLHRGSYGVSNHLLQTPWPKLLRLRQHVTSTVVAAGEDSEPLHQTLINHLIDATPAPDHLLPRTGVSLDTERMLSPAFIIGEHYGTRVTTVVTVAASGEIRVTEQTWQPGGKSGECRQMCWQQ

SEQ ID NO: 9353 - protein, 456 aa, Oryza sativa (japonica cultivar-group)
MEVFYYLVFGGLAAVVAGLELGKSGKDRVATTPAFNAFKNNYILVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDPQWLSITFSKAIFLGNGLVAIIAGLFANLLADNLGFGPVAPFDAAACFLAIGMAIILSSWSENYGDTSDNKDLIAQFKVAAKAIASDEKIALLGAIQSLFEGSMYTFVFLWTPALSPNDEEIPHGFIFATFMLSSMLGSSIASRLLARKLKVEGYMQIVFSISAFTLFLPVVTNFLVPPSSVKGGGISFGGCLQLLGFCIFESCVGIFWPSIMKMRSQYIPEEARSTIMNFFRIPLNLFVCVVLYNVNAFPITVMFGMCAIFLFMAAILQRRLMVVSDLHRSTKAVEMTGEDEPLNP

SEQ ID NO: 9354 - protein, 504 aa, Ralstonia solanacearum GMI1000
MRVSELLSSLSIDGAASVEGGHQVRSPIDGTLIGSVKLVSAKESEAAIERAHAAFLQWRGVPAPVRGELVRLLGVELRRHKEALGRLVTLEAGKLLSEGLGEVQEMIDICDFAVGLSRQLYGLTIASERPGHRMMETWHPVGVVGVISAFNFPAAVWAWNSALAFVCGDSVVWKPSEKTPLTALACDALFRKAVAAFGKAHQGTAPDGLHALIVGGREAGEALVQSKRVPVVSATGSTRMGRLVSARVGERLGRAILELGGNNAMIVAPSADLELATRAITFAAVGTAGQRCTTLRRLIVHESVAANLVERLKRIYGSVTVGNPLQEGTLVGPLIDAGAYAAMARALERADAQGGRVHGGERTHLEAGPEAYYVKPALVEMPAQTEVMQQETFAPILYVLTYRTLDEAIALQNGVPQGLSSAIFTRDLNEAEWFLSAAGSDCGIANVNIGTSGAEIGGAFGGEKETGGGRESGSDAWKAYMRRATNTINYSNRLPLAQGVRFDV

SEQ ID NO: 9355 - protein, 444 aa, Pseudomonas putida GB-1
MLPAETQRTLDQHGIKYVLAQFVDIHGSAKTKSVPVSGLKMVAEEGAGFAGFAICGMGMEPHGPDFMARGDLTTLIPVPWQPGYGRVVCVGHVNGQPWPYDSRHVLQQQVQRLAEKGWTLNTGLEPEFSLFRRDEGGKLQLVDASDNLDKPCYDYKGLSRSRLFLERLTEALQPVGFDIYQIDHEDANGQFEINYTYSDAMESADRFTFFRMAAGEIANDLGMICSFMPKPDPKRAGNGMHFHLSLASSTNKNLFHDPSDSSGMGLSKLAYHFAAGLLAHGPALCAFAAPTVNSYKRLVVGRSLSGSTWAPAFVAWGANNRSAMVRIPYGRLEFRLPDAGCNPYLVTAAIIAAGLDGIDRQLEPGEMCNENLYNLSLEDIAARGIKTLPQSLKEAVDALQTDPLFREVLGAEIVDEFIKLKRMEWVEYCRHVSDWEIQRYTEFF

SEQ ID NO: 9356 - protein, 316 aa, Thermobifida fusca YX
MSELSANSTQRRAPEPEILDEKRSRTERYTIFTFVFVPLLALAAAVPFAWGWGLTWLDVAIGAVFYLIGGLGITVGYHRLFTHGSYRAARPLKIALAIAGSLAIEGGVIKWVADHRRHHKYSDHEGDPHSPWRFGDDWRSVAKGMFYAHMGWLFLDEQKTSPKRFAPDLLKDKDLVRIDRYFWVFVLISLLTPPLIGGLVTMSWWGACTAFFWGSLVRIALLHHVTWSVNSICHTIGEENFTVRDRSRNVWWLAIPSFGESWHNLHHAEPTCARHGVLKGQIDISARVIWIFEKLGWATKVRWPDPERLAAKRVAA

SEQ ID NO: 9357 - protein, 456 aa, Medicago truncatula
MEVSYVSPESSKVVSPRTLRKSIVEKVFGKSYSIKGSGSFKKRSESQSSINEDNEGGMELMEIGAERTKNVLILMSDTGGGHRASAEAIRDAFQIEFGDEYKIFVKDVWKEYTGWPLNDMEGQYKFMVKHVQLWKVAFHSTSPKWIHSVYLAAVAAYYAREVEAGLMEYKPDIIISVHPMMQHIPLWVLKWQGLEKKVIFVTVITDLSTCHPTWFHPWVNRCYCSSEEVAKKALLEGLEESQTRTYGLPIRPSFARAVLVKDELRKELKMDPDLPAVLLMGGGEGMGPVKKTAKALAESLYDKENEKPIGQIVVICGRNKNLVASVEAIEWKIPVKVRGFETIMAKWMGACDCIISKAGPGTIAEALIRGLPIILNDYIPGQATGVFTRSPKETARIVAGWFTTKQDELKTMSENALKLANPEAVFNIVRDIHELAKQREPGNFPYELTSSFTSII

SEQ ID NO: 9358 - protein, 160 aa, Anaplasma marginale str. St. Maries
MRRVMVLFGVVIAGVKGFMLTLVSMFRPKVTLRYPSEKGPLSTRFRGEHALRRYDDGEERCIACKLCEAICPAQAITIEAAERGDGSRRTVRYDIDMTKCIYCGFCQEACPVDAIVEGPNFEYATETREELMYNKEKLLCNGDVWEEALDFRIRKNRPYY

SEQ ID NO: 9359 - protein, 194 aa, Hordeum vulgare subsp. spontaneum
MEYQGQQQHGQATNRVDEYGNPVAGHGVGTGMGEHGGVGTGMGAHGGVGTGAAAGGGGGHFQPTRAEHKAGGILQRSGSSSSSSSEDDGMGGRRKKGIKDKIKEKLPGGHGDQQHATGTYGQQGIGMAGTGGTYGQQGHTGMTGMGATGTMATGGTYGQPGHTGMTGTGTHGTDGTGEKKGIMDKIKEKLPGQH

SEQ ID NO: 9360 - protein, 346 aa, Oryza sativa
  misc_feature (256)..(256): Xaa can be any naturally occurring amino acid
MAATNKKIVLRNHVTGFPKESDMELVAATGAAPSRVPEGTDGAVLVKNLYLSCDPYMRGRMSSHDGSYVDAFVVGEAITGYGVGKVVDSSHPGFKAGDLVWGMTGWEEYSLIKDPSRALFAIRHPDLPLSYYTGLLGMAGFTAYVGFHEICAPREGERVYVSAASGAVGQLVGQFAKLMGCYVVGSAGSDDKVRLLREKFGFDDAFNYKKESDLSAALKRCFPEGIDIYFENVGGAMLDAVLLNMRVRGRVAACGXMISQYNLEHPDPVHNLTAIVTKRLRIEGFIVSDHYARYREYEEKAARYVKEGKIAYVEDVAEGLENAPAALIGLFSGRNVGKQVVVVARE

SEQ ID NO: 9361 - protein, 402 aa, Solibacter usitatus Ellin6076
MKTRYKWTVVGLLWFVCLFNYADRQAIFSVFPLLKAEMHLSDVQLGYVASSFMWVYAAAAPFAGLAGDRFRRKSVILGGLIFWSLITLATALATRYWHLVLFRALEGLGEAFYFPASMSLISSWHGKETRSRAMSWHQSSVYAGTIAGGTAAGFLAERFGWRSGFYLFGSLGVVLGLVLLVLLKEPPEEAPREEEKFQFGSAWRDVLRNPMAGALMAVFICANFVAVVFLTWLPSYLNRNFHMSLTMAGFSATAYLQVASVLGVLTGGMVADAWVRKNRRGRMFTQAVGLFAGVPFLLLTGWAFQVTVFVFATIGFGFFKGMYDANIWASLHDVVPPGRRATAVGLMNSIGWLGGGVAPVAIASASGVWGMGACLSATSAVYALAGSLLVLGGARWMRKAQP

SEQ ID NO: 9362 - protein, 510 aa, Clostridium tetani E88
MKKELVFIIDFGGQYSQLIARRVRENNVYCEIIPYSTSIEKIKEKNPKGIIFSGGPNSVYGENSPRISKEIFEIDVPVLGICYGQQLASFILGGKVESAKVREYGKTAVNLDNKCALFEGIDKVQECWMSHTDYVSEIPSGFNIVAYTDGCKVAAMANEDKKIYGVQFHPEVEHTPFGKKMLKNFLFNICELKGDWSVTSFAEEKIKEIRELVGDKKVICALSGGVDSSVAAVIVHKAIGDQLTCIFVDHGLLRKDEGDQVESIFKEKFQMNLIRVNAQDRFLGKLKGVTEPERKRKIIGEEFIRVFEEEANKLGKIDYLVQGTIYPDVVESGTDTSATIKSHHNVGGLPEDIEFELIEPLRELFKDEVRRVGEELGIPHKLVWRQPFPGPGLGIRVLGEVTEEKLEIVREADAIFREEIANAGLDEKIWQYFACLPNIRSVGVMGDERTYSHTIGLRAVNSSDGMTSDWAKIPYEVLDKVSIRIVNEVKGVNRIVYDITSKPPSTIEWE

SEQ ID NO: 9363 - protein, 308 aa, Glycine max
GVVSRLESESSSVPTNPFFYSILFGTLRKAAPPPPPPSSTASCLRSFHFFYNWLRIIMAYRRCLLIRGSLVDRRCHLSFSYVLHSNEGKRERTNEKSSSGGVGDFTQTRSFGSSLNGQMRFFSPSRDRFLSPCTGYGFCQYMSTVNRGSDKIGSDVMTDVADVLADTTMDSVASQAPVVNEVAIAAADSFLPVQALQYVIDAVHSYTGLNWWAAIVLTTLLIRTATVPLLINQLKATSKLTLMRPHLEEIKQQMEGLTMDPVAVAKGQQQMKKLFKEYGVSPFTPLKGLFIQGPIFVSFFLAIDNKYG

SEQ ID NO: 9364 - protein, 298 aa, Bacillus cereus E33L
MKKIQGAFPVLITPMDEFQEINWNGVKQNVNYFIEQKVAGIIINGSTGEFVSLLKEERFKMVETVLKEVNGRIPVIVGTAAETTKETIEFTKHAETHGADCALIINSYYCKPKEEEIYFHFKEISNAVNIPIMLYNNPFTSGVDMSTELMLRIGKDCENVTHIKESSGDIRKARDLVRQGEGAFQVFCGSEDLVMESYLVGATGWVSVAGNIVPGLVTKMYEHFQNGELEKAWEINDAILPLCEFLEGSGKYVQIVKRSMELYGQAGGPSRYPRLGLTEEEDQKLQTILSKIAAHAAV

SEQ ID NO: 9365 - protein, 490 aa, Xylella fastidiosa 9a5c
MTLQLNKNRKTAMSEHYDVVVIGAGPAGYHAAIRAAQLGLKVACVDAALGKDGKPALGGTCLRVGCIPSKALLDSSRQYWNMGHLFNEHGISFKDAKIDVATMIARKDKIVKQFTGGIAMLFKANKITPYYGFAQLQPGNVVKVKQHEGKNIELKGANVILAAGSDSVELPFATFDGETIVDNIGALDFIKVPKRLAVIGAGVIGLELGSVWKRLGAEVTILEAMPDFLAAVDADVAKTAAKEFKQQGLDIKLGAKVSRTEISSKNNKKEVIVTYTDASGKQTFTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKANNIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 9366 - protein, 494 aa, Bacillus cereus E33L
MLTTNIELKPKVKAFLDEEIKMFINGEFVPSIRGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGSAIVNHHDIDKVAFTGSTVTGKYIMRQSAETIKHVTLELGGKSPNIILEDADLEEAINGAFQGIMYNHGQNCSAGSRVFVHRKHYETVVNELVKMADNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 9367 - protein, 369 aa, Proteus vulgaris
MKSRAAVAFAPGKPLEIVEIDVAPPKKGEVLIKNTHTGVCHTDAFTLSGNDPEGVFPVVLGHEGAGVVVEVGEGVTSVKPGDHVIPLYTAECGECEFCQSGKTNLCVSVRETQGKGLMPDGTTRFSYNGQPLYHYMGCSTFSEYTVVAEVSLAKINPEANHEHVCLLGCGVTTGIGAVHNTAKVQPGDSVAIFGLGAIGLAAVQGARQAKAGRIIAIDTNPAKFELARQFGATDCINPNDHDKPIKDVLLEINKWGIDHTFECIGNVNVMRAALESAHRGWGQSIVIGVAGAGQEISTRPFQLVTGRVWKGSAFGGVKGRTQLPAMVEDAMKGEIELEPFVTHTMTLDEINEAFDLMHEGKSIRTVIRY

SEQ ID NO: 9368 - protein, 277 aa, Bacillus thuringiensis serovar konkukian str. 97-27
MKQLYGVIGNPIGHSLSPVMHNDAFEHLNMDAHYHAFLVKEEVLGEAVRGLKALGISGFNVTTPHKVAIMDYLDEIDPLAKQIGAVNTVVHKDGKLIGYNTDGIGFVRALQSISSEPLQEKRILLLGAGGASRAIYFSLADAGVKEIDVANRTVDKAKELIAACTATVHSVALSLEKATKEQGSYDIIIQTTTIGMHPRVEHTPLQISSLKKGTIVSDIIYNPFETKILCEAKEQGAIIQNGIDMFVYQGALAFEMWTGCVPNIERMKQLVIRKLGG

SEQ ID NO: 9369 - protein, 1172 aa, Magnaporthe grisea 70-15
MATLDSLKSALRQRAATATQALPPLSEAQYSAGFDMFVKESGWATYQDFIIPQLSQLVAPLLNRRVRLSVLEIGPGPKSVFGYLPEQQRQKITKYVAYEPNTLFAARLEEWFQSGSELVPPLPCLKTSPEIRHTPFALDGNNCMDEPEEAFDLVLFCHSMYGMRPKVKFIERALGMLDGRFDGGMVVIFHRAGSLHLDGLVCHSTASFPSGVIRVTNDDAILDAFARFVAGYAVDDVDEQSVSIRSDWREVCRSLGRREGAHPDLLGFGAPEVMIALTRHATSLPELTAQVPLLIGSPQNKIKNRQARLHRPAAVFGPTEIQHLQRCVRWALKNKTKLTVVSGSHSDQCLWPNVVAIDMGFFDKVQICVAEDGKATCTPESNVFVVAETGAKAGDIIEKTMAAGLTVPLGSRPSVGAGLWLQGGIGHLTRLHGLTCDSIVGAVMVSVSSGQVLCIGNVPGPHQPAGSERPENEADLLWAIRGGGTNFGIVVSVTFKTYTSPTYSVRNWIVPLRGDSEALLKLEMFDELVAGKLPRDCSADAYLYWDVGQMHLGVTMYEASTKAPALQTAQADRLAKVLGQEASSKVVDGIGLFDTEMYMSGMHGGHGGGKTSSFKRCMFLRRIGAEATATVLQNAIKTRPSPFCYLHLLHGGAAVMDVAADSSAFGCRDWDFACVITGVWPRDQDGIQAAETAIQWVYNVVGALLPLSTGVYGADLGPDPRDSALATKAFGPNLARLARLKTSSDPYSILAYAFPLPKVPTEPKLIILVTGLHGAGKDYCAAIWVSVFNSSNPARKYPTACAIGISDATKREYAEATGADFDRLLSDRPYKEQHRSGLNAFFKSQLRRRPRLPEEHFLKVVRDSAPIDVLLITGMREQAPVAALSHLVPKSKLLEVRVTVSEELRQVRRGSRKDLAIGRGNCAALCAAEDGTDGEGIKHARLGSMTSSDCPDLTFENDIPGSKAVKAFAQDRLLPLIHEDLQRLVQMIRSVPDHPREGIEFRHVLDIAQRPGGLDLCSSLLQSHFAGDWAQIDALVCCEAGGFLFASALATRVDVPLVLIREAGKLPPPTISTSKLPSHISSPVLADSTLGRIEMDLYAISPGASVVVVDDVLATGRTLCAVLRLLKKAGVHEKNISVIVVAEFPCHRGRDVLHQHGFAETSLQNLLVFGGP

SEQ ID NO: 9370 - protein, 191 aa, Hordeum vulgare subsp. spontaneum
MEYQGQQQHGQATNRVDEYGNPVAGHGVGTGMGEHGGVDTGMGAHGGVGTGAAAGGHFQSTRKEHKAGGILQRSGSSSSSSSEDDGMGGRRKKGIKDKIKEKLPGGHGDQQHAAGTYGEQGTGMAGTGSTYGQQGHTGMTGTGATGTVATGGTYGQPGHTGMTGTGTHGTDGTGEKKGIMDKIKEKLPGQH

SEQ ID NO: 9371 - protein, 862 aa, Prunus dulcis [sequence omitted]

SEQ ID NO: 9372 - protein, 194 aa, Hordeum vulgare subsp. spontaneum
MEYQGQQQHGQATDRVDEYGNPVAGHGVGTGMGEHGGVGTGMGAHGGVGTGAAAGGGGGHFQPTRAEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 9373 - protein, 619 aa, Anaplasma marginale str. St. Maries
MSHCVAGGSMSNNYESVRNLAIVAHVDHGKTTLLDSMLKQSGALRDNQEVVERVMDSNDLERERGITILAKCTAITWGSHKINVIDTPGHADFGGEVERVLSMADGVLMLVDASEGPMPQTKFVLSKALQANLLPIVVVNKVDRPDSRVSEVLDEVYELFINLNATSEQLDFPVLYASGRSGWCVKDLSEERKDLTPLFGAILEYIKPSQYDHNAPFSMLLTLLESDKFLGRVLTGKIYQGRAKINSQVKVLNLSGEVVESGRLTKLLSFSGLKRVPVDEAGAGDIIAVAGLEKASVSDSIVDVAVSVPIPSTPVDPPTMAVTIGVNDSPLAGTEGTKLTSTVIKNRLLSEAETNVAITVKEGERSDSYEVGGRGELQLGVLIETMRREGFELSVSRPRVLFKKEGSALLEPMEEVVIDVDEEYSGIIMEKLSFRKGDMQDMSPSGQGRVRMVFLIPSRGLIGYHGEFLTDSRGTGIMNRLFHGYAPHKGDIPGRVNGVLISTGQGEAVAYAIFNLQDRGAMFIKPQDKVYMGMVVGLHNRGNDIEVNVLKGKQLTNIRAAGSDEAVRLVPPQLMTLEEMIGFINDDELVECTPKSVRLRKRFLDPNERKRFARAKSAT

SEQ ID NO: 9374 - protein, 194 aa, Hordeum vulgare subsp. spontaneum
MEYQGQQQHGQATNRVDEYGNPVAGHGVGTGMGEHGGVGTGMGAHGGVGTGAAAGGGGGHFQPTRAEHKAGGILQRSGSSSSSSSEDDGMGGRRKKGIKDKIKEKLPGGHGDQQHAAGTYGQQGIGMAGTGGTYGQQGHTGMTGMGATGTMATGGTYGQPGHTGMTGTGTHGTDGTGEKKGIMDKIKEKLPGQH

SEQ ID NO: 9375 - protein, 351 aa, Medicago truncatula
MANNLLVSEEKLLPRSVQEMSMDGDEPPSQYLVNGNVFGSKEDSSTLIPIPIIDVSLLSSEDELEKLRSALSSAGCFQAIGHDMSTSYLDKVREVAKQFFALPVEEKQKYARAVNESEGYGNDRIVSDKQVLDWSYRLTLRVFPKEKQRLSLWPENPSDFSDTLEEFSTKVKSMMDYLLRSMARSLNLEEGSFLDQFGKQSLFQARINFYPPCSRPDLVLGVKPHTDRSGITVLLQDKEVEGLQVLIDDKWINVPTIPNALVVNLGDQMQIMSNGIFKSPMHRVVTNTEKLRMSIAMFNEPEPVNEIGPVEGLVNEKRPRVYKNVKNYGDINYRCYQEGKIALDTVKMTDN

SEQ ID NO: 9376 - protein, 484 aa, Pyrococcus abyssi GE5
MVGSMKMEDVYIWDLNAKWLGITPFQLMENAGSGVARIIEERFGKGLKVAVFCGTGNNGGDGFVTARHLSFENDVTVFLIGDETKIRSEEAKLNWSILKNLEFVKIKILKDSSQVKKLSLEEFDVIVDALLGAGTRGEPREPIRSAIEKINEYHGKAKIVSIDLPSGYPSKVRVKCDFAVTFQWDKEEYRDFDRVIVKIGYPRELYHLIGPAHVKFAFKRKGEHKGQNGKILIIGGSENYYGAPYLAGKASSYLVDLVYLLTPERVARRIDDPNLIVREVPGDNLRGEHIELALELSERVDAVVIGPGIGTKEETKEFVLEFIKKVEKPMVIDADGLKIIAEDLDALKNRKFVLTPHAGEFKLLFGVKPGGSLVEKSKLVKEKAEEINGVILLKGAYDIVSDGKVWLYNKTGNRGMTTGGTGDVLAGVVGSFLALGNEPLRAASAGAFLTGFSGDLVYEEKGEAFTALDVANKIPLALKRILEL

SEQ ID NO: 9377 - protein, 175 aa, Triticum aestivum
MAPTLMASSATSVALFQGHKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMPQVQCVSFIAFKKTAPQPPGKA

SEQ ID NO: 9378 - protein, 501 aa, Myxococcus xanthus DK 1622
MTFDDLQLHDTLLRAVKAEGYTTPTPIQQKAIPHALAGRDVLGVAQTGTGKTAAFALPILQRLSAKAPAGGARPVRCLVLTPTRELAGQVGDSFGTYGKGLPLRHAVIFGGVGQNPQVQTLRNGVDVLVATPGRLLDLMEQGFVSLRSLEVFVLDEADRMLDMGFIHDVRRVIKALPPKRQTLFFSATLPPDIVDLARSILTDPIRVEVTPASSTAETVSQQVYFVEREQKRGLLTHLLKEGNIHRALVFTRTKHGANRVAKQLEGAGVSSAAIHGNKSQNARERALDEFRSGTLRVLVATDIAARGIDIDGLSYVVNYDLPNVPEQYVHRIGRTGRAGASGTAVSFCDAEERAYLRDIERTIRRNVPVVEDHPYRSGQPAPRPVSHASGAAPEARPSGNGGRPQGTPRPAGNGGGGGHSAGASRRRRGGRGGAGGGGRGQGRPEGGRSAQGSGGSGGNASRGGQGGSRGSGGGRPAVAQAPAKAPEASPLPPRRPSPKWF

SEQ ID NO: 9379 - protein, 471 aa, Zea mays
  misc_feature (105)..(105): Xaa can be any naturally occurring amino acid
MEAAAPAPARGLGRQEYAVLALTFASYASFHASRKPPSIVKAVLSADWVPFSGPRGPHRLGELDVAFLSFYALAMFAAGHLADRADLRCLLGTAMLASGAACAAXLGAAYFLDIHALAFFAAAQVSSGVVQSAGWPCVVAVVGNWFGHASKRGTIMGVWNSHTSVGNIAGSVLAAAALEFGWGWSFLLPAVVIAALGVVVLVFLVAHPSEAGLDVEVMEVEMNGDGGEEVGLLGEDKKEVQGNEDNEFELEMGSQLPRAIGFVEAWKLPGVAPYAFCLFFSKLVAYTFLYWLPFYIRNNAVAGQFLSHKASGILSIVFDIGGVLGGISAGFLSDAIGARAITSVLFLLLSIPSLVVYRTYGSISMHHNIALMFLSGYFVNGPYSLITTAVATDLGTQDAIKGNSRALATVSAIIDGTGSVGAALGPLLTGYISTRGWNSVFFMLIVSISLAILFLIRLAKGEIVAKLSTWN

SEQ ID NO: 9380 - protein, 97 aa, Zea mays
DLVFSDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 9381 - protein, 573 aa, Burkholderia thailandensis E264
MKRTRRARRRTSARSARSDAPYSPAQPGRVPAAPPNLPICANPPRSRVVTLVRPIRAAMSGAGRPIEPQHETHMTQTDLVAVADTVRAFTKREFGIFIDGAMRAAHSPRRLDVYDPATGERLSRVPDADAHDVDAAVASAKRAFDARVWSGLRPADRERVLLKLADVLEAHAEELAQLETLNQGKSILVSRGVEVGATIEYVRYMAGWATKITGQTLDVSIPFPPGARYTAYTRKEPVGVVAAIVPWNFPLMIAVWKLVPALAAGCTVVLKPSPETPLTALRLAELALEAGVPAGVFNVVTGGRECGAALAGHPSVRKISFTGSTATGKLVGAAAVQNMTRFSLELGGKNPIVMLDDVDVDAALGGVAAGAFFNQGQVCAAASRIYVHRSKFRRLAQGLADVAAAMRLGPGLDPAAQINPLVSAHHRDKVVQHIEVARREGLTFLTGGTRADDLPGYFVRPAVIADAAHDSAIVRDEVFGPVVVVLPFDDPAEAVRLANASPYGLAASLWSNDLKAVMDLVPQIEAGTVWVNCHIPLDPSMPFGGYKQSGIGREFGQYAIEGFTETKSVCIAH

SEQ ID NO: 9382 - protein, 419 aa, Parvularcula bermudensis HTCC2503
MDHFSSRHDGLYAEDVPLRRIADAVGTPLYIYSAATLRRHYDILADEFKNRDALIAFAVKALSNIAVLALLGRRGAGADIVSGGELYRALKAGIPAERVVFSGVAKSRGEMEAALNAGILQFNVESEAELAHLSAVASALGKTAPVALRVNPDVDAGTDTRISTGRKDDKFGVPFADAGRLYRLAAALPGLRPQGLTVHIGSQITSVAPFERAAARVGGLVTSLRAEGHEVTHLDLGGGLGIPYERAAAAPPLPVDYAATLNRATADLNVRLILEPGRLIAGNAGLFVTRIVLTKNQEGTHYALVDGAMNDLIRPALYGARHEVMEDTPPTGVPVHHHIAGPVCESTDLFAKDVPLHEVSAGALLAFRTAGAYGAVQASQYNTRPLVPEVLVDGDRFTVIRRRPTYEEMLSLEVIPDDF

SEQ ID NO: 9383 - protein, 144 aa, Zea mays
  misc_feature (76)..(76): Xaa can be any naturally occurring amino acid
  misc_feature (104)..(104): Xaa can be any naturally occurring amino acid
  misc_feature (132)..(132): Xaa can be any naturally occurring amino acid
MQLDSDHPTGVRPTIRDPGPAPLHRPGPALLLEPPQRPRGGPEATFREDVGHAAAETYLVTGLAFTLLGYLGSGYXKCSTVVYGENEEMGQQSLKKVTCYIASXLALITVDPEKLCVLDLYMPRDNSKSSPXVAFVTGGAWIIG

SEQ ID NO: 9384 - protein, 411 aa, Arabidopsis thaliana
MSGLTLGLMSLSLVDLEVLAKSGTPEHRKYAAKILPVVKNQHLLLVTLLICNAAAMEVSGMVFDDSDDLSFQTLPIFLDGLVTAWGAILISVTLILLFGEIIPQSICSRYGLAIGATVAPFVRVLVFICLPVAWPISKLLDFLLGHRRAALFRRAELKTLVDFHGNEAGKGGELTHDETTIIAGALELSEKMVKDAMTPISDIFVIDINAKLDRDLMNLILEKGHSRVPVYYEQPTNIIGLVLVKNLLTINPDEEIPVKNVTIRRIPRVPEILPLYDILNEFQKGLSHMAVVVRQCDKIHPLPSKNGSVKEARVDVDSEGTPTPQERMLRTKRSLQKWKSFPNRASSFKGGSKSKKWSKDNDADILQLNGNPLPKLAEEEEAVGIITMEDVIEELLQEEIFDETDHHFEDS

SEQ ID NO: 9385 - protein, 630 aa, Erythrobacter sp. NAP1
MADINSPVEIGVTTGPIRGSRKIHVGARTGSGVQVAMREIDLEGGEAPVRVYDTSGPYTDPDANIDINSGLPALRRDWIMARGDVEDYDAREVKPEDNGQLGPDRSGGVPQFPNTVKRPLRAKAGMNVSQMHYARKGIITPEMEYVAERENLGREIAADFVRDGEDWGAEIPDVITPEFVRSEVARGRAIIPNNINHPETEPMAIGRNFLVKINANIGNSAVASDVAQEVDKMVWATRWGADTIMDLSTGRNIHDTREWIIRNSAVPVGTVPIYQALEKVGGIAEELTWEIFRDTLIEQAEQGVDYFTIHAGVRLPYVPLAAKRVTGIVSRGGSIMAKWCLAHHKESFLYEHFDDITEIMKAYDIAYSLGDGLRPGSIADANDEAQFAELYTLGELTKKAWAQDVQVMIEGPGHVPMHKIKENMEKQLEACGEAPFYTLGPLVTDIAPGYDHITSGIGAAQIGWYGTAMLCYVTPKEHLGLPDRDDVKVGVVTYKLAAHAADLAKGHPASKVRDDALSKARFEFRWRDQFNLSLDPDTAEQYHDQTLPAEGAKTAHFCSMCGPKFCSMKISQEVREFAAKQNSDPDSFLASEDLKGENSPAERAENEAGMEEMSRVYKEKGERLYLPEEN

SEQ ID NO: 9386 - protein, 469 aa, Geobacter metallireducens GS-15
MQIKFGTDGWRGVIARDFTFDNLSRVAQATMEYLIREGLAPRGLVIGYDRRFLSREFAERVAEIAAGNGIRVWLTAGYAPTPAVSWAVHELGAGGGVMITASHNPPAYNGFKVKESFGGSARPSTTKILEEMVAANDAAGREIKARPLAEALADGSVATFDPKGGYFRQLARYVDLEAIRKANLPVVVDPMFGAGAGFVPELLPGVREIHGDENPSFGGQPPEPTEEHLTELAALVASGRYRIGLALDGDADRIGAVDETGEFFSSHRIFTVILRHLVERKGLTGGVVKTVSTTRMVDLLAEKFGLPLHETPIGFKHICELMLDHDILMGGEESGGLGVKGHIPERDGILMGLLLLEAMAVSGKGVRQLLDETMDEIGRFCYRRIDLPIADAAKELLIARLKQGGIASIAGRNVARENFRDGFKFIFEDGSWLLIRPSGTEPVLRLYSEAGDAQTVEELLAAAREIAGL

SEQ ID NO: 9387 - protein, 201 aa, Zea mays
MSALARTAPPLAGTIRRPSCALRPTASLSFAAASTTPRGRLGLGLSTAPAGSGRAARARAVPQRIVASSVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCQWESVQAPWLIE

SEQ ID NO: 9388 - protein, 445 aa, Arabidopsis thaliana
  misc_feature (276)..(276): Xaa can be any naturally occurring amino acid
MAKKRDRIVNTQPFISDDASVASSRKRSKVPKTHQKQEKLIEAGMSEKIMKQALAQQKEVADEENAERNPSSAAFAVAGAATAGEEQKILEEEEDDIDDFDGTFENQSQFDKQEEINEDDEKLFESFLNKNAPPQRTLTDIIIKKLKDKDADLAEEERPDPKMDPAITKLYKGVGKFMSEYTVGKLPKAFKLVTSMEHWEDVLYLTEPEKWSPNALYQATRIFASNLKDRQVQRFYNYVLLPRVREDIRKHKKLHFALYQALKKSLYKPSAFNQGXILFPLCKSGTCNLREAVIIGSILEKCSIPMLHSCVALNRLAEMDYCGTTSYFIKVLLEKKYCMPYRVLDALVAHFMRFVDDIRVMPVIWHQSLLTFVQRYKYEILKEDKEHLQTLLQRQKHHLVTPEILRELKDSRNRGEKEDPMVDNFAPVPAKEDRFDIPEVPMEED

SEQ ID NO: 9389 - protein, 351 aa, Ostreococcus tauri
MITGAQGVRQTRSKTTYEVPQQQQQQSFEWGRTSQRTSHGKPRRGSVMGGTMTTAGADVDMRESYSTYLERSSAADVMTDALPDIDLYDHDNPLAVTQYVNDIYQYWYKVEPDTRVSETYMLIQGDINYKMRAILIDWLVEVHLKFKLMPETLFLTTNLIDRFLELKTVTRRNLQLVGVTAMLVASKYEEIWAPEVRDFVYISDRAYTRQQILEMEKQMLNTLGFHLTVPTPYCFLNRFFKAAGGDRQFQLYASYAVECALPEYGMLKYSGSTLAAAGVYIAIRGLQTGSWNHTMEAHTRLSESEVYPCACDMAELMRKAPTATLTAVYKKYSSEKFMKIATLPVPHDLRL

SEQ ID NO: 9390 - protein, 168 aa, Ralstonia eutropha JMP134
MIYILMGVSGSGKSTVGELLATRLGCAFHDADEFHSAANKAKMHAGIPLTDEDRWPWLAAMRAAIDAARAEGRTHVFTCSALRQVYRDRLTPPDGGVVFVYMKGDAQLIGSRLSARTDHFFNPALLESQLETLEEPHGALVLDIRQSPEALVQAILADGERHRVAAAR

SEQ ID NO: 9391 - protein, 183 aa, Hordeum vulgare subsp. spontaneum
MEYQGQQQHGQATDRVDEYGNPVAGHGVGTGMGTHGGVGTGAAAGGGGHFQPTREEHKAGGILQRSGSSSSSSSEDDGMGGRRKKGIKDKIKEKLPGGHGDQQHAAGAYGQQGIGMAGTGGTYGQQGHTGMTGTGATGTMATGGTYGQPGHTGMTGTGTHGTDGTGEKKGIMDKIKEKLPGQH

SEQ ID NO: 9392 - protein, 427 aa, Thermobifida fusca YX
MASIEAVHAREILDSRGNPTVEVEVALDDGTIARAAVPSGASTGQFEAVELRDGGDRYGGKGVEKAVAAVNEEISEQIVGYEAEEQRLVDSALITLDGTPDKSRLGANAILGVSLAVAKAAAESADLPLFRYLGGPNAHVLPVPMMNILNGGAHADTNVDIQEFMIAPIGAESFREALRWGAEVYHSLKAVLKAHGLATGVGDEGGFAPNLDSNRAALDLISEAITKAGFTLGQDIALALDVAATEFYADGAYQFEGSSRSAEEMAAYYTELVESYPLVSIEDPLSEEDWAGWKALTESLGDRLQLVGDDLFVTNPERLQRGIDEGAANSLLVKVNQIGTLSETLDAVSLAQRNRYTAMISHRSGETEDTTIADIAVATNSGQIKTGAPARSERVAKYNQLLRIEEELDDAAVYAGANAFPRFARQG

SEQ ID NO: 9393 - protein, 493 aa, Ralstonia solanacearum GMI1000
MALTFDQLRHTGLIRTDNLIDGRWSAGADGARYAVTDPATGSIIAQVADSSAADARAATDAAARALPAWRDTLPAERAAILRRWHAAIVANADALGRLISLEQGKPFAEGRGEVMYGASYVAWFADEATRIYGDLIPQQQRGKRMSAIKEPIGIVAAITPWNFPLAMIARKIAPALAAGCTVVAKPAEDTPLTALALAQLAQEAGLPPGVLNMIAASRERGVAAVADWLQDGRVRKITFTGSTPVGKHLARESAGTLKKLSLELGGNAPFIVFDDADLDAAIAGLLSAKFRNGGQTCVCPNRVYVQAGVYDRFAAMLAARVSALKVAPATDPDAQIGPMINARAVDKIERHVQDAVAHGARVLAGGKRLPEVGAHFYAPTVLADAHPGMALCGEETFGPVVPLFRFTDEAEAVQAANDTPFGLAAYFYSQDVRRIDRVAHALEAGIVGINEGALASEAAPFGGVKESGYGREGSKYGLDDYLSIKYLCQGGLA

SEQ ID NO: 9394 - protein, 191 aa, Hordeum vulgare subsp. spontaneum
MEYQGQQQHGQATNRVDEYGNPVAGHGVGTGMGEHGGVGTGMGAHGGVGTGAAAGGHFQPTRKEHKAGGILQRSGSSSSSSSEDDGMGGRRKKGIKDKIKEKLPGGHGNQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 9395 - protein, 361 aa, Ralstonia solanacearum GMI1000
MTRKTYRIAVIPGDGIGREVMPEGLRVLDAAARRFGIDLEYQHIEWASCDYYLQHGRMMPDDWKAQLQGADAILFGAVGWPATVPDHISLWGSLLKFRREFDQYINLRPVRLFEGVPCPLANRKPGDIDYYVVRENTEGEYTSLGGIMYEGTDREVVIQESVYSRKGAERLLKFAFDLARSRARKHVTLATKSNGIAISMPWWDARADEVATHYPEVTLDKQHIDILTARFVLQPGRFDVVAATNLFGDILSDLGPATTGTIGLAPSANLNPDRTFPSLFEPVHGSAPDIYGKNIANPIAMIWSAALMLDFLTEGQGAGRAAHDAIVAAIEAVLKGGPRTPDLGGSANTTQVGEAIASHLA

SEQ ID NO: 9396 - protein, 458 aa, Thermobifida fusca YX
MTESRNYRLVPGGGDASEIPHVLIVGGGYLGMYTAKRLEKKLGPGEARITVVDPNSYMTYQPFLPETAAGSISPRNVVVPLRKVLRRTRVLNGRVVRIEHAQRRVECVTNEGERRELTYDYLVMAAGAVSRTLPIPGLAEHGIGIKTVQEAAYLRNHVLEQLNIADSTDDPRVRRKALNFVFVGGGFAGAEAIAELEDLARDATRIYPSISIDDLHFYLIEAADRILPEVGPEVGAKALQQLRNRGIDVRLSTFLESAVDQRIKLSDGTEFEAGTLVWTAGVKPSPVVQASDLPLGPKGHVDTTEYLTVRGVENAFAGGDNAQVPDGNGGYYPPNAQNAVRQAPVLADNIIATLRGKELKPYRHKNLGAVAGLGMYKGAAQVFGAVKLTGLPAWLAHRSYHLLAVPTFNRKMRVLADWTLGFFLRRDFASIPEMSQPRQAFTEAARPQVDGSNLRRVS

SEQ ID NO: 9397 - protein, 254 aa, Zea mays
IGYLEAGREAFPERSDPIRNCAGQPWRLGFCSPPSSSPSSSSPPLSPPEVSSDGPLSPAPGVETVVVFPKNAGKIVLAGEETELLVGLQNEGESTLNVVAVHSTLHLPFDHNMYGQNLTVQNFFNASVPVSVQATFPYKFVVSKFLQPGAYDLVGYIVYEIDQHPYQNVFYNGTIEVVEAGGLLSVESVFLITLGIALLGLFGLWAYGQVQQLSKKTKKAPKVELGTGTTDANIDEWLEGTSFVQRSKSKKKQT

SEQ ID NO: 9398 - protein, 497 aa, uncultured proteobacterium
MYLHKSAITPTVQSQVTQNISTGLSHMDLILASQSATRRRILNSARISAQFMSPQIDEENITKSLIAEQALPRDIADTLAEHKALKISRKNPDSWVIGCDQILVFEGEIFGKPASPEALKTSLSRLSGKTHRLITANVIYKDSKPQWRHISISHMSMRFMSAAEIDAYIEAYWEDVKHSAGGYHFEKKPDLFADVRGNWFDIMGLSIGPIISFLNQANTTAPFQTPKLAAVLGHPIAQSKSPLMHGHWLKKHQISGDYFAIDIPPARFSETVRMLFDLGFSGFNVTIPHKEQALAFADDATPPAQRIGASNTLIKKDNGNITADNTDGYGFMTNLISQSTTWQPSAGPSLVLGAGGAARAILVALLDAGAPEIYLCNRTRARAEDLAAEISDLIEVIEWQDKEDILPKVFTVVNSTSLGMIGKPALDFDLTHVNPRALVADLIYAPLETQLLKGARARGCEVVGGIGMLLHQGVPGFEAWFGTRPVVDQELETLVLT

SEQ ID NO: 9399 - protein, 314 aa, Arabidopsis thaliana
MYSLVFKLFLFLSLLQISVSARNLASQEPNQFQLLKYHKGALLSGKISVNLIWYGKFKPSQRAIISDFITSLTHTSPTSKTLHQPSVATWWKTTEKYYKLATPSKNSSPLSLTLGKQIIDESCSLGKSLTDKKIQTLASKGDQRNAINVVLTSADVTVTGFGMSRCGTHGHARGLGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGDLLVDTTTGGSFNAYGANGRKFLLPALYDPTTSACSTMV

SEQ ID NO: 9400 - protein, 228 aa, Solibacter usitatus Ellin6076
MANAASLAVLTGAGISAESGIPTFRGDDGLWKNYKPEELATPEAFLKDPRLVWEWYNWRRELIAKALPNAAHKALVQLEIKKREYTLITQNVDGLHDRAGSGRQLKLHGDIWRMRCTVCGANWPDRRAPLPKLPPHCACGGLARPGVVWFGEALPDGMMKEAEHAVASAEVFLVIGTSAMVFPAASLVPYAKQGGAKVIEINTAETPFTNLVDCALRGPAGELLPALL

SEQ ID NO: 9401 - protein, 499 aa, Clarkia lingulata
  misc_feature (291)..(296): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQG

SEQ ID NO: 9402 - protein, 499 aa, Clarkia lingulata
  misc_feature (291)..(296): Xaa can be any naturally occurring amino acid
MATPALISDTEAWKDLKAHLEGIKHTHLRELMGDTERCQSMMVEFDNIFLDYSRQQASPDTINKLYKLAEAAHLKQKIDSMYNGDHINSTEHRSVLHVTLRAPRNSAICSDGKNVVPDVWNVLDKIKDFSERVRNGSWVGATGKELKNVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQG

SEQ ID NO: 9403 - protein, 279 aa, Myxococcus xanthus DK 1622
MARSDEGFFPGRDGTRLYWKSILPDAEPRAHVAVVHGYGDHFGRYGFVTDALLADGFAVHGFDYRGHGKADGRRAYCEKWPDYLEDLEVFWERVRAVSEGKKAFVLAHSHGGLMSATWASSRRVEGLTGLVLSAPYLKLAITPPASKLMAARAVGKLVPWLSISSGLKVEDLTHDTDVQRATREDPLHQAIATPRWFVESTRAQGEAVLLAPKIQVPLFVLCGAEDGVAAPAAAREYFERAGSPDKKFKEYPGMRHEPLNEVGRAEVFRDISGWISAHL

SEQ ID NO: 9404 - protein, 326 aa, Burkholderia thailandensis E264
MAELNLVEAVNLALAYELAHDPSVVLLGEDIGANGGVFRATVDLQARFGAQRVIDTPLAETAIAGAAIGMAAMGLRPVAEIQFTGFVYPAIDHVLNHASRLRHRTRGRLSCPLVIRAPCGAGIHAPEHHSESPEALFAHIPGLRVVIPSTPARAYGLLLAAIRDPDPVMFFEPSRLYRLFRQPVEDNGEALPLDTCFTLRDGADVTLVSWGAALQEVQAAADQLAQDGVTAEVIDVATLKPLDADTIVASVSKTGRCVIVHEAPRTAGFGAEIAALVAERCLYSLLAPVQRVTGYDIVVPLFRLESQYMPSVARIVDAARKTLEAA

SEQ ID NO: 9405 - protein, 189 aa, Triticum aestivum
MAPTVMASSVTSVVPFQGLKSTAGLPVSRRSNGASLGSVSNGGRIRCMQVWPIEGIKKFETLSYLPPLSTEALLKQVDYRIRSKWVPCLEFSKVGFIFREHNASPGYYDGRYWTMWKLPMSGCTDATQVINEVEEVKKEYPDAYVRIIGFDNMRQVQCVSFIDFKPPGCEESGKAYTDHSAWATYKVLL

SEQ ID NO: 9406 - protein, 194 aa, Fagus sylvatica
KLGQGYGMTEAGPVLAMCLAFAKTPFDVKSGACGTVVRNAEMKIVDPETGASLPRNKPGEICIRGDQIMKGYINDPNATAATIDKEGWLHTGDIGLIDVDDELFIVDRLKELIKYKGFQVAPAELEALLLTHPNISDAAVVSMKDDQAGEVPVAFVVRSNGSNITKDEVKQFVSKQVVFYKRINRVFFIDAIPK

SEQ ID NO: 9407 - protein, 449 aa, Pseudomonas putida
NMPEHAGASLASQLKLDAHWMPYTANRNFLRDPRLIVAAEGSWLVDDKGRKVYDSLSGLWTCGAGHTRKEIQEAVAKQLSTLDYSPGFQYGHPLSFQLAEKITDLTPGNLNHVFFTDSGSECALTAVKMVRAYWRLKGQATKTKMIGRARGYHGVNIAGTSLGGVNGNRKLFGQPMQDVDHLPHTLLASNAYSRGMPKEGGIALADELLKLIELHDASNIAAVFVEPLAGSAGVLVPPEGYLKRTREICNQHNILLVFDEVITGFGRTGSMFGADSFGVTPDLMCIAKQVTNGAIPMGAVIASTEIYQTFMNQPTPEYAVEFPHGYTYSAHPVACAAGLAALCLLQKENLVQSVAEVAPHFEKALHGIKGAKNVIDIRNFGLAGAIQIAPRDGDAIVRPFEAGMALWKAGFYVRFGGDTLQFGPTFNSKPQDLDRLFDAVGEVLNKLLD

SEQ ID NO: 9408 - protein, 262 aa, Fagus sylvatica
TNNIQRMRLYDPNQDALRALGGSNIELMLGLPNDNLQSIASSQANANAWVQNNVKNFGNVRFKYIAVGIEVKPSDSFAQFLVPAMQNIQNAISAAGLKNQIKVSTAIDTGVLGESFPPSKGSFRADYKPLLDPIIRFLVNNGSPLLVNLYPYFSYIRNTKDIRLDYALFTAPSTVVNDPPLSYRNLFDAILDAVYAALEKAGGRSLVIVISESGWPSTGGTATTLDNERTYITNLVQHVKGGTPKRPGRAIETYVFAMFDEN

SEQ ID NO: 9409 - protein, 791 aa, Geobacter metallireducens GS-15
MEETEIPQNIVLTRLDDLINWGRANSLWPMFFGLSCCFVEMMTSFTSRYDISRFGAEVLRGTPREADLMVIAGTVFKKMAPSILRLYEQMAEPKWVISMGSCANSGGMYDVYSVVQGVNQIIPVDVHVPGCPPRPEAFLQGVMLLQEKIRREERPARKVLHMAGGTEGTTRPVLVDGVTKSRDTRGPGMEGIAIRGTPVQHPRFWMSRSDEMWRPPAPRHDYPDFGLAGELETIFGGRVAVEQAATDMLTYRCPPELVPEVLRHLKSRSSAPFRRLEDVVCVDESCRRERERFPDFTVNYHLLNFDIPGHLRIKTELMGETPELPSATGVFPAADWYEREAFDMYGIRFAGHPNLRRILMPPDWEGHPLRKEHPFRATEMPPYTTDDARRHQALPASDFFDRIDEETLIINLGPQHPGTHGIIRFILKLDGEEIVDMDTDIGYHHRGAEKIGERQHWNQFIPYTDRIDYLAGVQNNLAYVNSVERLCGITVPDRAITIRVMLAELFRIASHLVWLGTFAADVGAMTPVFYTFTDREKIFDIIEMVTGGRMHPSWFRIGGVTEDLPEGWDGAVKEFLDWMPGRLKEYEDLLKENPIFKARLKGVGVITKDEAMEWGITGPNLRACGMAWDLRKKIPYNGYQHFHFEIPTEEGGDCWARYRIRVEEIRQSLHIVAQCRKEMPAGRWITDDYRYVLPKKRDTLHDIESLIHHFINATRGMAPPRGENYSAIEAPKGENGYFVVSDGLNVPYRVRIKTPSFPHIQALPLMSRGWLVADFLAIIGSIDFVLADLDR

SEQ ID NO: 9410 - protein, 429 aa, Ralstonia eutropha JMP134
MSAIVDIIGREVLDSRGNPTVECDVLLESGVMGRAAVPSGASTGSREAIELRDGDKSRYLGKGVLKAVEHINTEISEAIMGLDASEQAFLDRTLIDLDGTENKSRLGANAMLAVSMAVAKAAAEEAGLPLYRYFGGSGAMQMPVPMMNIVNGGAHANNSLDIQEFMVMPVSATSFREALRCGAEVFHALKKILADKGMSTAVGDEGGFAPNFSSNEECLNTIVQAVEKAGYRMGEDVLLALDCAASEFYHEAEDVYVLEGEGLKLSSTQFADYLANLCDKFPIVSIEDGMAEGDWDGWKTLTDKLGKRVQLVGDDLFVTNTKILKEGIDKGIGNSILIKINQIGTLTETFAAIEMAKRAGYTAVISHRSGETEDSTIADIAVGTNAGQIKTGSLSRSDRISKYNQLLRIEEDLGDIASYPGKSAFYNLR

SEQ ID NO: 9411 - protein, 129 aa, Brassica napus
MSVKARRISGRLETVVAKPTYAFDPVDDDKIIRNRLLTRTTTTRGEPPLKKLQKKFTSFVLEVDKEEDNYAECNRLAKAFLQELTTFEIPLLKSQAVVEANVREKESFDEVKVETERQIMMAKGEIEEL

SEQ ID NO: 9412 - protein, 505 aa, Escherichia coli
MCLDSFINVNGCFLLWRAKGETLMSAIDSQLPSSSGQDRPTDEVDRILSPGKLIILGLQHVLVMYAGAVAVPLMIGDRLGLSKEAIAMLISSDLFCCGIVTLLQCIGIGRFMGIRLPVIMSVTFAAVTPMIAIGMNPDIGLLGIFGATIAAGFITTLLAPLIGRLMPLFPPLVTGVVITSIGLSIIQVGIDWAAGGKGNPQYGNPVYLGISFAVLIFILLITRYAKGFMSNVAVLLGIVFGFLLSWMMNEVNLSGLHDASWFAIVTPMSFGMPIFDPVSILTMTAVLIIVFIESMGMFLALGEIVGRKLSSHDIIRGLRVDGVGTMIGGTFNSFPHTSFSQNVGLVSVTRVHSRWVCISSGIILILFGMVPKMAVLVASIPQFVLGGAGLVMFGMVLATGIRILSRCNYTTNRYNLYIVAISLGVGMTPTLSHDFFSKLPAVLQPLLHSGIMLATLSAVVLNVFFNGYQHHADLVKESVSDKDLKVRTVRMWLLMRKLKKNEHGE

SEQ ID NO: 9413 - protein, 270 aa, Azoarcus evansii
MTTTLDPKRERTAAPLAGRHALVTGAGSGIGRACALELARLGATLTLVGRRGAALEATCAELEGDGHGLAVADITDFAAVRAAFDAAVAARGPIAILVNNAGAAKSAPFGRTDPELWSEMLAVNLTGTYHCTHAVLAGMQAAGWGRIVNVASTAGLVGYAYVAAYCAAKHGVVGLTRALALEVAKQGITVNAVCPGYTDTPLIEGAVDNIVAKTGRSTDDAKAALAARNPQGRLVQPEDVAATVGWLCLPSSDAIHGQSIAVAGGEVMCG

SEQ ID NO: 9414 - protein, 499 aa, Clarkia heterandra
  misc_feature (221)..(231): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKNFSDRVRNGSWIGATGKELKDVIAVGIGGSFLGPLFVHTALQTDPEASKNARGRELRFLANVDPIDVARNISGLNPETTLVVVVSKTFTTAETXXXXXXXXXXXSSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQG

SEQ ID NO: 9415 - protein, 559 aa, Clarkia heterandra
MATPTLISETEAWKDLKAHLDGIKRTHLRELMGDTERCQSMMVEFDNIFLDYSRQQASPDTINKLYKLAEAAHLKQKIDRVYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGISAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEEGFNFSTKTLLTRYLQATSDV

SEQ ID NO: 9416 - protein, 380 aa, Clarkia dudleyana
MASPALISETEAWKDLKAHLEGIKTTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSSVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 9417 - protein, 380 aa, Clarkia dudleyana
MATPSLISETEAWKDLKAHLEGIKRTHLRELMGDTERCQSMMVEFDNIFLDYSRQQAAPDTINKLYKLADAAHLKQKIDRMYNGDHINSTENRSVLHVALRAPRSSAICSDGKNVVPDVWNVLDKIKDFSERVRSGSWVGATGKELKDVIAVGIGGSFLGPLFAHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 9418 - protein, 380 aa, Clarkia dudleyana
MATPALISETEAWKDLKAHLEGIKRTHLRESMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 9419 - protein, 568 aa, Collimonas fungivorans
MDKYVDKFWLKSYPEGVAPEIDYSQYQSLAQLLEEAFQKYAPRNAYACMGKYLTYAEVDQLSRKVGAWLQGKGLEKGARVAIMMPNVLQYPVAIAAILRAGYIVVNVNPLYTPRELEHQLNDSGAEAIFILENFATTLQQVIARTKVKHVVVASMGDLMGVKGLVVNLVVRHVKKMVPSFSLPGSVPFNSVLSQGASLQLKPVALTPDDTAFLQYTGGTTGVSKGATLSHRNVVANVLQAEAWLAPGLNNGPKVEQLVFVCALPLYHIFALTVCGMLGMREGALNLLVPNPRDIAGLIKEMSKYQINTFPAVNTLYNALLNHPDFAKLDFSGYRVCVGGGMAVQKAVADKWKEVTGCPIIEGYGLSETSPIACANPCDIKEYSGTIGLPLPSTEIAILDDAGNPVALGQAGEIAIRGPQVMRGYWNRDDETAKVMTADGFFKSGDIGIMDERGYTKIVDRKKDMILVSGFNVYPNEVEGVVVQHPGVLECACVGVPDEHAGEVVKIFVVRKDPSLTAEQLMAYCREQLTGYKRPKYIEFRTDLPKTNVGKILRRELRDEKPAEQKQAA

SEQ ID NO: 9420 - protein, 362 aa, Streptomyces coelicolor A3(2)
MAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEAVGRPETYRQAFYARDLAGTVVLVGVPTPEMKLELPLLDVFGRGGSLKSSWYGDCLPSRDFPMLVDLHLQGRLDLGKFVTETIRLDEVEQAFDRMHAGDVLRSVVVL

SEQ ID NO: 9421 - protein, 553 aa, Anaplasma marginale str. St. Maries
MDYSGVYPSSSKVYVRGNLYSDVNVGMRKVAIKNGTSEFLVYDTGGPYTDREAKLDIKSGIRKLRSTWIENRRDTSPVQRSFVPSGSSCTRYQKAAENVLRKIAGGSPVTQLFYAQNGIITPEMEYVAIRENALRMQVGSSETGAAAHQEITPEFVRQEIAAGRAIIPANINHPESEPMVIGRNFLVKINANIGNSAVLSGIEEEVKKMALAVAYGADTVMDLSTGSDIHNIREWIIRNSPVPIGTVPIYQALNKVKGVVENLSFEVFKETIIEQAEQGVDYFTIHAGVLKDYIKHARGRVTGIVSRGGAIMAQWCLAHNKENFLYTHFDEICEIMGSYDVAFSLGDGLRPGSIDDANDEAQFLELKTLGELVKVAWHHGCQVMVEGPGHVPMHLIKENMEKQLHLCSEAPFYTLGPLTTDIAPGYDHITSAIGAAMIGWYGTAMLCYVTPKEHLGLPNIDDVKAGVISYKIAAHAADLAKGNPSAYARDYALSQARFDFRWYDQFNLSLDPLTAKSLHDESLPGKGGKTANFCSMCGPKFCSMKLSKELVDQ

SEQ ID NO: 9422 - protein, 176 aa, Synechococcus sp. WH 8102
MGCRSLLSAMALVASLGLAGLPVVAQEAASSDRVLAQKADGFNPAAVQAMINRGDAAAAAGDLTKARQEYDNARKASKQLLAFYRDLSGAFRGLDARIPREMDTKGREALGLLAEADLRLAALFRRQNQPEIAVPVLVEVVKLMTPAQPQGRKAYQSLLELGFVDTEFKGAAPAGS

SEQ ID NO: 9423 - protein, 120 aa, Candidatus Kuenenia stuttgartiensis
MRSGIMNVIDVIEKEHMKTEIPKYSVGDQVDVSIKIKEGEKERTQVFSGLVIAKNGGGIRETFTVRRIVQGEGVERVFPIHSPKVLDVKVKKSGKVRRAKLYYMRDRTSKGTRLKEKRVD

SEQ ID NO: 9424 - protein, 167 aa, Ostreococcus tauri
MTVTLRSSDDETFVVDDDVALSETIKSIIEGARDGRDGVNGAKDGVRDADTEDESMVPLPNVSSKILAKVIEYAKFHVDAKKANEAEAKIKEFNTEFVKVDQATLFEIILAANYLNMKGLLDLTCMTVANMMKGKTPEEIRKTFNIKNDFTPEEEEEVRKENQWAFD

SEQ ID NO: 9425 - protein, 184 aa, Geobacter metallireducens GS-15
MPRPSVATMPIITDFKAIATGLFVTWKHIFRRSVTVEYPEVKRTPAPRYRARIVLTRDPEGGERCVACYLCSAACPVDCISMEATEDGNGRRYARWFRINFSRCIFCGLCAEACPTLAIQMTPDYEICERDIMELVYEKEDLLIDGCGKDPAYNFYRHAGIGVTQPRGAGEREEEPVDARGLMP

SEQ ID NO: 9426 - protein, 402 aa, Campylobacter upsaliensis RM3195
MDYIKLKEEFKTPFYLYDFDLIKSRFLELKSAFKARKSQIFYAMKANSNLSLLQMLARLDSGFDCVSIGEVKRALRVGVKPYKIIFSGVGKSEEELKQALKFDILYINLESEEEMLLLESVAKKLDLKARISIRVNPNVDAKTHPYISTGLNENKFGVELEVARKMYLYAAKSEFLEPVGVHFHIGSQLLDISPIHDAALIVAKLLRELKALKIELKFFDVGGGLGVGYEGEKEPCLYDYAQGILANLSGLDVTIGLEPGRFLVAKSGVLVCSVLYEKITPKKRFMIVDAAMNDLIRPSLYDAYHEIVLPYTKGEVSPCDVVGGICESGDFFAKDRKLAKSKSGDIVLIKEAGAYGFSMSSNYNTRPRICELALENGAVKMVRKREKFEDLIALEEEFLENL

SEQ ID NO: 9427 - protein, 749 aa, Oryza sativa
MNPATILGHIQLVHMHPDVSCGVHFVTCFQEPRDKAGRNPNRSEMICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRVIDDGDDKLTMFNVYRVVSSVDANNELLFELADFESFADALGGYLLLLLVATWEMEMDCLGASWRSDRYAWVVGDGGSREETQRPRGSMNTQDSKRMRSLGKVLGSRVAGRRQEVHVARGYGKKMATKGRKYDMRSGGGRGGTWRRVTVMNDISHLYKIALLLILGWMYSLHSARTGYMGLTYSILVNLDTYSNLY

SEQ ID NO: 9428 - protein, 447 aa, Triticum aestivum
MAIAVSGHWTRLRTLGCGASGAVVSLAADGASGELFAVKSVRAADAAQLSREQGILSGLSSPHVVACIGGGGARDGSYHLFLEFAPGGSLADEAARNGGRLEERAVRAHATDVLRGLAYIHGKSLVHGDVKSRNVVIGADGRAKIADFGCARALGEARPIGGTPAFMAPEVARGEEQGPAADVWALGCTVVEMATGRAPWGEMDNVLAAVHRIGYTDAVPEVPTWLSAEAKSFLAMCFARDARERCTAAELLEHPFVALQAGEAKARWVSPKSTLDAAFWESETDEEEEEEEEVSESPCERIKSLSCSVLPDWDSDEGWIDVLGEQCEEACDSPAATKGPADVSSRAPSKVLGSPAAPAEDAAVVGTLSSDEHEVDAEDEPFGDDIILAADPLVDRQIQVCWSSDRYVLSSSLVPCNNRIDAIEKFRFPQKKKKKKKKKKKKKKKKK

SEQ ID NO: 9429 - protein, 521 aa, Mycobacterium avium 104
MVLLDGTSSHPRELLGNKGHGIEVMRRHHLPVPPAFCLTTAVGLRYLADPAATMDAVWDDVLDRIGWLQAQTSRAFGRGPHPLLVSVRSGATQSMPGMMDTLLNLGINDSVEQALAAEHGPAFARDTHRRFREMYRRIVGVERPVPSDPYTQLRAGIEAVFASWNSPRARAYRAHYGFADRHGTAVVVQAMVFGNHGPNSGAGAFFSRNPITGDDEPFGEWLPGGQGDDVVSGSVDVEPIAALRDEQPAVYDQLMAAARTLERLDRDVQEIEFTVEDGALWLLQTRAAERSAQAAVRSALQLRREGLIDDAETLRRVTPAHVRSLLMPALQPEIRLTAPLLAKGLPACPGVVSGTAYADVDEALHAAERGEPVILVRDHTRPEDVSGMLAARGIVTEVGGAASHAAVVSRELGRVAVVGCGAGVAAMLAGRRITVDGAEGEVREGELSLSAWSENDTPELRELAEIARLISPLRAHSGGDHPRLDDDSESAVRAALAAGQTDVVSPTPLLVMLTALRQGAP

SEQ ID NO: 9430 - protein, 217 aa, Prochlorococcus marinus str. MIT 9301
MSIFVGNLPFRAEREDAIQLFAPFGEVLNCSLPLERDTGRKRGFAFIEMADEAIESTAIDGLQGTELMGRPLRINKAEPRGSGGSRRGGRGGGYGGGNSGGGYGGGGYGGGNSGGGYGGGGYGGGNSGGGYGGGGYGGGGYGGGGYGGGGYGGGNSGGGYGGGNSESNSSNINKSSGAEGWEDRSYGNSSENSEYESGRSRRKRGVSNESNASNEAD

SEQ ID NO: 9431 - protein, 324 aa, Pyrococcus abyssi GE5
MLALGIEGTAHTLGIGIVSEDKVLANVFDTLTTEKGGIHPKEAAEHHARLMKPLLRKALSEAGVSLDDIDVIAFSQGPGLGPALRVVATAARALAVKYRKPIVGVNHCIAHVEITKMFGVKDPVGLYVSGGNTQVLALEGGRYRVFGETLDIGIGNAIDVFARELGLGFPGGPKVEKLAEKGEKYIELPYAVKGMDLSFSGLLTEAIRKYRSGKYRVEDLAYSFQETAFAALVEVTERAVAHTEKDEVVLVGGVAANNRLREMLRIMTEDRGIKFFVPPYDLCRDNGAMIAYTGLRMYKAGISFRLEETIVKQKFRTDEVEIVW

SEQ ID NO: 9432 - protein, 374 aa, Prochlorococcus marinus str. MIT 9301
MADFYQILGVSRDADADTLKRAYRKLARQYHPDVNKEPGAEDKFKEIGKAYEALADPETRARYDQFGEAGLGGAAGMPDMGDMGGFADLFETFFNGFGGQNPQGGRTQRRGPQQGDDLRYDLNVDFKDAIFGQQREIKIPHLETCEVCRGTGAKPGTGPKTCSTCGGSGQVRRATRTPFGNFTQVAECPSCNGAGQIIADPCVSCGGNGVKQVRKKLRINIPAGVDTGTKLRVSGEGNVGLKGGPPGDLYVFIKVKNDSKLKRDGVTIYSEIDVSYLQAILGDTVKVTTVDGNVNLKIPCGTQPNTTLSLENKGVPRLGNPVARGNHEVLVKVKLPTRVTDEERKLLEGLASQYSDKNINSSSGLFSKLFGKES

SEQ ID NO: 9433 - protein, 332 aa, Sulfolobus solfataricus P2
MFQDIPKSKLLDMYKKMLLIRYHELTAKELFASGKIPGFVHLYVGEEAVAVGVMSTLRDDDYITSTHRGHGHCIAKGLDVKRMLAEIMGKKTGVCKGKGGSMHIFDYSKGMLGANGIVGGGAPHAVGAALAFKLKGLDRVAVAFIGDGAMNQGVVLESLNLSAIWKLPVIFVVEDNMYAMSTRSLVPGKLQPRHSAAKSYVERALGFGIPAVEVDGMDVLAVYEVAKEAVDRARRGGGPSLLHCKTYRFFGHFEGDPLVYRDKEEEEMWRKRDPITLFRDKLVSNNIINSEELDKIDREAKAEIEQALKFAEESPYPEVEEALTDVFTDNSY

SEQ ID NO: 9434 - protein, 324 aa, Sulfolobus solfataricus P2
MRQITFTEAINEALRQEMERDPSVILIGEDIGVYGGAFGVTKGLIEKFGSDRVIDTPISEAGFIGAAVGAALAGLRPVVELMFVDFFGVAMDQIYNQMAKLRYMSGGQLKVPLTLRAPIGAGISAAAQHSQTLYSIFAHVPGLKVVVPSTPHDAKGLLISSIRDDNPVVFLEHKVLYGIKGEVPEEEYTIPLGKAEIRREGDDVTVIGIARTVWHSLEAAEQLSKESISVEVIDVRSIVPFDKETVIKSVKKTGRVVIVDEDYDRCGFASWVSSIIADEAFEYLDAPIKRITTPNVPIPFSPPLEQYILPDSKKIVNTVKSILG

SEQ ID NO: 9435 - protein, 159 aa, Rickettsia typhi str. Wilmington
MINYLKSFFLYEIVRGLTLTLKYFFKPKVTINYPYEKSPVSPRFKGEHALRRYENGEERCIACKLCEAVCPAQAIVIESDERDDGSRRTTRYDIDMTKCIYCGLCQEACPVDAIVEGPNFEFASLTHTALIYDKERLLYNGDKWEQELTNKLHKDYQYR

SEQ ID NO: 9436 - protein, 428 aa, Collimonas fungivorans
MTIKHEVPSYLTQHGIGPWGDYLEQIDRVTPYLGNLARWVETMKRPKRMLIVDVPIERDDGTIAHFEGYRVQHNTSRGPGKGGVRFHQDVTLSEVMALSAWMTVKNAAVNVPYGGAKGGIRVDPKTLSQGELQRMTRRYTSEIGIIIGPNKDIPAPDVNTNEQIMAWMMDTYSMNQGSTASGVVTGKPISLGGSLGRREATGRGVFVVGCEAAVKRGLDIHGAKIAVQGFGNVGGIAARLFSEAGAKVVAVQDHISTVVRSSGLDVAALQAHVNETGSVAGFKGGEEISDRAQFWAVDCDILVPAALEQQITVENAPTIRAKIILEGANGPTSPAADDILHEKGVLVVPDVIANAGGVTVSYFEWVQDFSSFFWTEDEINLRLTRIMREAFTAVWQLAEEKKVSLRTAAFIVACTRVLQAREMRGLYP

SEQ ID NO: 9437 - protein, 512 aa, Hieracium pilosella
MTLLSLIIYLCITGVTAYVLVNLRTRRANRLPPGPTPWPIVGNLPHLGTIPHHSLADLATRYGPLMHLRLGFVDVVVAASASVAAQFLKTHDANFASRPPNSGAKHMAYNYQDLVFAPYGPRWRMLRKICSVHLFSAKSLDDFRHVRQEEVAILTRALVGAGKSTVKLGQLLHVCTTNALVRVMLGRRVFGDGSGGGDPKADEFKNMVIEMMVLAGEFNLGDFIPVLDLLDLQGVTKKMKKLHTRFDSFLNSILEEHRTSSGGASGHVDLLSTLISLKDEADGEGGKLTDTEIKALLLNLFVAGTDTSSSTVEWAIAELIRNPQLLKQAQQELDTVVGQGRLVNESDLSQLTFLQAIVKETFRLHPSTPLSLPRIASESCEINGYNIPKGSTLLVNVWAIARDPKMWTEPLEFRPSRFLPDGEKPNADVKGNDFEVIPFGAGRRICAGMSLGLRMVQLLTATLIQAFDWELANGLEPRNLNMEEAYGLTLQRAQPLMVHPRPRLAPHVYGTG

SEQ ID NO: 9438 - protein, 76 aa, Glycine max
MASLATLAAVQPATINGLAGRSLSGTKLSFKPSRHSVKSENFRSGAVVAKYGDQSVYFDLDDLGDTTGLWDLSSSD

SEQ ID NO: 9439 - protein, 418 aa, Debaryomyces hansenii CBS767
MEQRLNIDEYQVDILYHLSSIQSTTSPNLSLIQQQPEINLKMRPLLLDFLMDVISKLNLSLSTFPLTVNLIDRYCSTRIVKKQHYQLLGLTSLWISCKNLDAKFKIPSLFDLCKMCCNCYDKKLFLEMENHVLKSLNWLISNPTFDQFIEIYINMLDSTKFIESSPANKNNVKTMAVYICELIQFYPNIYFNNNSSQIALGGLLTSLLICKVPIKLESALKHLNSYLDQDSIFDLASFNSFYKNLLKILKCPPPSLKLKYFSETGPSLKLMKIMIHYVNDRNANITPITPKFQIHEQSSQSSCYANFPRTPVSNNISPRIQLPPHSPAQVPTNTHSYNHSISSTTSELLPSPKASPENLSFDSFPARSPVDIHPPLHMPTITTTANFFHGRKRSIDDDTSVESPNKKLRARKPAFYIS

SEQ ID NO: 9440 - protein, 637 aa, Glycine max
MLLPTSGVGMNSAMDDMNLIQQTQRHHLVVREIGEEIDLEIGAGEDDPSFGSATLIGAPMRESSVEEHGESKQMGMISQLPNDAQDMSKTQQGKRKKKVVKRWREEWADTYKWAYVDVKDGTPRIFCSVCREYGRKHRRNPYGNEGSRNMQMSALEEHNNSLLHKEALRLQMASKDKIVVDKPVYVKVAMSKTAGSILEATLKRDPHEVEFIQAVQEAVQALERVIAKNSRYINIMERLLEPERMIVFRVSWVDDRGGTCVNRGFRVQFNQSMGPCRGGIRFHPSMNLSVAKFLGFEQTLKNALSPYKLGGAAGGSDFDPKGKSDNEIMRFCQSFMSEMYRYLGPDKDLPSEEMGVGTREMGYLFGQYRRLAGHFQGSFTGPRIFWSGSSLRPEATGYGLVFFAQLMLADMNKELKGLRCAVSGSGKIAMHVLEKLIAYGALPISVSDSRGYLVDEDGFDYMKISFLRDIKAQQRSLRDYSKTYARSKYYDEAKPWSERCDVAFACTSQNEIDQSDAINLVNSGCRILVEGSNMPCTPEAVQILRKASVLIAPAMAAGAGGVVAGELELNHECSLMHWSPEDFESKLQEAMKQTYQRAMKAATDFGYQKESPEALVHGAVISAFLTIAQAMTDQGSI

SEQ ID NO: 9441 - protein, 143 aa, Magnetospirillum magnetotacticum MS-1
MTVARILAEKGNSVVTVPPHRTVDEAIHLLAEKQIGALVVADAGGHVIGILSERDVMRALARDGAAALDQSISHYMTAKVVTCTRRASIEDVMETMTEGRFRHLPVVEDGHLVGVVSIGDVVKRRIAAVEAEHQAMRDYITMA

SEQ ID NO: 9442 - protein, 155 aa, Brassica napus
RDPDPVIFLENELLYGESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVD

SEQ ID NO: 9443 - protein, 401 aa, Marinobacter sp. ELB17
MAHQEDLARLMTLEQGKPIAESRGEVAYGASFVEFYAEEAKRMAGETLQSHGVDKRILVFRESIGVVAAVTPWNFPLAMITRKCAPALAAGCTVVIKPAEATPLTALALVRLAELAGLPAGVINVITASQPAAVGDVLTTDPRVRKFSFTGSTAVGKKLLAQCAGTVKKASMELGGNAPFIVFDDADLDAAIEGAIASKYRNSGQTCVCTNRFLVQSGVYDAFVEKLAARVKQLKVGNGLDAGVVQGPLINQAAVEKVKAHIADALEKGGRLICGGKAHALGGTFFEPSIIADATGDMRVAQEETFGPLAPIFRFDTDEQAIAMANATNSGLAAYFYAKDYRRIWHVMEGLEYGMVAVNEGILSTELAPFGGVKESGLGREGSRHGLDEFTELKYVCVGGL

SEQ ID NO: 9444 - protein, 191 aa, Aspergillus nidulans FGSC A4
MPAYHSIFLEDRDVPVIGNFPVLPLRTRTRGPAYTLPMLPPGVADIDVQPDNESYDCVDEILSLFRANVLFRNFEINGPADRMLIYGTLFITECLGKVKPTMSAREAEKALTNVALDNFAIPGDASFPLNQAFEPPRDRQDAETLRSYLTQVRQEIASRLLARLYPGGVGPSKLRQFWLSFTKRKFMGKSF

SEQ ID NO: 9445 - protein, 363 aa, Pseudomonas putida GB-1
MSKPFRIAAIPGDGIGNEVLPEGIRVVEAAARKHGLDISFEFFEWASCDYYLAHGKMMPDDWFEQLKGFDALYFGAVGWPDKVPDHISLWGSLLKFRRDFDQYVNIRPVRLFPGVPCPLAGREPGDIDFVVIRENTEGEYSSLGGRMFEGTENEFVLQESVFTRRGVDRILKYAFDVAQTRERKHVTSATKSNGMAVSMPYWDERTAAMAANYPEISWDKQHIDILCARFVLQPDRFDVVVASNLFGDILSDLGPACAGTIGIAPSANLNPERKFPSLFEPVHGSAPDIYGKNIANPIAMIWSGALMLDFLGNDGADPRYRAAHDDILKAIEQVIAAGDVTRDMGGQQSTQQVGQAITALVEA

SEQ ID NO: 9446 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 9447 - protein, 540 aa, Uromyces viciae-fabae
MDGNIREADAEKVSTSVLESALPAADAGNKPAPHQLQRQLQNRHVAMISIGGAIGTGLFIGTGTALSNGGPFSLVVGYCLMALMVWALMCSLGEMIAHLPIAGGHLALADRFFSPSLSFTLGWSYWYLWSIVLPTELSASALFISFWTVKVHLGIWIFIFLAIVALINLGGVRFYGEMEFWFSSLKIITIVGVLILGFVLDLGAVTGDTIGFRYWKNPGLFVQYEGVPGAAGRFLGFFSVLVTAAFSFIGVEMPAIAAAEAKNPRRNLPRAIKRVAARVVGFYILSTIVVSMLVPSNEPRLRLSSSTGAKSPFVIAIHNAGIKGMSSVINGCLLSFTLSAASSDLYISSRSLYGLSITGNAPRFLSKTTSNGLPIYCYLIGVMMGTLAFMATGDGQAGKLFGYLANLTSVTGLLSWSGIFITYIRFRGGMKLQNFDRQQLPYRSPVGVTGAWFGLVSCNIIIIFNGFSVFLKGKWNSATFFTCYFPVAAFVFLFCAHAWWTKAGLVQKKHMDFATGSDCPDEDEESPPKSWVQKVWRAIM

SEQ ID NO: 9448 - protein, 404 aa, Symbiobacterium thermophilum IAM 14863
MSMAEDLHLEEQRPERMTLSIGPHHPATHGVLRVKLELEGETVVKAEPETGFLHTGIEKTAEHLTWNQATTVMDRMDYLSPISNNTGYVMAVEKLLGIEDRIPEKARVTRVILLELNRVASHLVGLGTGGLDYGNIGTPIFWAFELRDRILDIFEHTTGQRMNPSYMRVGGLAYDLPHNFKEMVEDFLKVAPGRIQELKDVMLHNPIFVDRAKGVSVITYEQALRYGLTGRNLRVTGSDYDVRKYYPYLGYENYDFKVPVYTDGDSWSRVAITFDEMFESLKIIRQALDNLPWDDRYIIDDRKLVLPPKQEVKHSMEALIHHFKLVHHGFDVPAGEVYVSIESPRGEIGFYVVSDGGNKPMRVRVRPPSFYAVYSLPVLLEGHLLSDMVGAIATIDPVFGEVDR

SEQ ID NO: 9449 - protein, 401 aa, Spinacia oleracea
MASNMLSIANPSLRVYNKGFSEFSGLHTSSLPFGRKGSDDLMAFVSFQTNAVGGKRSSQNGVVEAKLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQ

SEQ ID NO: 9450 - protein, 153 aa, Brassica napus
MAAARQLRALQSHPENKVCVDCAQKNPQWASVSYGIFMCLECSGKHRGLGVHISFVRSVTMDSWSEIQIKKMEAGGNARLNSFLSQYGIAKETDIISKYNSNAASVYRDRIQALAEGKAWSDPPVVKEGVHKKPPLAAQGGGGGGWDSWGNED

SEQ ID NO: 9451 - protein, 139 aa, Triticum aestivum
  misc_feature (90)..(90): Xaa can be any naturally occurring amino acid
  misc_feature (95)..(95): Xaa can be any naturally occurring amino acid
MSAMETDAPDAPPPAAPAPAADAGAGSSSSSSRKPGKRFEIKKWNAVALWAWDIVVDNCAICRNHIMDLCIDRGGGPFYIIGEAPRCQAXQASAXSEECTVAGGVCNHAFHFHCISRWLKTRQVCPLDNSEWEFQKYGH

SEQ ID NO: 9452 - protein, 800 aa, Coprinopsis cinerea okayama7#130
MGGSSVVDGMKLVVLGGTVETARRISSSAWSHFVNSFFLTAHFCEEEHPYDWLMLWLSRRPEWQRSREFETTIRSGSTSTSSTFGSPADQEWDEAEREWEAYNAHFERGYSHHGQDGEDDTDPIEKPKTRIVFQPTYDTTHTIFFRGHWLRVRRSRKHDTNSEMISISVIARSNNILKQLVLQAKKEYEAECVHRIQIYFADAHGSWRWTDSRAKRPLSSIVLNPGVKEMLVDDAKDFLRSEKWYADRGIPFRRGYLLYGVPGSGKSSLIHALAGYLQLDIYVVSLSASWISDSTLTSLMGRVPARCVVLLEDLDAAFTRSVSRDDEEEILGSSNNNNNNGNNGGNNNNAEGPQEQQSGFSSFYGSGRRRGGRSGRSGEYLSDVNTLSLSGLLNALDGVAASEGRLLFATTNHLDKLDEALRRPGRMDVWIEFKNASKWQAEALFRNFFPACDEDEVEDVDSDGALSAGELEARRRDAREAQKRREREVDEALKNIKVESRMFTPNPPVPTTGVPSSPSTSSVWSIASSASNLLSSASSLSLPFGSSSGSSTPSVSPASSTSASRKTSSASSSIASAAAAVSSSRPHVKKFGEGNTAYIAPPPTDDIASRRHSAAPLDKKTLAVLAKKFADGVPEEEFSVAGLQGYLLKHKSNPHLAASNIESWVASERALRVKLAQEKAAREEREKQLREKRRQELLLKREEKKKQEEKEAEMEKIKAKLAEKEKEEELEKMRQKLREKEEEARKKEREEREGKSGDSAEEKKEEEKVEEKKEEHKTEEEKKSDSDDDEDKENWSDALP

SEQ ID NO: 9453 - protein, 340 aa, Prochlorococcus marinus str. MIT 9301
MTLRVAINGFGRIGRNFMRCWLSRGAYTNIEVVGINVTSDPKTNAHLLKYDSVLGQLDGVDIQYTDDTFVINNKTIKCFSDRNPLNLPWKDWGVDLVIESTGVFNTDVGASKHLEVGAKKVILTAPGKGDGVGTYVVGVNADTYKHTDYDILSNASCTTNCLAPVVKVLDQTFGINKGLMTTIHSYTGDQRILDNSHRDLRRARAAATNIVPTSTGAAKAVALVYPEMKGKLTGIAMRVPTPNVSAVDFVFESSKSVTTEEVNNALKEASLSSMKGIIKYGDEPLVSSDYAGTNESSIVDSDLTMCIGDNLVKVLAWYDNEWGYSQRVVDLAEIVAKNWE

SEQ ID NO: 9454 - protein, 294 aa, Solanum lycopersicum
MDQYEKVEKIGEGTYGVVYKARDRVTNETIALKKIRLEQEDEGVPSTAIREISLLKEMQHANIVRLQDVVHSEKRLYLVFEYLDLDLKKHMDSCPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQPPLFPGDSEIDELFKIFRVLGTPNEDTWPGVTSLPDYKSAFPKWPPKDLAIIVPNVDGAGLDLLGKMLSLDPSKRITARNALEHEYFKDIGYVP

SEQ ID NO: 9455 - protein, 651 aa, Triticum aestivum
MSKLLVIALLLLPLINHGIYLATAWDDQDFFKYCPPSNCSQHGPEVRFPFCLESSNTSAVAAAAAASCGCSSTDGLIWKLACFGQDTILVHPVLGSYSVSAIDYRRSSVKLIPLVDPCLMLQQKLAISRRWSSRQVDVIDGMQLPDRQFSILSYKYATLVCCSSEFTPAAVDADSIAGPVSCLSNTTLFLYLVAAYKDMSILPLDCKVFPVSDGVSGRLIPMYMLEDPMSGTPFSLSFKERAERMLSFAETTVYWFGGNCRQCELSGQRCAFSSQRDETFCIPDPHGSRIKVIAATSSVAAFVVLLVTVATVLYPSLKTRYNAEIHLKVEMFLKTYGTSKPTRYTFSEVKKMARRFKEKVGQGGFGSVYKGELQNGVPVAVKMLENSTGEGEAFINEVATIGLIYHANIVQLLGFCSEGMRRALIYEFMPNESLEKYIFSRDSANFQHLLVPDKLLDIALGIARGMEYLHQGCNQRILHFDIKPHNILLDYNFNPKISDFGLAKLCARDQSIVTLTAARGKMGYIAPELYSRNFGGVSYKSDVYSFGMLVLEMVSGRRNSDPRIGSQDDVYLPEWIYEKVINGEELALTLETTQEEKDKVSQLAMVALWCIQWNPRNRPSMTKVVNMLTGRLQSLQMPPKPFVSYENEPMP

SEQ ID NO: 9456 - protein, 294 aa, Solanum lycopersicum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNVLKLADFGLARAFGIPVRTFTHEVVTLWYRAPEILLGSRHYSTPVDVWSVGCIFAEMVNQRPLFPGDSEIDELFKIFRVVGTPNEDTWPGVTSLPDFKSAFPKWPSKDLGTVVPNLGAAGLDLIGKMLTLDPSKRITARSALEHEYFKDIGFVP

SEQ ID NO: 9457 - protein, 359 aa, Marchantia polymorpha
RVAAQSAVAVSGAQKRAVVEAKVKVAINGFGRIGRNFIRCWHGRKDSPLEVVVINDTGGVKQASHLLKYDSMLGIFDADVKAVGDDAISVDGKIIKIVSDRNPLNLPWGEMGVDLVIEGTGVFVDKEGAGKHLQAGAKKVLITAPGKGPIPTYVIGVNEELYDPSEQIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFREAANGDMKGILAVCDEPLVSVDFRCTDVSSTVDSSLTMVMGDDMVKVVAWYDNEWGYSQRVVDLANLVAEKWTGA

SEQ ID NO: 9458 - protein, 321 aa, Brassica napus
  misc_feature (308)..(308): Xaa can be any naturally occurring amino acid
MVTEEDKIFAKNFKIDDLSDVPAGLPPHLKLKQNRVVSKKDASVDTADAIYSGSYVSSGVDNSVKLENFYEDFKVDVISCTETDMEFDMIGIDAAFANAFRRILIAEVPSMAIEKVLIAYNTSLIVDEVLAHRIGLIPIAADPRLFEYLTENDQPNEKNTIVFKLHVKCPKGQPRLQVLTNELQWLPNGSEFLKETGGSTSNSNSNSKPKTYTSFSCSQDSLPEFADNPITPTYLDILIAKLSPGQEIELEAHAVKGIGKTHAKWSPVGTAWYRMLPEVVLLGEVEDEKAERLVKVCPQNVFDIEDMXNGRKRATVAQPRI

SEQ ID NO: 9459 - protein, 393 aa, Marchantia polymorpha
VAAQAASFKRSSLGEFSGLKASSAVTFGKSSSENGFFDAVASQVAVKAGASGAIKGETSAKLRVAINGFGRIGRNFLRCWHGRGDESPLEVVAVNDSGGVKNAAHLLKYDSMLGIFKADVKVGDDTTLLVDGKPITVVSNRDPLKLPWAELGIDIVIEGTGVFVDGPGAGKHIQAGAKKVIITAPAKGADIPTYIMGVNEGDYSHEVANIISNASCTTNCLAPFVKVLDEKFGIVKGTMTTTHSYTGDQRLLDASHRDLRRARAAALNIVPTSTGVAKAVSLVLPQLKGKLNGIALRVPTPNVSVVDLVINTEKKGLTAEDVNNAFREAANGPLKGILAVCDIPLVSIDFHCSDVSSTVDSSLTMVMGDDMVKVVAWYDNEWGYSQRVVDLAH

SEQ ID NO: 9460 - protein, 56 aa, Pediococcus acidilactici
MMAENNTYYITTPIYYPSGKLHIGNSYTTIACDAEARFQRLQGKDVFFLTGTDEHM

SEQ ID NO: 9461 - protein, 459 aa, Rickettsia typhi str. Wilmington
MEQYDVAVIGGGPGGYVAAIRAAQLKKKVVLIEKSHLGGVCLNWGCIPTKSLLKSAEVFEYIKHAKDYGIDVGIAEINIQKIVERSREIASTLACGVQLLLKKNKVTIINGVASFGENKVINVNDKPTVKANNIIIATGARPKILQGFEPDITQIWTSKEAMIPQYVPKSMIIIGSGAIGIEFASFYNSIGVDVTIIEAYNRILPSEDTEIAGIAHKIFEQKGIKILTNAKLIKQTKSQNKIEVELELEGKKQKLQATILLMAVGITANIENLGLEKTKVQVENGYIVTNGLMQTAESGIYAIGDVSGVPCLAHKASHEGIIAAESIAGLKPNSINKHNIPYCIYSSPQIASVGLTEEVAKDLGYEIKIGRFPFRANGKALVSGNSYGLIKTIFDVKTGELLGAHMIGLEVTELIQGYVVSKNLEGTELDLIHTIFPHPTLSEMMHESVLAAYDMAIHI

SEQ ID NO: 9462 - protein, 408 aa, Marchantia polymorpha
SSISTTLQSGAKAEGRNANSQSMVAFSNQGRSVNMQTKGSFFSSTELLSSGTPPRKQQLSGPIRATATQTPTISKKSGSKEKAKIGINGFGRIGRLVLRIALSRDDVEVAAVNDSFLTADYIRYLFKYDSTHGVYPGEVEVIDENTLSVDGHKIKFFGSKTPADIPWGDSGVDYVVESTGVFTNIAKASAHLQGGAKKVIISAPSEDAPMYVMGVNEEKYSADQNIVSNASCTTNCLAPLAKIVHQEFDIVQGLMTTVHATTATQKTVDGPSGKDWRGGRGAGQNIIPSSTGAAKAVGKVLPELNGKLTGMAFRVPTPNVSVVDLTCRLEKKASYDDIKKVIEAASESSMKGILGYTEDAVVSSDFIGDARSSIFDAHAGIGLGDGFMKLVSWYDNEWGYSNRVVDLI

SEQ ID NO: 9463 - protein, 174 aa, Vitis vinifera
MPRERDPLVVGRVVGDVLDPFLRSITLRVTYNNREVANGCEFRPSQLVSQPRVDIGGDDLRTFYTLVMVDPDAPSPSNPNLREYLHWLVTDIPATTGANFGQEIVCYESPRPTAGIHRFVFVLFRQLGRQTVYAPGWRQNFNTRDFAELYNLGLPVAAVYFNCQREGGSGGRRS

SEQ ID NO: 9464 - protein, 310 aa, Mesostigma viride
SPLEVVAINDSGGVKQASHLLKYDSMLGTFAADVKAVSDDTISVDGKLIKIVSSRDPLSLPWKEMGIDIVIEGTGVFIDEAGAGKHITAGAKKVLITAPGKGPNIPTYVVGVNADQYKSTDTIVSNASCTTNCLAPFAKVLDEKFGIIKGTMTTTHSYTGDQRLLDASHRDLRRARAAALNIVPTSTGAAKAVALVLPKLKGKLNGIALRVPTPNVSVVDLVIQVEKKTFAEEVNAALREAANGPMKGVLAVCDEPLVSVDFKCSDVSSTIDASLTMVMGDDMVKVVAWYDNEWGYSQRVVDLAHIMAKE

SEQ ID NO: 9465 - protein, 443 aa, Clostridium beijerinckii
MAKYTKGDIINLVKENGVKFIRLQFTDIFGTLKNVAITDRQLEKALNNECMFDGSSIDGFVRIEESDMNLRPNLDSFVIFPWRPQQGKVARLICDVYKPDGKPFEGDPRYILKRAIADAAELGYTMNVGPECEFFLFETDENGNATTNTQDKGGYFDLAPTDLGENARRDMTLALEEMGFEIEASHHEVAEGQNEIDFKYGDALTTADSIMTFKLVVKSIAQRHGLHASFMPKPIFGINGSGMHVNMSLFKDGKNVFVDENDKNGLSPIAYNFIAGLLKNIKGLAAVTNPLVNSYKRLVPGYEAPVYLAWSCKNRTALIRVPAARGAGTRVELRCPDPSSNPYLVLAALLQAGLDGIKNNLQPPAEVEANIFAMTDEERKANGIDNLPNNLYEAVQFMRESELAKSALGDHVYNNYLEGKAAEWDDYRTKVHDWELENYLNRY

SEQ ID NO: 9466 - protein, 158 aa, Aspergillus flavus
MEHSSAPNNAALDNIVSASNTVDRDEVERLRKRFMKLDKDSSGTIDRDEFVSGLSAFSSKGNKEEKLRFAFKVYDIDRDGYISNGELFIVLKMMVGNNLKDVQLQQIVDKTIMEADKDQDGKISFEEFTDMVENTDVSLSMTLSMYPQFSFSLVSRLW

SEQ ID NO: 9467 - protein, 153 aa, Oryza sativa
  misc_feature (44)..(44): Xaa can be any naturally occurring amino acid
MEHQGQHGHVTSRVDEYGNPVGTGAGHGQMGTAGMGTHGTTGGXERTAPMREEHKTGGVLQRSGSSSSSSSEDDGMGGRRKKGIKEKIKEKLPGGNKGEQQHAMGGTVGAYGQQGHGTGMTTGTTGAHGTTTTDTGEKKGIMDKIKEKLPGQH

SEQ ID NO: 9468 - protein, 205 aa, Oryza sativa
  misc_feature (159)..(159): Xaa can be any naturally occurring amino acid
  misc_feature (193)..(193): Xaa can be any naturally occurring amino acid
TRTCLYRGIGHYRRGHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVLTAEDAEAWHAQGKDVILVRTETSPEDVGGMXHAAVGILTARRGMNSHAAVVARGWGKCCVSGCSXSVRVTDATRLTR

SEQ ID NO: 9469 - protein, 279 aa, Fagus sylvatica
ERRVEKPLPTYVPRDEQFEESKQDTFSAMRLKGVLHNLIPSLKASISANNHEFKGFSEIDNLYSEGVLLKIGLQEELLKKLPLPKVVSNNRGIIKYDTPKILSKDRFAWLRDDEFGRQAIAGINPVSIERLKAFPPVSNLDPKIYGHQESAIKEEHIVGYLNGMTVQQALEKNKLFILDHHDAYLPFLDRINALDGRKAYATRTIFFLTPLGTLKPIAIELSLPPSGPSSRSKRVVTPAVDATTNWTWQLAKAHVCSNDAGCTTCYHWLRTMRAWNHYT

SEQ ID NO: 9470 - protein, 162 aa, Symbiobacterium thermophilum IAM 14863
MNGVAAIAKGMATTLKVLFRKPVTVDYPYVKRPRAPRFRGRHELRTYENGLEMCVGCELCQVACPAAAITVQAAENDPDNPHSPGERYGYKYQVDLLRCIFCGMCEEACPTDCLHLTQEFELADFTRESLILQKEQLVNRNPSGFKVPMNVYPPFRRKAVNA

SEQ ID NO: 9471 - protein, 115 aa, Campylobacter upsaliensis RM3195
MREKSVFELIVEGKVPCNKVLEDNDFLAFEDINPRAPIHILVIPKKHFRDFQEFEPELMAKMTRFIQKLAVLLGLDKSGYRLVSNCGKNSGQEVFHLHFHILSGFEKTSKTSTLF

SEQ ID NO: 9472 - protein, 485 aa, Oryza sativa
ALAGRDLMACAQTGSGKTAAFCLPVVSGLVAAGGSGIGHRERSSFNRAAAKPRALVLAPTRELAAQINEEAKKFSFQTGLRVVVAYGGTPMYNQLRDLERGADILVATPGRLVDMVERSKVSLEAIKYLVMDEADRMLDMGFEPQIRKIVERMNMPRKSVRQTMLFSATFPPEIQRLASDFLSNYIFITVGRVGSSTDLIMQKVELLSDGEKRGYLLDLLQRQSVGVANSKLQQPLTLVFVETKREADSLRYWLYSKGFPATAIHGDRTQQERESALRSFKTGLTPIMVATDVASRGLDVPNVAHVINYDLPKSIEDYVHRIGRTGRAGKAGSATAFFTESDHSLAKGLLELMTEAKQDVPDWLVQYAERPYYGGSSYGGRNRRSGGGGNRFAGRDFRQGSGGGYSGGGGGGGYSGGGGGGGYSGGGGGYSGGGRGGGYSRGGRGGYSGGGGGGGGDPYRASAPPPRYYPSYPMGTADINASGWD

SEQ ID NO: 9473 - protein, 472 aa, Mycobacterium avium 104
MNVHPAGPRHAEETRHPESPPRPQSPEELLLLAPNVWPRNATRNEAGVATIAGVAVTELAREYGTPLFVVDEDDFRSRCREIASAFGGGNNVHYAAKAFLCSEVARWIDEEGLSLDVCTGGELAVALHADFPPERITFHGNNKSVAELTAAVKAGVGHVVLDSMTEIERLDAIAADAGIVQDVFVRLTVGVEAHTHEFISTAHEDQKFGLSVASGSALAAVGRVFDTEHLRLVGLHSHIGSQIFDVAGFELAARRVIGLLHDAVEQFGVEKTAQIATVDLGGGLGISYLAADDPPPMGELAGKLSAIVQHESAAVGLPTPRLVVEPGRAIAGPGTITLYEVGTVKDVDVSATAHRRYVSVDGGMSDNIRTALYDAQYDARLVSRVSDAPAELARIVGKHCESGDIVVRDTWVPGDLRPGDLIGVAATGAYCYSLSSRYNMVCRPAVVAVRDGRARLVLRRETVDDLLSLEVR

SEQ ID NO: 9474 - protein, 528 aa, Prochlorococcus marinus str. MIT 9301
MSQKSFKKERDPSILILDFGSQYSELIARRIRETNVFSLVVSNCISIEDINDINPKGIILSGGPNSVYEQNAPKCDKKIFNLGIPILGICYGMQLMVKELGGSVISATKKAEYGRAPINIDQESDLLRDVEDKSIMWMSHGDSINCLPDGFNKIAHTENTLHAAISNDIKKLFGVQFHPEVVHSEFGMKIIKNFVYNISCCEADWTTETYIEETIPRIREQVGNKKVLLALSGGVDSSTLAFLLNKAIGNQLTCMFIDQGFMRKGEPEFLMNFFDKKFHIKVEYINARERFIAKLKGITDPEQKRKIIGEEFIRVFEEESNRLGPFQYLAQGTLYPDVIESAGTNIDPKTGERIAVKIKSHHNVGGLPKDLQFKLVEPLRKLFKDEVRKVGGALGLPDEIIKRHPFPGPGLAIRILGEVNNEKLDCLRDADWIVRDEIKKAGLYNDIWQAFAVLLPVKTVGVMGDKRTYAWPIVLRCVSSEDGMTADWSKIPFKILERIANRIVNEVISVNRVVYDITSKPPGTIEWE

SEQ ID NO: 9475 - protein, 384 aa, Mesostigma viride
ARLAPVQATGSSQKQVTEAKLKVAINGFGRIGRNFLRCWVGRENSPLEVVAINDSGGVKQAAHLLKYDSMLGTFKADVKVISETALAVNGKTIEIVSSRDPLQLPWAKMGVDLVIEGTGVFIDGPGAGKHIIAGAKKVLITAPAKGAEIPTYVVGVNEKDYTHDVSNIISNASCTTNCLAPFAKVLDENFGIVKGTMTTTHSYTGDQRLLDASHRDLRRARAAAFNIVPTSTGAAKAVSLVLPKLKGKLNGIALRVPTPNVSVVDLVINTTKKGMTAEEVNAAFRKEANGAMKGILAVSDLPLVSIDFRCSDVSCTIDSSLTMVMGDDMVKVVAWYGNEWGYSQRVVDLADIVANNWPGMVQETGSDPLETFCNTNPDADECRV

SEQ ID NO: 9476 - protein, 351 aa, Brassica napus
MMKETNAAGEASSSLRRHRKRQRLPSVENGRETASVDGDEVIPEARSGALLDLDLLDCPVCFQALTQHVFQCDNGHIACSSCCRELRNKCPACALPIGNNRCRIMERVVESVTVPCPNAKHGCTEKFSYGKELAHEKECRFALCYCPAPDCNYAGVYKDLYTHYDANHKDTSTRFVCDTLHRTYLGTVSTTSVLQEYRDGPLVVVQGFVVAHGLSVTVNCIAPSAPGVGKFSFNLTYTLGRHTVTFGSTEMNRIQKVSLETPQSDFMSIPSYLVSPIIVKNLRICIRRLEEEAGEDEEEEEAGEEEEAGEEEEEAGEEEEEEEAVEVDVVNNVRRSTRQKKGNSKYQNKVK

SEQ ID NO: 9477 - protein, 459 aa, Synechococcus sp. WH 8102
MTQAFASQKPYETERDTASPNRNLAPVTTCLDERDRLMVGGCLLSDLAQRYGTPLYVLDEDTVRGTCRAYRDALKQHYPGPSLPIYASKANSSLLVSSIAASEGLGLDAVSAGELLTAFQGGMPGERMVLHGNNKNDEELLLAYNNDVTIVVDNQHDLERLAELVPAGGAPARLMLRFTPGIECHTHEYIQTGHLDSKFGFDPDLLESVLRQLVGKPWAKLTGLHAHIGSQIFELEPHRDLAAVMADALKLARSLGHPVEDLNVGGGLGIRYVASDDPPTIEQWVKVVADAVTAACRDRQLELPRLLCEPGRSLVATAGVTLYAVGSRKTIPGVRTYVAIDGGMSDNPRPITYQSLYTCCLADRPLAPAEETVNLVGKHCESGDVLLKDLPLPTTQSGDIVAVFATGAYNASMSSNYNRIPRPAAVVVQSGSSELFQKREQPDDLLRYDVLPERFRALP

SEQ ID NO: 9478 - protein, 250 aa, Fagus sylvatica
GFNAFWYSHHLFVIVYVLFIVHGYYLYLSKKWYKKTTWMYLAVPIILYACERLIRAFRSGYKTVRILQVAVYPGNVLALQMSIPQGFKYTSGQYIFVNCAAVSPFQWHPFSITSAPGDDYLSIHIRTLGDWTSQLKTVFSKVCQPPCSDQSDLPRTDIAPGNNIPRMPRLLIDGPYGAPAQDYKLYDVLLLVGLGIGATPLISIVKDVLNNIKQQREIEEGMVESGVKGNKRKPFATSRAYFYWVTREQA

SEQ ID NO: 9479 - protein, 274 aa, Synechocystis sp. PCC 6803
MQRLIEGLQKFREGYFSSHRDLFEQLSHGQHPRILFICCSDSRVDPNLITQSEVGDLFVIRNAGNIIPPYGAANGGEGAAMEYALVALEINQIIVCGHSHCGAMKGLLKLNSLQEKLPLVYDWLKHTEATRRLVLDNYSHLEGEDLIEVAVAENILTQLKNLQTYPAIHSRLHRGDLSLHGWIYRIEEGEVLAYDGVLHDFVAPQSRINALEPEDEYAPHPNSPLISYDAFKVPGKERPGREKATESPAPQLSPLPGFGHLPREQAERIYRGSR

SEQ ID NO: 9480 - protein, 199 aa, Neisseria meningitidis Z2491
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 9481 - protein, 478 aa, Nicotiana tabacum
MSSFLVSSNNLPEREIPGDYGFPIISAIKDRYDYFYKQGEDVWFHSKAEKYNSTVVKINMAPGPFTSNDYKLVAFLDANSFVYMFDNSLIDKTDTLGGTFKPGKEYYGGYRPVAFVDTSDPNHAALKNYILTSFAKRHNLFIPLFRNSVSDHLFQNLEKQVSDQGKSDFNALLPNMTFGFIFRLLCDQTNPSDTVLGAQGPEHLRKWLFPQLIPSLSARKLPSFIEDLLFHNFLIPFGLVKSDYNKLVDAFSKNAGSMLDEAEKLGIKREEAVHNILFLVGINMFAGLNAFFPHLIRFVGEAGPTLHARLAKEIRTAIKEEGGAVTLSAINKMSLVESIVYETLRLRPPVPLQYGKAKKDFMVQSHDASYMIKKGQFLVGYQPMASRDPKIFDKPDDFIPDRFMGEGVKMLKHVLWSNGRETENPAPDNKQCAGKDLVHLLGRLMLVEFFLRYDTFTVEITPLFRAPNVAIKTLTKAT

SEQ ID NO: 9482 - protein, 613 aa, Oryza sativa (indica cultivar-group)
MILCRRPFLAIARSRARSLSTAAVAAAVRHGDLAGAEEAFVSTPRKTTATYNCLLAGYARAPGRLADARHLFDRIPTPDVVSYNTLLLCHFASGDADGARRLFASMPVRDVASWNTMVSGLSKSGAVEEAKVVFLAMPVRNSVSWNAMVSGFACSGDMSTAEEWFRNAPEKEDAVLWTAMVSGYMDIGNVVKAIKYFEAMPVRNLVSWNAVVAGYVKNSHADDALRLFRTMVREANVQPNASTLSSVLLGCSNLSALGFGKQIHQWCMKLLLSRNLTVGTSLVSMYCKCGDLSSACILFGEMHTRDVVAWNAMISGYAQHGDGKEAINLFERMKDEGVEPNWITFVVVLTACIHTGLCDFGIQCFEGMQELYGIEPRVDHYSCMVDLLCRAGKLERAVDFIRSMPFEPHPSAYGTLLAACRVYKNLEFAELAAGKLIEKDPQSAGAYVQLANIYAVANQWDDVSRVRRWMKDNTVVKTPGYSWIEIKGVLHEFRSNDRLHPQLYLIHEKLGQLAERMKEMGYVPDLDFVLHDVDETMKVQMLMRHSEKLAIAFGLISTAHGMTLRIFKNLRVCGDCHNAAKVISMIEDREIILRDTTRFHHFRGGHCSCDDYW

SEQ ID NO: 9483 - protein, 489 aa, Mycobacterium avium 104
MALLADGVSELFIDGKMSAGNAGTFPTVNPATEEVLGVAANADAADMDRAIDAARRAFDETDWSRNTELRVRCVRQLRDAMREHIEELRDITIAEVGAPRMLTSAAQLEGPVGDLSFAADTAESYEWNQDLGQASPMGIPTRRTIAREAVGVVGAITPWNFPHQINLAKLGPALAAGNTVVLKPAPDTPWCAAVLGQLIAEHTDFPPGVVNIITSDDHGVGALLSKDPRVDMVSFTGSTVTGRSVMSDAAATIKRVFLELGGKSAFVVLDDADLGGACSMSAFTAAMHAGQGCAITTRLLVPRDRYDEAVAAAAGTMGSIKPGDPNDPGTVCGPVISARQRDRVQGYLDLAIAEGGTFACGGGRPADKDVGFFIEPTVIAGLTNDARPAREEIFGPVLTVIAYDGEEDALRIANDSPYGLSGTVFSADPERAANFASRMRVGTVNVNGGVWYSADAPFGGYKQSGNGREMGLAGFEEYLEIKTIATAVQ

SEQ ID NO: 9484 - protein, 300 aa, Mycobacterium avium 104
MSTVGFDAPARLGTVLTAMVTPFAADGSLDTAAAARLANHLVDSGCDGLVVSGTTGESPTTTDDEKRELLRVVLEAVGDRARVIAGAGTYDTAHSVRLAKACAAEGAHGLLVVTPYYSKPPQRGLIAHFTAVADATELPVLLYDIPGRSVVPIESSTIRALASHPNIVGVKDAKADLHAGGQIIAETGLAYYSGDDALNLPWLAMGATGFISVISHVAANQLRELLSAFTSGDIATARKINATVAPLCDAMARLGGVTMSKAGLRLQGIDVGDPRLPQVPATPEQIEALTADMRAASVLR

SEQ ID NO: 9485 - protein, 614 aa, Marchantia polymorpha
SSCFFHSSSSSLRILRSRADQPLRRALSIPHHRIEAMASGQHAPISESAAWADLKQHVKTIEGTHLRNLMQDNNRCEELIKEYDGIVVDLSRQRVIHDTVDKLLNLAEEAKLKEKIDQMFDGVHINETENRSVLHAALRAPRDEVINCDGQNVVPAVWDVLDKIDAFSDQIRSGSWLGSTGKPLTDVVAIGIGGSFLGPLFVHTAMQTEPGCAQAAKGRRLRFLANVDPIDVARALLDLNQETTLVVIVSKTFTTAETMLNARTVRTWITSALGVEAVSKHMVAVSTNLKLVKEFGIDPANAFGFWDWVGGRYSVCSAVGVLPLALQYGFSHVKKFLQGAWSIDDHFRSAPLESNLPVLLGLMSVWNVSFLGCPARAILPYCQALAKLAPHIQQVSMESNGKGVSLDGVPLPFGTGEIDFGEPGTNGQHSFYQLIHQGRVIPCDFIGIIKSQQSVYLKGEQVSNHDELMCNFFAQADALAYGKTREELVAEKVPEALIPHKMFSGNRQSLSILLPNLTPYTVGQLLALYEHRVAVQGWIWGINSFDQWGVELGKSLAGKVRTQMNAARTKTQPLSGFNYSTTTLLTRYLQGKTQLLYPDPHDVFPSNVLPGFEK

SEQ ID NO: 9486 - protein, 660 aa, Haemophilus somnus 129PT
MSKISLGKPYPLGCTECCMEGIAGFNFAIYSSQASAVELCIFNKNSVQETRYSMYCTENIWHIWVAELEYGTEYGFRIHGVDGSLSNPNKLMLDPYAKAVVGKPDLSCVENRAWFLLEDERDNAHLAPKALIESSSFDWEGDILPQTPWSESIIYELHVKGFTQLREDIPQAIRGTYAGLAHQNVIAYLKELGVSAVELLPINYHLDEPHLQKKRLQNYWGYSPLAMFAVESKYWSNQADTTPLTEFKSMVKALHKAGIEVILDVVFNHSVESEKHFPTFSQRGIDDRTYYWQDEAGNYINLTGCGNTLNLSTELGRKWIIDCLCYWVEECHVDGFRFDLASVLGRETPDFNANALLFKEIEQVSILQKVKFIAEPWDIGMGGYQVGNFPSYFAEWNDRFRDDMCRFWLWKSGELGVFAERFAGSSDIYRCLGKLPHNSVNFITAHDGFTLHDLVSYNQKHNWANGEDNRDGRSENYSYNHGMEGYKEGNSLVEEARYLSRSALLLSLLLSNGTPMLLAGDEFGNTQYGNNNAYCQDNETTWLKWQYFEQDLFNLVKQVIALRKQIPSLQRDNWWQESDVSWLNIDAEKMSLDEWHNKGSKALQILLDSKYLFVINAKTSSQKFLLPQGNWEILCYSKVVHLENKQLEMTDLAFGVLQKK

SEQ ID NO: 9487 - protein, 152 aa, Prochlorococcus marinus str. MIT 9301
MTKERTFIAIKPDGVQRGYVSEIIGRFEKKGFKLVGLKQLIPSKELAQNHYGVHRERPFFGDLVDFISSGPVVAMVWEGEGVILSARKLIGSTKPLEAEPGTIRGDLAIDIGRNIIHGSDGEDTAKFEIDLWFNEEELCEWETSDLKWRSEN

SEQ ID NO: 9488 - protein, 674 aa, Arabidopsis thaliana
MNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSMAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 9489 - protein, 144 aa, Glycine max
MYFICFLSACCTRDPAFLYKKKAGSCRTMATLDSDVPMVPAGEPSSSAGPSSKKPKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 9490 - protein, 1126 aa, Physcomitrella patens
MSTTKLAYSSGSSVKSKHSVRVAQTTADAKLQAVYEESGDSGDSFDYSKSVHASKSTGENVPALAVTAYLQRMQRGGLVQTFGCMLCVDESSFRVIAYSENAPEMLDLMPQAVPSVGQQEVLGIGTDARTLFTPSSAAALEKCAGAVDVTMLNPISVHCRSSGKPFYAILHRIDVGLVIDFEPVRPNDAVVSSAGALQSHKLAAKAISRLQALPGGDIGLLCDTVVEEVRQLSGYDRVMAYKFHEDEHGEVLAEIRRSDLEPYLGLHYPATDIPQASRFLFMKNRVRMIGDCYAPPVKVVQDKDLRQPISLAGSTLRAPHGCHAQYMGNMNSIASLVMAVIVNDPDEDPNSRGGQQRGRKLWGLVVCHHTSPRTVSFPLRSACEFLMLVFGLQLNMEVELAAQLREKHILRTQTLLCDMLLRDAPIGIVSQSPNIMDLVKCDGAALYYGKRFWLLGITPNEVQIKEIADWFLEHHQDSTGLSTDSLADAGYPGAAQLGDAVCGMAAAKITPRDFLFWFRSHTAKEIKWGGAKHDPDEKDDGRKMHPRSSFKAFLEVVKRRSLPWEDIEMDAIHSLQLISRGSFQDIDDSDTKTMIHARLNDLKLQGMDELSTVANEMVRLIETATAPILAVDSSGFINGWNAKVAELTGLPVGEAMGRSLVKDLILEESIDVVQRLLYLALQGEEEQNIEIQLKTFGPQKEKGAVILIVNACSSRDVQDNVVGVCFVGQDVTGQKQVLDKFTRIQGDYKAIVQNPNPLIPPIFGTDEYGYCSEWNPSMEKLTGWKREEVLGKLLVGEIFGMQLMCCRLKGQDAMTKFMIALNSAMDGQDTDRFPFSFFDRQGKYVDALLTVNKRTDAEGSITGVFCFLHTTSVELLQALTVQRATEKVAFAKLKELAYIRQEIKNPLYGIMFTRNLMEDTDLSEDQRQFVETSAVCERQLRKVLDDMDLESIEDGYLELDTNEFVMGTVMDAVVSQGMITSREKGLQLIRETPREIKNMCLFGDQVRLQQVLADFLLNAVKFTPSSGGWVGIKVVPTKKRLGGGIHVMHLEFRVTHSGMGLPEELVHEMFDRGRGMTQEGLGLSMCRKLVKLMNGNVQYIRETGKSYFLVEVELPLAQRDDAGSVR

SEQ ID NO: 9491 - protein, 1123 aa, Physcomitrella patens
MSTPKKTYSSTSSAKSKAHSVRVAQTTADAALQAVFEKSGDSGDSFDYSKSVSKSTAESLPSGAVTAYLQRMQRGGLTQSFGCMIAVEGTGFRVIAYSENAPEILDLVPQAVPSVGEMDTLRIGTDVRTLFTASSVASLEKAAEAQEMSLLNPITVNCRRSGKQLYAIAHRIDIGIVIDFEAVKTDDHLVSAAGALQSHKLAAKAITRLQALPGGNIGLLCDTVVEEVRELTGYDRVMAYRFHEDEHGEVVAEIRRADLEPYLGLHYPGTDIPQASRFLFMKNKVRIIADCSAPPVKVIQDPTLRQPVSLAGSTLRSPHGCHAQYMGNMGSIASLVMAVIINDNEEDSHGSVQRGRKLWGLVVCHHTSPRTVPFPLRSACGFLMQVFGLQLNMEVELAAQLREKHILRTQTLLCDMLLRDAPIGIVSQIPNIMDLVKCDGAALYYGKRFWLLGTTPTESQIKDIAEWLLEYHKDSTGLSTDSLADANYPAAHLLGDAVCGMAAAKITAKDFLFWFRSHTAKEIKWGGAKHDPGEKDDGRKMHPRSSFKAFLEVVKRRSLPWEDVEMDAIHSLQLILRGSFQDIDDSDTKTMIHARLNDLKLHDMDELSVVANEMVRLIETATAPILAVDSNGMINGWNAKIAQVTGLPVSEAHGRSLVKDLVTDESVAVVERLLYLALRGEEEQNVEIKLKTFGTQTEKGVVILIVDACSSIHVSENVVGVCFVGQDVTGQKMFMDKFTRIQGDYKTIVQNPHPLIPPIFGADEFGYCFEWNPAMEGLTGWKKDEVVGKLLVGEIFGMQMMCCRMKSQDAMTKFMIALNTAMDGQSTDKFTFSFFDREGKYVDVLLSTNKRTNADGVITGVFCFLQIASSELQQALKVQRATEKVAVAKLKELAYIRQEIKNPLCGITFTRQLLEDTDLSDDQQQFLDTSAVCEQQLQKVLNDMDLESIEDGYLELDTAEFEMGTVMNAVISQGMTTSREKGLQIFRETPREINTMRLLGDQIRLQQVLSDFLLNTVRFTPSPEGWVKIKVVPTRKRLGGSVHVVHLEFRVSHPGAGLPEELVLEMYDRGKGMTQEGLGLNMCRKLVRLMNGDVHYVREAMQCYFVVNVELPMAQRDDASSQM

SEQ ID NO: 9492 - protein, 1130 aa, Physcomitrella patens
MSTPKLAYSSGSSVKSKHSVRVAQTTADAKLQAVYEESGDSGDSFDYSKSVHASKSTGENVSAQAVTAYLQRMQRGGLMQTFGCMLCVEESNFRVIAFSENAPEMLDLMPQAVPSVGQQEVLGIGTDARTLFTPSSAAALEKCAGTVDVTMLNPISVHCRSSGKPFYAILHRIDVGLVIDFEPVRSNDAIVSSAGVLQSHKLAAKAISRLQALPGGDIGLLCDIVVQEVRELSGYDRVMAYKFHEDEHGEVLAEIRRSDLEPYLGLHYPATDIPQASRFLFMKNKVRMIGDCFASPVKVIQDKDLRQPISLAGSTLRAPHGCHAQYMGNMNSIASLVMAVIVNDPDEDPNARGGQQRGRKLWGLVVCHHTSPRTVSFPLRSACEFLMQVFGLQLNMEVELAAQLREKHILRTQTLLCDMLLRDAPIGIVSQSPNIMDLVKCDGAALHYGKRFWLLGITPNDAQIKEIADWLLEHHQDSTGLSTDSLADAGYPGAAQLGDAVCGMAAAKITSKDFLFWFRSHTAKEIKWGGAKHDPDEKDDGRKMHPRSSFKAFLVVVKRRSLPWEDIEMDAIHSLQLILRGSFQDIDDSDTKTMIHARLNDLKLQDMDELSTVANEMVRLIETATAPILAVDSGGFINGWNAKVAELTGLPVEEAMGRSLVKDLILNESIDVVQRLLHLALQGDEEQNIEIQLKTFGPQKEKGAVILIVNACSSRDVQDNVVGVCFVGQDVTGQKQVLDKFTRIQGDYKAIVQNPNPLIPPIFGTDEYGYCSEWNPSMEKLTGWKREEVIGKLLVGEIFGIQLMCCRLKSQDAMTKFMIVLNGAMDGQDTDRFPFSFFDRQGKYVDPLLTVNKRTDAEGSITGVFCFLHTTSVELLQALTVQRSTEKVAFAKLKELAYIRQEIKNPLYGIVFTRNLMEDTDLSVDQRQLVETSAVCERQLRKILDDLDLESIEDGYLELDTTEFEMGTVMDAVVSQGMITSREKGLQLIRETPSEIKNMCLYGDQVRLQQVLADFLLNAVRFTPSSEGWVGIKVVPTKKRLGRGVHVMHVEFRVTHPGLGLPEELVHEMFGRGRGMTQEGLGLSMCRKLVKLMNGTVQYIRETGKSCFLVEVELPLAQRDDAGSVRSTVV

SEQ ID NO: 9493 - protein, 1122 aa, Physcomitrella patens
MSAPKKTYSSTSSAKSKAHSVRVAQTTADAALHAVFEKSGVSGDNFDYSKSVSKSTAGSLHTGAVTAYLQRMQRGGLTQSFGCMVAVEETGFRVIAYSENAPEFLDLMPQAVPNIGEINTLGIGTDVRTLFTPSSAASLEKAAETQEISLLNPITVYCRSKKPLYAIAHRIDIGIVIDFEAVNMNDVTISADGALQSHKLAAKAITRLQALPGGDIGLLCDTVVEEVRELTGYDRVMAYKFHEDEHGEVVAEIRRTDLEPYLGLHYPATDIPQASRFLFMKNRVRMIGDCSAPPEKIVQDPNLRQPVSLAGSTLRSPHGCHAQYMGNMGSISSIVMAVIINDNEDDSRGSVQRGRKQWGLVVCHHTSPRTVPFPLRSACEFLMQVFGLQLNMEVELAAQLREKHILRTQTLLCDMLLRDAPTGIVSQVPNIMDLVKCDGAALYYGKRFWLLGTTPTESQIKDIAEWLLEYHKDSTGLSTDSLADANYPAAHLLGDAVCGMAAAKITSKDFLFWFRSHTAKEIKWGGAKHDPGEKDDNRKMHPRSPFKAFLEVVKRRSLPWEDVEMDAIHSLQLILRGSFQDIDDSDTKTMIHARLNDLKLHDMDELSIVANEMVRLIETATAPILAVDSNGMINGWNAKIAQETGLPVAEAMGRSLVKDLVMDESLEVVERLLYLALRGEEEQGVEIKLKTFGAQTVKGAVTLIVNACASRDVSENVVGVCFVGQDVTGQKMFMDKFTRIQGDYKTIVQNPHPLIPPIFGADEFGYCFEWNPAMEGLTGWKRDEVIGKLLVGEIFGMQKMCCQMKSQDAMTKFMISLNSAMDGQNTDKFSLSFFDREGRYVDALLSTNKRTNADGAITGVICFLQIASSELQQALRVQQATEKVAIAKLKELAYIRQEIKNPLCGITFTRQLLEDTDLSNDQKQFLDTSAVCEQQLQKVLNDLDLESIEDGYLELDTAEFEMRTVMDAVISQGMTISREKGLQIIRETPREIITMRLFGDQVRLQQVLSDFLLNAVRFTPSSEGWVKIKVVPTRKRLGGNEHVMHLEFRVSHPGAGLPEELVLEMFDKGKGMTQEGLGLNICRKLVRLMNGDVQYVREAMQCYFVLYVELPLAQQDDAASQM

SEQ ID NO: 9494 - protein, 299 aa, Bacillus clausii KSM-K16
MNHVSGIYAALLTPFHEDQSIHKEALQQLVARMIDNGVHGLFALGTNGEFHTLTPQEKCEVATIVLKEAKGKVPVMLGVGGNYTGEVIQLAKQFEQLGATMFSVITPFFMPPNQSELANYFEDIANATKVPIFLYNIPSKTGVSIDPLTVARLAKHPNIYGIKDSSGDLQLIQSYIRHTQEEDFVVFAGTDSLILKTLQEGGGGAVAATANALPKLVSSIFTHFKNGQLEEAEKAQAQLQPLRDTFSLSTIPASLKKVVELSGIPVGPPRRPVQPVDSKALRQIETMMRTYRAEGVLDE

SEQ ID NO: 9495 - protein, 209 aa, Oryza sativa
  misc_feature (125)..(126): Xaa can be any naturally occurring amino acid
  misc_feature (146)..(146): Xaa can be any naturally occurring amino acid
MMMETELCSSRVLSLPRYDSGDEELSVLPRHTKVIVTGNNRTKSVLVGLQGVVKKAVGLGGWHWLVLKNGVEVKLQRNALSVLEPPTGNEDDYDIDGNNSFCSSSDMGDKDMDYLAIIEYHKPTXXDVLHTSHWSSCIKSSNRGNXFHPSTKLRTRVNLTKLGTPTLWRYWKHFNLVSMNPYPSKEQLFHGVILGFIQAAKRLKTLYRS

SEQ ID NO: 9496 - protein, 284 aa, Symbiobacterium thermophilum IAM 14863
MNRGDWLIEEQTPSYQTRWRVREVLHEEQTPYQKLQVLELEDFGRALVLDDAVQTTVGDEFIYHEMIAHVPLFTHPHPERVLIIGGGDGGTAREVCRHESVQKVDMVEIDRAVIEACRKHLPEIACGMDHPKVNLVVGDGIAWVADHADEYDVIIVDSSDPVGPAKGLFNQAFYKNVFRALKADGLFVCQVLSPFFHQSLIRDVYGVVSAIFPITMPYLAVVPTYPSGLHCFMLGSKRHSPLREGVRTPAWPTRWYTPAVHRAAFQLPPVVAQLLEPSGSQAGQ

SEQ ID NO: 9497 - protein, 370 aa, Thermobifida fusca YX
MAERRPVADRLPTFPWDRLAPYKETAAQHPDGIVDLSVGTPVDPVPPRLRAALAEAADTPGYPQTYGTRALRESISGWLARRHQVQVDPDATLPTIGSKELVAWLPTLLGLGPGDTVVFPELAYPTYDVGARIAGATPVAADSLTQLGPVRPGLLWINSPANPTGRVLGLEHLRKVVSWARERGVVVASDECYLELGWEGERPLSILHPEVCGGSHEGLLAVHSLSKRSNLAGYRAGFVAGDPALVQQLLQARKHAGMMVPAPVQAAMRAALDDDEHAEEQKQRYAARRTQLRDALEKAGWQITHSEAGLYLWASHPDYDAWGSVRVLAEQGILVAPGEFYGPAGARHVRVAFTATDERVAAAVKRLAEL

SEQ ID NO: 9498 - protein, 360 aa, Glycine max
MLGVIRHKSIRPAFSAIRHFSSAAKEITVRDALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 9499 - protein, 166 aa, Glycine max
ESLTCRFGIGQPPPTDFVSFGVMLIDFVPTESRVSLAEAPGFLKAPGGAPAIVAITVSCLGGRSAFIVKLGDDEFGHMLAGILRKNGVADQGINFDTGARTALAFVTLKADGDREFMFYRNHSADMLLRPDELNLDLIRSVRKSPLSIPHDLQEIQMEVEIHSLVF

SEQ ID NO: 9500 - protein, 363 aa, Shigella flexneri
MSKNYHIAVLPGDGIGPEVMTQALKVLNAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDIQCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 9501 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEIAFAEVLTQIYNIVSKKAMETSDDGAASAVPSKGEKIDVGKDVSAMKKGGCCSS

SEQ ID NO: 9502 - protein, 192 aa, Triticum aestivum
SVNMEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYL

SEQ ID NO: 9503 - protein, 326 aa, Oryza sativa (japonica cultivar-group)
MAATNNVGAGALPVVDLAPFLATGDDEGGVARASASATGAVREACRDYGFFRAVNHGVPAELMARALELSAAFFALPDEEKAKARPVEGSEAPLPAGYARQPAHSADKNEYLLAFDPQLGFNLYPDEPSGFREALYELYGKLTELGVLIQEILNKCMGLPPGFLKEYNGDRSFDFIAALRYSPATAEENNGVSEHEDGNCITFVLQDGVGGLEVLKDGAWVPVDPVEGSIIVNIGDVIQVLTNGKMKSATHRVVRKPAVHRHSLVFFFNVHGDRWVEPLPEYTEKIGEAPRYRRFLYSEYQQLRMRNKTHPPSRPEDVVHITHYAI

SEQ ID NO: 9504 - protein, 510 aa, Arabidopsis thaliana
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKLKKEAMASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 9505 - protein, 618 aa, Gossypium hirsutum
MEQHIMWVFWFFLHWFCSVHSASDGDSLLSPKGVNYEVAALMSVKRELRDDKQVMDGWDINSVDPCTWNMVACSAEGFVISLEMASTGLSGMLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVHWYRSRIMLPSYVQQDYDFEIGHLKRFSYRELQIATGNFNPKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTDEPQGGTNHCETSAYSFSRNYSDVHEESSFIIEAMELSGPR

SEQ ID NO: 9506 - protein, 185 aa, Oryza sativa
  misc_feature (132)..(132): Xaa can be any naturally occurring amino acid
MHLSAGFLSCRERKGDFSCLTAARICEASTSDAVVQAAGTAMPVPLAPYPTPPVPFTPPNGAQSQLVCSGCRNLLMYPAGATSVCCAVCSTVTAVPAPGTEMAQLVCGGCHTLLMYIRGATSVQCSCCHTVXNLAMEANQVAHVNCGNCRMLLMYQYGARSVKCAVCNFVTSVGASPGTDQKPSS

SEQ ID NO: 9507 - protein, 432 aa, Tropheryma whipplei str. Twist
MSKIKLVTAIPGPESERLHRMRQATVARGVSSTFPIYIKESHGSILIDEDGNHLIDMGCGIGVTTLGHSHPAVVDAARAQINSVWHTLFSITPYESYVEVCKLLAKNTPGDFPKKSLLLNSGAEAVENAVKISRAYTGRPTVAVLDRSFHGRTNLTSSMTYRGSLYSSDFGPTASNIVSAPNSYPLHDRLSGKEAAARTISYLETRVAARNIACLFYEPIQGEGGVIVPADGFLPALQDWCRENDIVFVADEIQSGFGRTGCFFASETDGLEPDIVCSAKGIANGLPLSAVTGRSDIVDAARPGTLGGTFTGNHVSCAAALEVFEQYKDNAPLDSASRLGDILKELLLNLQSKHPQIAEVRGRGAMFGAEFSGNHAGEMVSRVITRAAELGVIFLSSGVEGNVVRFLPNVFMDKETIEEAIGVLDSAISSVV

SEQ ID NO: 9508 - protein, 1126 aa, Ceratodon purpureus
  misc_feature (344)..(344): Xaa can be any naturally occurring amino acid
MASAKMAYSSGSGIKSKHSVRVAQTTSDAKLQAVYEESNDSGDSFDYSKSVAQAAKSTGQQQVPAQAVTAYLQRMQRGGLTQTFGCMLAVEENTFRVIAYSENAPELLDVMPQAVPSLGQQDVLGIGTDARSLFTPSSATALERAAGAADLSLVNPISVHSRASGKPFYAIIHRIDVGIVMGFEPVRPNDVIVSTAGTLHSHKLAAKAIARLQALSGGDIGLLCDTVVEEVRELTGYDRVMAYKFHEDEHGEVLAEIRRSDLEPYLGLHYPSTDIPQASRFLFMKNRVRMIVDCWAPPVKVIQDKDLRQPISLAGSTLRAPHGCHAQYMGNMGSVASVTMAVIXNDQEDDFGGQQTRARRLWGLVVCHHTSARTISFPLRSACEFLMQVFGLQLNMEVELENQKREKHILRTQTMLCDMLLRDAPVGIVSQCPNIMDLVKCDGAALYYGKRFWLLGITPSEEQIEEIANWLLEHHQDSTGLSTDSLADAGYPGANLLGDAVCGMAAARITPTDFLFWFRSHTAKEIKRGGAKHEADDKDDGRKMTPRSSFNAFLEVMKRRSVPWEDIEMDAIHSLQLILRGSFQDIDDSDTKTMIHARLNDLKLQGMDELSTVANEMVRLIETATAPILAVDSNGFINGWNAKVAELTGLPVGDAMGRSLVQDLIVDESVEVVERLLYLALQGDEEQDVEIQLRTFGPQKGKGAVILIVNACSSRDVQDNVVGVCFVGQDVTSQKQVHDKFTRIHGDYKSIVQNPNPLIPPIFGSDELGYCTEWSPSMEKLTGWKRDEVLGKMLVGEVFGTQQICCRLKGQDSVTKFMIVLNNAMDGQDTDKYPFSFYDRQGKFVEALLTANKRTDADGYITGVFCFLHIASPELLQALTVQRATEKVAFAKLKELAYIRQEIKNPLYGIMFTRNLMEDTDLSDEQKQFMDTSAVCERQLRKILDDMDLESIEDGYLELETAESELGSMMDAVVSQGMITSREKGLQLIRETPREINDMSLFGDQVRLQHVLADFLLNAVRLTPSSEGWVGIKVVPTKKRLGGGFHVVHLEFRVAHPGSGLPEELVHEMFDRGRGMTQEGLGLSMCRKLVKLMNGEVKYIRDTGKSYFLVNLELPLTVRDESGMLR

SEQ ID NO: 9509 - protein, 524 aa, Gossypium hirsutum
MAEPKPEEISHPPMDQLQGLEYCIDSNPSWGEAIALGFQHYILALGTAVMIPSFLVPLMGGTDDDKVRVVQTLLFVEGINTLLQTLFGTRLPTVIGGSYAFMVPIISIIHDTTLLNIEDNHMRFLYTMRAVQGALIVASSIQIILGYSQMWAICTRFFSPLGMIPVIALVGFGLFDKGFPVVGRCVEIGIPMLILFIAFSQYLKNFHTKQLPILERFALIISITVIWAYAHLLTASGAYKHRPELTQLNCRTDKANLISSAPWIKIPYPLQWGAPTFDAGHAFGMMAAVLVSLIESTGSYKAAARLASATPPPAHILSRGIGWQGIGILLDGLFGTLTGSTVSVENVGLLGSTRVGSRRVIQISAGFMIFFSILGKFGALFASIPFTIFAAVYCVLFGIVASVGLSFMQFTNMNSMRNLFIIGVALFLGLSVPEYYREYTAKALHGPAHTRAVWFNDFLNTIFFSSPTVALIVAVLLDNTLDYKDSARDRGMPWWANFRTFKGDSRSEEFYSLPFNLNRFFPPS

SEQ ID NO: 9510 - protein, 525 aa, Pisum sativum
MEYGTRKLSDVYEVSEILGRGGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQARDRSGCITKEEVASMLRALPYDCLPTDITEPGKLDEIFDLMDANSDGKVTFDEFKAAMQRDSSLQDVVLS

SEQ ID NO: 9511 - protein, 520 aa, Pisum sativum
MGYGTRKLSDVYEVSEILGRGGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQARDRSGCITKEEVASMLRALPYDCLPTDITEPGKLDEIFDLMDANSDGKVTFDEFKAAMQRDSSLQ

SEQ ID NO: 9512 - protein, 320 aa, Leuconostoc mesenteroides subsp. mesenteroides ATCC 8293
MSEILTLGEPVVTFASTDLNKGLVDSINYYKFLGGAELNVMIGATRLGHNTEYISQVGADPLGQFTIKEIARYNVGNHYIATDEGNWTAFQLKELVDQGDPSTFNFRRNSAAAHFDKSLIDQVDFSDVKIAHLSGIFPAISLQAREAFRYFAEQLIDHGIRTTFDPNLRPALWESREVMIETINDLAKYGEIVLPGIDEGEILIGSRDPETIADFYLNNSDRTQTVVVKIGSDGAYVKNKSGESYIVNGFKVEKVVDTVGAGDGFALGLITGLIEGLTMADAVRRGNAVGALQVQTPGDNDGYPTQEELEAFLADNKKEA

SEQ ID NO: 9513 - protein, 951 aa, Aspergillus nidulans FGSC A4
MPRLLPVLLAAASLQVARVGATPPGIPSTSVAETQLEALTVKEAGASSDYDRDLFPHWISQGDSCNTRDRVLIRDGTNVETGSGCSITGSWTSPYDGETWTATSDVDIDHVVPLSNAWNSGASEWTTDEREAFANDLSIPQLLAVTDSVNQQKSDSGPEEWLPPLESYHCTYGKMWTNVKYTYGLSVTSAEKKYMAGIGIAIVRQPEAIPRWFANRYENRMIFKSTRPHIDIPTNLPIWPWLFDSEYSPLRQSNANNLGSFVNAITKESIRYDALADLTTHVSTALVKDYGLKPGDTVALFSPNTIWYPVAMLAVVRAGGVISGASPAYNIEEMSYALKTANAKYLMTVPSSMDVAIPAAQSAGIPAERIFLLEGMKEGVAEGLTGLVHQMHLPIIRNSTVYMLPSFTMKSMLDTIVEYRIEEILSVPPIIIRLLQDPIVSNYDLSHVKRFSSGAAPISGEILQKLHARFPWTGFKQGYGMTESCSCITAHPPEKQSYEYAQRGGMIVANTEVKIIHTETGKEVGPEEEGEILARGPQIVMGYLNNEKATRETFDEDGWLHTGDVGYMDREGFIVITDRIKEMIKVKGIAVSPAEIEDLLLGHPDVEDVGVTSVADDYAGERPKAYVVLKGDAKRRLGSEEGVQAVGKQLIEYVKAKKVRHKWIVEVEFLEEVPKSASGKILRRVLRDRERSKDKGKNKAEKRLVVRDEKFSLLGFDDITTYGTGGLTYASMEHHPYAETTEFYGWLDQSSLHPDTNATKNMNLKSLSNYAFIESSLDNDNFVQSWDLSGYDAIELVLGKSDGKTYTLALKDDRFFLSWEAQFRCINEKGLMTATRKVLRFRDLVPQRRRTSTFMSAHPRELDLQKTLYSSGSSGRSGSLQEGPFSLSIYAVNAVKLDCSCPCPLVHDTVPGKGQGLEFEMSRLKNRVAAFISYLAMKMTKPNPKRKLKQK

SEQ ID NO: 9514 - protein, 372 aa, Arabidopsis thaliana
MAANLARRLIGNRSTQILGAVNSSSGAASSVARAFCSSTTPITATLFPGDGIGPEIAESVKKVFTTAGVPIEWEEHYVGTEIDPRTQSFLTWESLESVRRNKVGLKGPMATPIGKGHRSLNLTLRKELNLYANVRPCYSLPGYKTRYDDVDLITIRENTEGEYSGLEHQVVRGVVESLKIITRQASLRVAEYAFLYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKFNEQAEQIHSAIINTIAEGKYRTADLGGSSTTTEFTKAICDHL

SEQ ID NO: 9515 - protein, 531 aa, Zea mays
KNERAAGSDPEAAAAPGSGNLHGPEPPATGSTTICARARARGTGRRTEAPLSSERVRPAWRRRWRGRGAAALARWRGMCSSSASAPRRAAALSSEELMRMEQDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKHIPKNEALLVSCCGCFHGRTLGVISMSCDNDATRGFGPLVPGHLKVDFGDIDGLKKIFEELGDRICGFLFEPIQGEAGVVIPPDGYLKGVRDLCSKHNVLMIADEIQTGIARTGKMLACDWENIRPDMVILGKALGAGVVPVSAVLADRDVMLCIRPGEHGSTFGGNPLASAVAVASLKVVRDEGLVERAAKLGQEFRDQLQKVQQKFPQILREVRGRGLLNAVDLNNDALSPASAYDICIKLKERGILAKPTHDTIIRLAPPLTISPEELAEASKALSDVLEHDLPQLQLQKQIKKPESEAEKPVCDRCGRDLYG

SEQ ID NO: 9516 - protein, 326 aa, Zea mays
ASLSESEASDHSTAQHSDADVETDSRGSSIEEQEAGYGAHIPQPDPAVCKVSKENNTAGVKISDRMTSVSESTLVLASGASMLPHPAKVRTGGEDAYFIACDGWFGVADGVGQWSFEGINAGLYARELMDGCKKIVEETQGAPGMRTEEVLAKAADEARSPGSSTVLVAHFDGKVLHASNIGDSGFLVIRNGGVHKKSNPMTYGFNFPLQIEKGDDPLKLVQPVINSQKYAICLQEGDVVVTASDGLFDNVYEEEVAGIVSKSLEADLKPTEIADLLVARAKEVGRCGFGRSPFSDSALAAGYLGYSGGKLDDVTVVVSIVRKSEV

SEQ ID NO: 9517 - protein, 115 aa, Clostridium tetani
MLDVIKAIEAEQIRTDLPAFKVGDTVKVHVKIKEGTRERIQVFEGTVIKRQNGGLRETFTVRRLAYGVGVERTFPVNAPTVSKIEIVRKGKVRRAKLFYLRDRVGKAAKVKERRY

SEQ ID NO: 9518 - protein, 318 aa, Betula pendula
MATFPVIDMEKLNGEERGATMELIEDACENWGFFELVNHGISHDLLDTVEKLNKEHYRKCMEERFKDMVASKGLEAAQSEVRDMDWESTFFLRHLPASNMSEIPDLDEDYRKAMKEFAGNLEKLAEQLLDLLCENLGLEKGYLKKSFYGSKGPNFGTKVSNYPPCPKPELIQGLRAHTDAGGLILLFQDDKVSGLQLLKDGKWVDVPPMRHSIVINLGDQLEVITNGKYKSVLHRVLAQPDGNRMSLASFYNPGSDALIYPAPVLVEKEAEKGQVYPKFVFEDYMKLYAGLKFQAKEPRFEAMKAMESTVKLGPIATA

SEQ ID NO: 9519 - protein, 705 aa, Coprinopsis cinerea okayama7#130
MDPEEDEELEQLRRYEDFTTIDWIQDAKRERAQRLQSARDVNTPRRGPRGEMTIPWFWAKVRKGADAVSSWFVVSLVGVCIGLNAAIISIMSEWFSDLKMGYCSDAWWLSQQFCCWEMEGEEVDGCDLWHTWSSITLIRWIVFVLFATLFAFVASHLVRSLAKYAAGSGISEIKCILAGFVMQGFLGSATFFIKSITLPLVIASGLSVGKEGPSVHVACCIGFLVAGFFRNFKRSESKMREVITAASAAGVAVAFGSPIGGVLFSIEEMSHTFSIKTMWRSFFCALIATFTLAAMNPFRTGKIVLFQVTYDRDWHFFEIIFFVILGIFGGLYGAFVVKFNLQVAAFRRKHLANHGVAEAVTLATITAMIGYFNRFLRLDMTSSMAILFRECEGGGNVFNLCQSEAQWRIANSLLLATIIRIGLVVITYGCKVPAGIFVPSMAIGATFGRMVGIMVKAMYNAYPTSGIFKVCDPDVPCITPGTYAFLGAAAALSGVMRITVTVVVIMFELTGALTYILPTMIVLLVTKAVGDFLGTNGIADEMIRFNGFPFLEKEDHAYNVAVSSVMKKELHTLTETGLSVKDVENLLSNTDVKGFPIVTADGALTLAGYIDRSELRYVIERARKTRGRITNIPCLFTTHSEYDGLEIGRPNFEEEEPNEQYFAPTTAGEVQFAPWVNKTPMTVSPDLPLETVMQIFKRMGLTGPP

SEQ ID NO: 9520 - protein, 396 aa, Marchantia polymorpha
MASMVAASSALGASCSLAAVPSQATTSSNNAAQAVILRSAKLGGRSSSILGQSLAGLSVKSVAHKAVASRSRVASTRAELGDSLEEFLFKNTKNINLRQLMLSMGLAIKKISFKVRTASCGATACVNTFGDEQLAVDMLANKVLFEALLHSHVCKYACSEEEPNLVDMGGPTEGGFSVAFDPLDGSSIVDTNFTVGTIFGVWPGDKLTGVTGREQVAAAMGIYGPRTTYVLCLAEVPGTHEFLLMDDGTWQHVKETTTIGEGKLFSPGNLRATYDNPEYEKLINYYVSEKYTLRYTGGMVPDVNQIIVKEKGIFTNVISPTTKAKLRLLFEVAPLGLLVEKAGGYSSDGKISVLDKVVVNTDDRTQVAYGSRNEIIWFEEALHGTSRVAALVGASA

SEQ ID NO: 9521 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEISFAEVLTQIYNVISKKAMETSDDGAASAVPSKGEKIDVGKDVSAMKKGGCCSS

SEQ ID NO: 9522 - protein, 245 aa, Debaryomyces hansenii CBS767
MSANDFYSSGDQGSYEPRRDQQQGQQGQQGQQGQQGQQGEDGDRGLISTLAGGSIGAFGGSKLGGNHSTLGGIGGAIAGAIGANKVEDRFENHGSSNNNHGHSQQGGGLMSGLSSFLGGDKHEGRNDGYGGSQGGYGGNQGGYGGSHSGRHDGGRHEGGRHEGGYGGGQGGFGSGNNGGNQGGYGGGQGGYSGGQGGYGGGQGGYGGGQGGYGGGQGGYGGGQGGYGGGQGGYGGGQGGNQGGRW

SEQ ID NO: 9523 - protein, 430 aa, Zea mays
  misc_feature (257)..(257): Xaa can be any naturally occurring amino acid
MTKKQRREAGAMRRRDRHHHHRRQPRDERCVSCTTFNILAPIYKRMDNENCRESQYRAYWFSRNEKIIDRLLADHSSIICLQEVWLGNDELVDMYQKRLGDANYMLFKLARTNNRGDGLLTAVHRNYFNVLNYRELLFNDIGDRVAQLLHVESAMPFLQNRSTSCVHQQSLIVNTHLLFPHDHSLSIVRLRQVYKILQYIEAYLEEHKLGPLPIILCGSDWNGSKRGQVYKFLRSQGFVSSYDTAHQYSDSEEDAHXRKPLKTSWNEAVFGIIKYFLQVAFLSEENAFALLKADSLYDHITYSSFYQALCQLGMVHPDRLKSEEIEELWSEADRDGDGVINYKEFQCIWSPNCCSQEEEDTEIDITDESLDTFEANNEAFGFTVKEAVLFPPEVEKGMWPENYSLSDHAPLTVVFSPIRMPCSPRNRGEL

SEQ ID NO: 9524 - protein, 205 aa, Parvularcula bermudensis HTCC2503
MPLDFPTSGRVAEHSRKTKETDIRVRMDLDGTGRSDVSTGIGFLDHMLEGFAKHSLIDLEVEAKGDLHIDMHHTTEDVGIVMGLAAAKALGDAGGIHRFGHAYVPMDETLTRAALDVSKRPYLIWKVAFSRDKIGEMDTELFKEWFHAFATNAGLCLHVENLYGTNNHHIAESCFKALAKAFDMAIRLDERRAGASPSTKGSLGS

SEQ ID NO: 9525 - protein, 271 aa, Triticum aestivum
  misc_feature (204)..(204): Xaa can be any naturally occurring amino acid
  misc_feature (215)..(215): Xaa can be any naturally occurring amino acid
  misc_feature (239)..(239): Xaa can be any naturally occurring amino acid
AYLGDTLEQVCTKKQAGTGPEFPGYRRPTRPHLPASPRPATVAARAASGVASTVPAATQTSQLEETFGRKGLRFGTDATGAPTAELSVRNGSSLQLRLNDGLVTSYRPKVSWEGGDGCRELLHTVAAAGAVKGGVGLVLNEASSSSSLLGASEWSVADVDSDSYDAVQVELGCGVGGAKLEVSYVVTLYPLSMATAVIVKNNGXKPVELTGAVLXHIKFRQRRGTAVEGPRGCPYCSHXAPGAGFALLPPPKAWNRRNPGGFRGAGREETR

SEQ ID NO: 9526 - protein, 663 aa, Vibrio parahaemolyticus RIMD 2210633
MTRLFSRPYPLGATLNKEGCNFSIHAPGVKDIQLALFASDGSYSLHDLPNEYAGIRHTFIPDIKPGQKYGYVVTRRDEPLLISDPYAKSLDKALHYHPPYTPAKSFDMPKCVVIEDTFDWQETDHPRIPREDMVLFETHVKGLTQLHPEVSATTKGRYLGLASPQMLAFYKQQNINTLQLLPIAACMHEPHLLEMGKVNYWGYNPYLFMVPDPRYAEKDAVTELKTTIRELHKHGIEVILDVVYNHTAEGGEGATVFNLKALDSRFYIKHGNHFANYTGCGNTVDLTYQPALNLVMDTLRYWVSEFKIDGFRFDLAATLGRQGDDYNPEAAFFKAVAQDPILRETKLIAEPWDIGPNGYQVGNFPFGWNECNDKLRDISRSFWRGDQGYLKEFATRLMGSRDIYSAANWPYKLTVNYITYHDGFTLQDLVSYKHKHNEANGEENRDGHGDNRSENYGVEGETENIMIIATREKQKRNLIASLLFAFGIPHILTADVLSHSQDGNNNAYCQDNKTSWINWSETERKAHFKTWMAQMVANRHQYMVPFIRAFSGENRNNNRIFWRRTDGRLMEHDDWNRLSSVALHLGIGKDGQELVYLINQTNATARFKLPNERNQEWVTICDTNVRNLNPGHAEGEVLLSPTSMVILHYQPKPNSPQGEQLQS

SEQ ID NO: 9527 - protein, 267 aa, Arabidopsis thaliana
MKKKGKVYPSPPPPPQSSSSSSSSNHLNEEDDDSLSVLKLLPATILVLVSVLSSEEREVLAYLITRGTTISDRGNSSSKNKTKKKSNKSSKNHKPPVFDCECFDCYTNYWFRWDSSPNRELIHEIIEAFENHHGEENSASRSKSKRGKKKEKPGRRVTDSDSKPALRVTDNGDKDSKPVVEPMNETTVSESSHVSSPVRLSEAEVAEGEPEDEIVVEEDGQEEESTVVVFPAAASNVTGHKGLARKVLPDVLGLFHSNFWRLWNPNA

SEQ ID NO: 9528 - protein, 452 aa, Frankia sp. EAN1pec
MDKQQEFVLRTLEERDIRFVRLWFTDVLGVLKSVEIAPAELEGALAEGIGFDGSAIEGFARVHEADMLARPDPSTFQVLPWRGEHPMTARMFCDLVMPDGTPAVADSRWVLRRTLARAADAGFTFYTHPEIEFFLLKHPPTRGGPMPPPVDESGYFDLTPNDISHDFRQQAIGVLERLGISVEFSHHEVAPGQQEIDLRYADALTIADNIMTFRQVVKEVALRQGIYATFMPKPFSDQAGSGMHTHMSLFEGDRNAFHDPTDEYQLSKVAKAFIAGLLVHSAEITAVTNQWVNSYKRLVGDQRAGELMEAPAYVCWGHNNRSALVRVPLYKLNKSNAARVEFRSPDSACNPYLTFALMLAAGLRGVQGGYDLPAPAADDVWTLTDAQRRERGITALPGSLAEAIATMETSSLVRETLGDELFDFFLRNKRSEWIEYRRQVTPFEIDRYLPTL

SEQ ID NO: 9529 - protein, 209 aa, Oryza sativa
  misc_feature (204)..(204): Xaa can be any naturally occurring amino acid
MAPNGEIDRFISTEQANATESHTFKNDRLHLYINGQWYDLTQWQKCHPGGQEILQNLNGKDATDIFYSLHSQNAIQRLERLKPTTTFHLSTIEPTKLTKSFRQLRTKLVQDGYFNRSISWELFYHCSVTFLCLLGMFCHFYLNSTLLAIITIGFAMQQAGWIGHDYAHGRGSWMYWLCRTLTGSVNAFSPTWWSHKHNTHHVYXNNIGI

SEQ ID NO: 9530 - protein, 81 aa, Glycine max
SNSYTRAVHQLSHRARGTAWLHPYTGLKSMAGLPTRKTNTDITSIASNGGRVQCMQVRPPAGSMKFETLSYLPDLDDAQLA

SEQ ID NO: 9531 - protein, 474 aa, Frankia sp. EAN1pec
MFTNADDVLRYIRDEGVQFIDVRFCDLPGVMQHFTIPTEVFSESVFSDGLMFDGSSIRGFQAIHESDMLLLPDPRTAFVDPFREHPTLAMTFFIHDPITKEQYSRDPRNIAKKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTVTFMPKPLFEDNGSGMHTHQSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGVKNKIDPPDPIDKDLYELPPDELAAVPQVPGSLEKVLDALEADNEFLREGNVFTPDLIETWIDYKRVNEVDAIRLRPHPYEFSLYYDI

SEQ ID NO: 9532 - protein, 398 aa, Oryza sativa
MEPSRRLLLSDYDGAIVSPLPSPPPSSATPFRPGVAVVVGILTSVFSITFLLLLYAKHCKRNAAESSGPYGSGGAFGSSGGGGAGERRNSGVDRAVVESLPVFRFGALRGQKAGLECAVCLGRFEPTEALRLLPKCRHGFHVECVDTWLDAHSTCPLCRSRVDPEDVLLLPEPPKPSTTGPPDPPETKVAAAAAAATAKDKEASLAPAAPAPSPAFRGFFSGRHSTGSVRAPGRVGPASRRSADLVGGDGGAVVGCFEAAKVRKDRVLLMEPAAAVAEPDPEAYDRRFGHRILVSTAGGCEDETAPAAKQRWSEVRPSDLMFVRSEMLVTEAGRYSCSAAVHSGNGRSVISARSLSELAGVSRLPPIRASGEPRAGARRWPGSSWWARGPPALNGPST

SEQ ID NO: 9533 - protein, 387 aa, Oryza sativa (japonica cultivar-group)
MTNKNLELQRLVGVQTNMLKNSGVTIIEGRGKVVDPHTVSVDGKLYTAKNILIAVGGRPSMPDIPGIEHVIDSDAALDLPSRPEKIAIVGGGYIALEFAGIFNGLKSGVHVFIRQKKVLRGFDEEVRDFVADQMSLRGITFHTEETPQAVMKSDDGLLTLTTNKGSINGFSHVMFATGRKPNTKNLGLEEVGVKMDKHGAIVVDEFSRTSVDSIWAVGDVTNRVNLTPVALMEGGALARTIFGNEPTKPDYSAVPSAVFSQPPIGQVGLTEEKAIEKYGDVDVYTSNFRPLRATLSGLPDRVYMKVIVCANTNKVLGVHVCGEDAPEIIQGIAIAVKAGLMKQNFDATIGVHPTTAEELVTMRSPTRKVRRDAVDEAKMKDEATSQK

SEQ ID NO: 9534 - protein, 552 aa, Synechococcus sp. CC9605
MRGHHARSWIRSARLQRPPGMSFPDFSASDAHIQWQRFCDLSWYHDDLGVWLDISRMHVNASDLQQLQPRMDKAFAAMQELEAGAIANPDEQRQVGHYWLRTPELAPSSELQQHISREIDLIAAFGRDVVNGTIKAPNGEAFTDVLWIGIGGSGLGPALMIKALQNPGEGLPFHFFDNVDPNGMSNVLAGLEGRLDRTLVVTVSKSGGTPEPHLGMEQARHRLEAAGGQWAGQAVAVTMLDSKLDQQAQKEGWLKRFDMFDWVGGRTSITSAVGLLPGALIGCDIRDFLSGASQMDAATRMADLRRNPAALMAASWHVAGGGRGQRDMVVLPYRDRLEVFSRYLQQLVMESLGKRLDRNGDVVHQGIAVYGNKGSTDQHAYVQQLRDGVDNFFATFIEVLEDVSDIPTISGECPGDFLDGFLQGTRSALTESGRQSMTISMRCFDARRLGALIALFERAVGLYGELVNINAYHQPGVEAGKKAAAAILNLQGRVEAILADGVARSADEIRLALGDGTDESIFWILRHLTGNQRGFSAQGDWSQPASMRFSKG

SEQ ID NO: 9535 - protein, 446 aa, Aquilegia vulgaris
MTEKRREITSEELKKHNKHGDIWISIQGKIYDVSEWIKDHPGGEAPLLNLAGQDVTDAFVAFHPGSAWKYLDKFFIGYLKDYTISEVSKDYRKLVAEFSKAGLYDKKGHHILFSLTFVTILMAISVMGVLCSDKTWAHLASAAVLGLLWMQIGFVGHDSGHYNIMLTPKLNRFMQIFTGNCITGISIGWWKWNHNAHHIAVNSLDYDPDLQHIPFLAVSSDIFSSLTSKFYGRKMTFDPIARFLISFQHWTFYPVMAIARINLFAQSFILLLSKRPVTDRALELLGLMVFWCWYSLLLACLPNWGERAMYVAMSFAVSGYQHIQFCLNHFSAHTYVGPPPCNDWFEKQTKGPFDISCSTWMDWFHGGLQFQVEHHLFPRLPRCHLRKISPFVKELCRKHNLPYISVSFFEANKMTIATLRNAALQARDLTNPIPKNLVWEAVNTHG

SEQ ID NO: 9536 - protein, 365 aa, Triticum aestivum
  misc_feature (287)..(287): Xaa can be any naturally occurring amino acid
  misc_feature (311)..(311): Xaa can be any naturally occurring amino acid
MASGKHFKYVVLGGGVSGGYAAREFAKQGVQPGELAIISKEAVAPYERPALSKAYLFPRNPARLPGFHVCVGSGGERLLPEWYSEKGIELILSTEIVKADLASKTLTSAAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKILKGTIAVGFDADANGDVTAVKLKDGSVLDADIVVVGVGGRPLTTLFKGQVAEEKGGIKTDAFFXETSVPGVYAVGDVATFPMKIYNDXRRVEHVDHSRKSAEQAVKAIKGKEAGSAVEEYDYLPAASPDELKAAGLQFASKI

SEQ ID NO: 9537 - protein, 225 aa, Coprinopsis cinerea okayama7#130
MADKAGSAYGAQRASDTDFRKKWDKEEFAERAKRKDDEERERMKENEERLKQGKRPRKGTKKDLPKPTELMKAREAPLELDKNLGKTMVVQNPGGRGPGQPGFYCETCNRTYKDTVAYLDHINSRAHLRAIGQSTKIERSTLAQVQARIAYLREKTKAASSAKDFDFDKRLAEIRAKERAAREQKKAEKKAEKEQKRMEMIAEPTGEDAEMAAMMGFSGFGTSKK

SEQ ID NO: 9538 - protein, 321 aa, Haemophilus somnus 129PT
MTALFNEEMTMNYLQIARNSLAAEQNALAKLSQNLNQQFNQVVELILNCEGRLVVGGIGKSGLIGKKMVATFASTGTPSFFLHPTEAFHGDLGMLKPIDIVMLISYSGESDDVNKLIPSLKNFGNKIIALTGNLNSTLAKHADYILDISVEREACPNNLAPTTSALVTLALGDALAVSLITARNFQPADFAKFHPGGSLGRRLLCRVKDQMQVRLPKVTENTNFTDCLTVMNEGRMGVALVMENENLKGIITDGDIRRALSANGTNTLNKTAKDLMTSNPKTINYNTYLSEAENFMKEKKIHSLVVVDDQNKVIGLVEFSS

SEQ ID NO: 9539 - protein, 618 aa, Gossypium hirsutum
MEQHIMWVFWFFLHWFCSVHSVSDGDSLLSPKGVNYEVAALMSVKRELRDYKQVMDGWDINSVDPCTWNMVACSAEGFVISLEMASTGLSGLLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVRWYRSQIMLPSYVQQDYDFEIGHLKRFSYRELQIATSNFNSKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTEEPQGGTNHCETSAYSFSRNYSDVHEESSFIIEAMELSGPR

SEQ ID NO: 9540 - protein, 524 aa, Gossypium hirsutum
MAEPKPEEISHPPMDQLQGLEYCIDSNPSWGEAIALGFQHYILALGTAVMIPSFLVPLMGGTDDDKVRVVQTLLFVEGINTLLQTLFGTRLPTVIGGSYAFMVPIISIIHDTTLLSIEDNHMRFLYTMRAVQGALIVASSIQIILGYSQMWAICTRFFSPLGMIPVIALVGFGLFDKGFPVVGRCVEIGIPMLFLFIAFSQYLKNFLTKQLPILERFALIISITVIWAYAHLLTKSGAYKHRPELTQLNCRTDKANLISSAPWIKIPYPLQWGAPTFDAGHAFGMMAAVLVSLIESTGSYKAAARLASATPPPAHILSRGIGWQGIGILLDGLFGTLTGSTVSVENVGLLGSTRVGSRRVIQISAGFMIFFSILGKFGALFASIPFTIFAAVYCVLFGIVASVGLSFMQFTNMNSMRNLFIIGVAMFLGLSVPEYYREYTAKALHGPAHTRAVWFNDFLNTIFFSSPTVALIVAVLLDNTLDYKDSARDRGMPWWANFRTFKGDGRSEEFYSLPFNLNRFFPPS

SEQ ID NO: 9541 - protein, 842 aa, Arabidopsis thaliana
MRKKMMISDLPHDLESEILSRVPAKSLAKWKTTCKRWYALFRDPSFVKKNFDKAGGREMIVLMNSRVYSNSVNLQGINNRFDPSMEVTGKLIKLNDSKGVDISAIFHCDGLILCTTTESTGLVVWNPCTGEIRCIKPRIFYRCNDRYALGYGNSKSSCHSYKILRSCCYYVDQNLSLMAAEFEIYDFSTDSWRDLGDITRDMIVYSSGVSLKGNTYWVSGSKEKGFFMRYFDFSKEVFGRLPLPYQSFNANHTAALSAVGNEKIAVLQQKILAMSDEMRIWVTNKIDEAKDLSWSNFLLTVDYGKFNLPCLVNVTSFLLDEENKVAVCSDVDTKDGLRSRIYIVGKDFYKEVFKDTRGSDNNWPLLLCYVPSLVSIQENIPNKAEENEIKGATSSVTMRKTMVISDLPHEIESEILSRVPTKSLAKLHTTCKRWYALFRDPRFVKKNFGKSERRLMLHSNFGVYKITDDLHGILNSGDPSLEFTSKLSNLKISEDLTITKIFHCDGLILCSTKENTRLVVWNPCTGQTRWIKPSKRYRSDDSYCLGYVNSKSSYHNYKILRYCFYYNDQDACVSEFEIYDFSSESWRVLDDYCTREWGLFCHGMSLKGNTYFVAGEKETGFFMLYFDFKTERFERLPLPYQSFDSEDTAVLSIVGGEKLAVLHQNIQSFSNEMRIWVTNKIDEAKDLTWSNFFLAVDYDIFNLPSVNNVTSFLLDEENKVAVCCDRHIDDEDKTRIYIVGVDLYKEVYKERTKGAHFNWPLLISYLPSLVHIQEKYPKDKRKGNKRSLISYQMIDFWRVYISHLRKTHSINSKPKPTAILDNDRTIVVVRVTRVSQPFIFSY

SEQ ID NO: 9542 - protein, 370 aa, Mesostigma viride
MQASQRRASARSAAVAPKASFSAKASSSGFMGASMPAMQASRARVASKAAPSPVRAEIGDTLEEFLVKATPNPKLRQMMQSLGEAMRTIAFKVRTASCSQISCTNTFGDEQLAVDVLADKLMFEACRYSGVCLSACSEEVPEIVNMGSGEDGFSVAFDPLDGSSIVDTNFTVGTIFGVWPGSKLTGIKGSQLAASGMGVYGPRTTYVLSIAGYPGTHEFLLIDEGKWVHVKETTEIKEGKLFSPGNLRATFDNPSYEKLISYWIGEKYTLRYTGGMVPDVGQIIVKEKGVFCNASSPSTKTKLRMVFEVAPLAYLIEKAGGYSSNGTMSILDIPINTVNDVSQVCYGSKNEVRRFEEYIVGASRIPAESA

SEQ ID NO: 9543 - protein, 323 aa, Heterocapsa triquetra
MAPAKTSSAAMLGLGAAGWLSSGSLFVSPTPPRAAELSRYAPQATAAPAAGASQGFAPGVRCSILGVAAVTVAAGARRVARRATQDELKKQVGYKAVDDYVKSGTVIGLGTGSTAAFAVERVGQLLKSGELKDIIAIPTSIRTKEQAESLGIPLATLDTHSDLDVAIDGADEVDPNLNLVKGGGGALFREKIVEMCAKKFIVIVDESKMCGGLGPGFPIPVEIVPFCHEHTMREIAKLPALAGCKPVLRLGDVANNKPDGDKPAVTDNSNYIVDLVFETPIKDAVAAGEQLKNTVGVVDHGLFTGMTTACIIAGSDGISVKEA

SEQ ID NO: 9544 - protein, 221 aa, Tropheryma whipplei str. Twist
MDNLVLLRHGNSLWNQENLFTGWVDVRLSELGEKEAKTAGQLLREANRYPDVLFTSLLTRSIQTAHIALMEIDRVWLPTFRSWRLNERHYGSLQGKNKAQVLEEFGEEQFNSWRRGYDTPPPPLHSQADDPRYEEPPPLSESLKDVQNRLLPYWQGVILPHLVAGKVVLVVAHGNSLRALVKHLECISDTDVCQLNIPTGIPLVYSIDPSGCATHPGRYLP

SEQ ID NO: 9545 - protein, 169 aa, Isochrysis galbana
SLSTLASHPNIDVCIDGADAVDANLNIIKGGGGAHLREKMVAEAAARLVVIVDESKMCESLGPSFPLPVEVTPFGHLHTLRRIGQLHSLSGSAAAPYLRQLKAGGLYTTDNGNYIVDVACGKPIADTVAVAAELSRLTGVVAHGLFNQMASEVIVAGKDGVSVIKSGRQ

SEQ ID NO: 9546 - protein, 454 aa, Haemophilus somnus 129PT
MTIKTPVQATLASNQYFLDRQDIMESNVRSYPRKLPFAYQKAQGVWVTDVEGNEYLDFLAGAGTLALGHNHPKLIQAIKDVLDSGLPLHSLDITTPLKDAFTEELLSFFPKDKYILQFTGPSGADANEAAIKLAKTYTGRGNVIAFSGGFHGMTHGALSLTGNLGAKNAVQGLMPGVQFMPYPHEYRCPFGIGGKAGVKAVEDYFENFIEDVESGVVKPAAVILEAIQGEGGVVPAPISFLQKVREVTQKHGILMIVDEVQAGFCRSGKMFAFEHANIEPDIVVMSKAIGGSLPLAVLAIKKEFDAWQPAGHTGTFRGNQLAMATGYVSLKIMREENLAQNAKERGEYLTKALTELSQEFPCIGNVRGKGLMMGIDIVDEHQAKDATGAYPRDCDLAVAIQKYCFKNKLLLERGGRGGNVVRILCAVNITQAECEEFIKRFKQSVAEAVKAVRG

SEQ ID NO: 9547 - protein, 215 aa, Brassica napus
MTSFSAFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLVASMAEGMLLPPPSVRFEHNYDFDGDADVSLWSY

SEQ ID NO: 9548 - protein, 444 aa, Neisseria meningitidis Z2491
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMSEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 9549 - protein, 450 aa, Escherichia coli
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIGVELGGVINGLGAKTHLFEMFDAPLPSFDPMISETLVEVMNAEGPQLHTNAIPKAVVKNTDGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGSEEKIVGIHGIGFGMDEMLQGFAVALKMGATKKDFDNTVAIHPTAAEEFVTMR

SEQ ID NO: 9550 - protein, 400 aa, Vibrio parahaemolyticus RIMD 2210633
MPNSLSLPTRVSQQVHTLAQQQNQPLCAYVYDLNALEEHIKQLRHVLPKNVELFYAAKANPSGPILKTLAPYVDGFEAASGGELAHLHQQQLDKPLIFGGPGKMPSELQQAIDLDVDAIHVESLTELKRIGALTERLNRPASIFLRMNIDIGDITLSKLAMGGKPTPFGLDESELSNALMLLRDCPQVSLKGFHFHLMSHQLDVERHLALMQRYFQVVKTWQQEFELGELMINLGGGMGINYQNPEQHFPWMEFCDKLEFLIAKEQVQDWTLRFECGRFITAACGYYVMEVLDIKQNLGESYVIARGGTHHFRTPAAQSHDHPFVILKSEQHHEISHPIQHAQATFVGQLCTPKDVLARNQHVAHVDIGDYVVFTLAGAYAWNISHQNFLMHEPPIFHYF

SEQ ID NO: 9551 - protein, 336 aa, Symbiobacterium thermophilum IAM 14863
MTIRIGINGFGSIGRRVFRIALSRPDIEIVAINDLTPPATSAHLLKYDSNYGILDAEVSATENSIIVNGKEIRVYAEKDPAQIPWKEHGVDIVMECTGRFTDKQQAEVHITSGGAKKVIISAPAKNEDITIVMGVNHEQYDPANHHVISNASCTTNCLAPVVKVLHDKFGVVKGMMNTIHSYTNDQVILDYPHKDLRRARAGALSIIPTTTGAAKAVALVIPELKGKLTGFAMRVPTPVVSVVDFTAELATPTTKEEINAALKAAAEGPMKGILAFEEAPLVSVDFKGNPNSSIVDGPSTLVLDGNLVKVVSWYDNEWGYSNRMVDLAAYIASKGL

SEQ ID NO: 9552 - protein, 299 aa, Streptomyces avermitilis MA-4680
MAPTSTPQTPFGRVLTAMVTPFAADGALDLDGAQRLAAHLVDAGNDGLIINGTTGESPTTSNAEKSDLVRAVLEAVGDRAHIVAGVGTNDTHHSIELARAAEKAGAHGLLTVTPYYNKPPQEGLYRHFTAIADATELPVMLYDIPGRSGVPISTETMVRLAEHPRIVANKDAKGDLGRASWAIARSGLAWYSGDDMLNLPLLSVGAVGFVSVVGHVVTPELRAMAEAYIGGDVQKALEIHQKLLPVFTGMFRTQGVMTTKAALALQGLPAGPLRAPMVELSPEETAQLKIDLAAGGVQL

SEQ ID NO: 9553 - protein, 481 aa, Rhodobacter sphaeroides 2.4.1
MTDFRREKILVGGDWIQADAGGRIEVTNPATGAVIGTVPDAGAAETARAVAAAEAAFGPWRALTAAERATHLRRLAQAILDHREALAELLTEEQGKPLAEARGEVGMSAAYIQWFAEEARRVYGEVIPSPWPDRRLLVTRQPVGVVAAITPWNFPSSMLARKIGPALAAGCTVVAKPASQTPFSGLAWGVLGEMAGLPAGVLNIVTGSARAIGGELTANPSVRKITFTGSTPVGKVLLAQAAGTVKKMSMELGGNAPFLVFDDADLDRAVEGAIAAKFRNAGQTCVCTNRFYAQAGIHDEFVKRLAAATAALKVGPGAQDGSEIGPLIDAAAVAKTEEMVADATAKGGRIVTGGRRHTAGAGFYEPTVIADATDAMTFAREEIFGPVAPVFRFETEEEAIRRANATEYGLACYFYTSDLGRAFRVSEALDYGIVGVNEGLVTTEVAPFGGVKESGFGSEGSHHGMQDYLTLKYTAMGGLGR

SEQ ID NO: 9554 - protein, 351 aa, Rhodobacter sphaeroides 2.4.1
MTRRHAVALIPGDGIGPEVIDASLEVLEKVARLHGFALDMTRFDWSCDRYLATGRMMPEDGIDQLRPHAAILLGAVGWPARVPDAVSLHGLLLPIRKSFDQFANMRPHRLLPGATGPLKSEAFDILCIRENTEGEYSGAGGRIHVGTPAEVAVETSIFTRRGVERILRFGFEQARRRSGRLASVTKSNAQKYSMVFWDEVTEEVAADYPDVTVSRYHIDAIAARMVMAPETLDVVVASNLFGDILTDLGAAIQGGLGFAPSANINPDRSQPSMFEPVHGSAPDIAGRGIANPVATLWSAALMLDHLGEEAAGRSLLAALSAVTAEGRLRTPDQGGRACTTDVARAVADRLS

SEQ ID NO: 9555 - protein, 103 aa, Gibberella zeae PH-1
MTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 9556 - protein, 193 aa, Glycine max
MFAEENGLKGDPRLQAISQAIRVVPHFPIHGIMFQDITTLLLDHKAFKDTVDIFVDRYRDTHISVVAGIEARGFMFGPSIALGIGAKFVPLRKPRKLPGEVISEKYALEYGTDCLELHVGAVQPGERAIIIDDLVATGGTMSAGVKLLERVGAEVVECACVIGVPDVKGQCRRIGKPLYVLVEPRKADKCYPD

SEQ ID NO: 9557 - protein, 299 aa, Rhodobacter sphaeroides 2.4.1
MNVRVACVGGAVLDRVYEVAALPGTDGKSRASSYREFGGGMAGNAAVAIARLGGQARWWGRVGDDAIGAGVLAGLAAEGVATAEARVVEGAVSSHSLVLSDAEGRRAIVLYRSDGLDPDASWLPLAAVGGLDAVLADNRWIDGAVAALTAARAAGLPAVLDADAGADPRSREAVQAASHAIFSEPGLAEIYGTSDPDEGLRHAAADAPFVAVTLGEAGLRWRDARGGLASLPAFPVRAVETVGAGDVFHGAFALALAEGQPPEDALRFAAATAALKCRGSGGRASYPGRTAVEDLLRQG

SEQ ID NO: 9558 - protein, 160 aa, Glycine max
  misc_feature (99)..(99): Xaa can be any naturally occurring amino acid
  misc_feature (152)..(152): Xaa can be any naturally occurring amino acid
ASSMISSPAVTTVNRAGAGMVAPFSGLKSIAGFPTKKTNNDITSIATIRGKVQFLHVWPPLGKKKIDTLSYLPYLDDAQLPNELEYLLTNVWIPCLEFXMEHIFMYREHYTSPGYYNSRYCTMLKLPMVGCTDASRVIKELLQAKTAYPNGXFIRIIGFD

SEQ ID NO: 9559 - protein, 778 aa, Heterocapsa triquetra
MPSMSKESRRTQRVVLAAGASAAVAAVGSTANGFVTGPALRTLPTQTTTQQSGYVASAGEAAPQSNSALLSGGCFALAASAVAVRSGARKARRSAVATRATAVSTETATDCINAIRFLAVDAINKSNSGHPGAPMGQAPIGFCLFAETMDFNPANPDWINRDRFVLSSGHGCMFQYSVLHLTGYKSVSMDDIKQFRQWGSKTPGHPENFETAGIEVTTGPLGMGVSNAVGLAAAEAHNAAVYNKPGMPLIDHYTYCIMGDGCCQEGISHESCAYAGHLGLGKLIVFYDDNGITIDGHTELSFTEDVGKRYEAYGWQVLTVTDGNTDVDAIRQAITDAKACTDKPTLIKVKTVIGYGSPNKADSHDAHGAPLGKDEGQATRDQLGWKYGEFEVPDHVYETYRAHGARGAKKEEEWNKMWGEYKKAHPELAEQFQRIVVDKKLPANWSDCLPKATPETAGKATRLHSQDCLNAIANTLPELIGGSADLAPSNMTLMKCTGDFLKGTYDGRNMRFGIREFGMGAVANAISLDRTGLVPYCATFTIFSDYMRNAIRVAALAKAGTIFVTTHDSIAVGEDGPTHQPIETIPSLRMIPDLLVMRPADCNESSGAYKVAVELSKNESRPTFMAFTRQALPNLPNSSIENTEKGAYAVLDPADPDIVLIGTGSEVSVCWEAAKEMKDKKVKVVSMPCWELFRAQPQSYKDQILPKGVPTMSVEAAVTMGWGEWSDAHVGINCFGASAPGNTCMDKFGFNVPNVVSCANRLLKGEKGVLSDGSQGKH

SEQ ID NO: 9560 - protein, 328 aa, Triticum aestivum
  misc_feature (222)..(222): Xaa can be any naturally occurring amino acid
  misc_feature (255)..(255): Xaa can be any naturally occurring amino acid
  misc_feature (303)..(303): Xaa can be any naturally occurring amino acid
  misc_feature (320)..(320): Xaa can be any naturally occurring amino acid
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLVATGKPESFXGPFLVPSYRGSSFLDPKGRGGSTGYDNAVALPXGGRGDEEELAKENVKNASSSTGNITLSVTKSKPETGEVIGVFESVQPXNTDLRAKAPKDVKIQGXWYAQLEFN

SEQ ID NO: 9561 - protein, 180 aa, Physcomitrella patens
MASAVVNQSEAAAVRAPSKPVKTYSKENEQLVKQSWEILKKDAQRNGINFFRKVFEIAPGAKAMYSFLRDSTIPFEENPKVKNHARYVFMMTGDAAVQLGEKGAYQVLESKLQKLAATHVNAGVTDDQFEIVKEAILYAIEMGVPDLWSPELKSAWGDAYDMLAEQVKAEMHAQRSAATS

SEQ ID NO: 9562 - protein, 580 aa, Mesostigma viride
LQSHLADVEKTHLRDLLRDEQRSSSCEVEHNGFFVDYARQRVTAETMNKLMALAKAANMKEKIQAMFAGDRINVTENRAVLHVATRAPKGEVIKVDGVNVVPDVYEVLDKIKSFSEKVRSGEWKGATGKPLKDVVCIGIGGSFLGPAFVHTALRTDHRAPLAASGRRIRFPSNVDPIDVARQLNGLDPETTLVIVVSKTFTTVETMLNARTVRAWITSNICVPDAVSKHMVAVSTDLALVKDFGIDPVNAFGFCDWVGGRYSVTSAVGILPLAIQYGYEHMERFLAGCWDMDTHFRDAPFDKNIPVLLGLIGVWNTQFLQCPTRAILPYCQALAKLPSHIQQLSMESNGKGVAMDGTELPFEAGEVEFGEPGTNGQHSFYQLIHQGRVIPCDFIGIIKSQQSVYLKNELVSNHDELMCNFFAQADALAYGKSAEELVAEGVAPDLVPHKTFTGNRPSSSILLPTLDAYTVGQLLSHYEHRVAVAGFIYGINSFDQWGVELGKVLAGKVRTTMNQARTKGVPITGYNSSTIALMNRYLSGKTKWLYPEPRDVFPSTSRQRVRPEPRRLWPLEGTSNADVGH

SEQ ID NO: 9563 - protein, 230 aa, Debaryomyces hansenii CBS767
MSQLFEWAFGKKLTPQERLRKNQRALEKTQRELARETTKLQSQEKKLVADIKKSAKQGQIASAKLQAKDLIRTKNYIVKFNSMKAQLQAILLRIQSVRSNQQMATSMRDATRLLSGMNKSMNLPQLSRIAQEFAKENDMMDQKQEFMDDAIDDAMAEDDELGEDEQADEILSKVLDEIGVDLNTSLQDTPSQINVQSPDRVDNGRVAEAIGGPSNNEEDDLQARLDNLKK

SEQ ID NO: 9564 - protein, 560 aa, Oryza sativa
VGRIPGRPTRRPRVGEGAGWCFCSGGGGGRSERVKAAIFSAKAAALAAVGGGHGGAGVLIHRNLLLTTHGNLPSAAAAEDAEALLGHARLAARLVPHRFFITSSILDLTIVGLDPAENETTLQAQQPHYLKTCCKPSLDHGSVVYLLGHTGKKELVIGEGKVVIGTDNLLKLSTDGVTWCPGSAGFDAQGNLAFMICDPMKLASSPTTRSSSTSSSSSHSSKKDHPMQFGVPISVVCDWLYQHWQGNLDEVSKPKLPLVRLMSSRSDHSSTSFTRRHVFKPADDENDDTSVSSQVTSKPKHQQASGNSANARISHDANPLVDLRANNEQGVSTPEIYESPRQSSCQGQKDAGSVQLLDINFPPSAPKTIFLPLPLKQMLSDENNADTSKPRNQSRDNGFPSGIIWHRNCEALSRDPPVAPLQDDCSSEGQSSSSPVELLEYRNEDHFSSEEETGYSAETMESRNIPSPREKHVGRSQSCVTYRRWSSPRMSTIQNGTLRKQHTLVPVRKSHSQNTSLPQRSHDYLSPTVSSAMKKRNSMEQQLPTKPRRSIAQTSPKWMF

SEQ ID NO: 9565 - protein, 541 aa, Schizosaccharomyces pombe 972h-
MNQTETLIPAARNVIRVLGYEIEYSKWTICFALLAVCIAYDQISYQMQKGHIPGPRFKIPFMGSFLDSMKPTFEKYNAKWQTGPLSCVSVFHKFVVIASERDLARKILNSPSYVQPCVVDAGKKILKHTNWVFLDGRDHIEYRKGLNGLFTTRALASYLPAQEAVYNKYFKEFLAHSKDDYAQYMIPFRDINVATSCRTFCGYYISDDAIKHIADEYWKITAAMELVNFPIVLPFTKVWYGIQSRKVVMRYFMKAAAESRKNMEAGNAPACMMEEWIHEMIETRKYKSENKEGAEKPSVLIREFSDEEISLTFLSFLFASQDATSSAMTWLFQLLADHPDVLQKVREEQLRIRKGDIDVPLSLDLMEKMTYTRAVVKECLRLRPPVLMVPYRVKKAFPITPDYTVPKDAMVIPTLYGALHDSKVYPEPETFNPDRWAPNGLAEQSPKNWMVFGNGPHVCLGQRYAVNHLIACIGKASIMLDWKHKRTPDSDTQMIFATTFPQDMCYLKFSPFDASTVDWKNSKEAFSNEAVSAATVETESA

SEQ ID NO: 9566 - protein, 405 aa, Glycine max
MPMATTHFQGLGVVTPSFSSSHSNKFLLSSRSERKDGIFMVRSDAARVLKTEGRKHELLVTNAVATKGGASSAASTSKSGSGHELLLFEALREGLEEEMERDPCVCVMGEDVGHYGGSYKVTKGLAPKFGDLRVLDTPIAENAFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDYLDAPIVCLSSQDVPTPYAGTLEEWTVVQPAQIVTAVEKLCQ

SEQ ID NO: 9567 - protein, 199 aa, Bacillus subtilis
MTIDHSVTNTEQLEQQNPAIKTKLKLKKLKDQVIVITGASSGIGLVTARMAAEKGAKVVAAARNEEALKELTDELKEKGHDAIWVKADVGKEEDVNRIAETAISTFGRFDTWVNNAAVSTFGHAMDVTVEDMKRMFDTNFWGPVYGTRAAVKHYTGRGVPGALINVGSLFGDRGTVIQSTYASAKFALHGWTESIRMEL

SEQ ID NO: 9568 - protein, 459 aa, Frankia sp. EAN1pec
MVRGIDTGHEKQAAGERTTGDESGVDPRTDPRADTGPVLARTIGTGDAVVIGLGAMLGAGVFAAFAPAARAAGAALLFALATAAIVAYCNATSSARLAALYPQAGGTYVYGRRRLGDFWGYLAGASFITGKTASCAAMALTVGAYTWPGHERLVAGTATAALTAVNYSGMRRAAWLTRLIVVVVLTVLVVVVVVCVTSGAAEPVRLSPTGRDGPAGPASPSLWPGLPQAAGLLFFAFAGYARIATLGEEVRDPRRTIRRAIPTALGITLVVYAAVAVALLLVLPVAALGASAAPLTDAVRAAGMPGLAPVVRVGAAVGALGSLLALILGVSRTTLAMARDGHLPTPLAAVHPRFGVPHRAELTVGAAVTALVLTTDLRGAIGFSSFGVLLYYAVANAAAWTLSPTEGRPVRAVPVVGLLGCLLLAFSLPGTSVLGGSAVLAAAAVVYAARHAGGHPARQ

SEQ ID NO: 9569 - protein, 302 aa, Debaryomyces hansenii CBS767
MPVEETETEVILTLPNDPNTKVTILKYGATIISWENKGDEKLWLSKAAKLDGSKPVRGGVPLVFPCFGKCNDESNPAYKLPQHGFARNSTWEFLGQTTESPVTIQFGLGPEQVDQDLYKLWNDGLYDFTLILSITLGEDHLKTNIEVENTGDKDFKFNWLFHTYFKIPDITDIIVNNFTDAKCYDQLIGETYEEKAPMISFTEEFDRIYKGIDTQKTFQMIELGKVLMNVQRENLPDSVVWNPWIKKSEGLADFEPKDGYMNMLCIEPGHVAEFKNLKSGEKWSGAQILSTGGEIKVQTNIY

SEQ ID NO: 9570 - protein, 648 aa, Oryza sativa
  misc_feature (34)..(34): Xaa can be any naturally occurring amino acid
MHGGGARALAAAFVLALLAAAPAASEVVCSGRRXYAANSSFDASLQQVARTLPGNASSSPLLFATLAVAGEAYALALCQGGTSAGSCNYCVAQTMRDGEHACAGDADVAMYDDICTVRFSDRDFLAATTNSPEKLVVAGSQSQKLVPSAAGRFYRLVGELLDATADYAVANSTARFATGDVGVGGYFDGEPFSKIYALAQCTPDLTPAQCRACLASAMEEMTRQVFAASSPGGKVIGERCGLRFEVFSFYTVDAMVHLQVAMEGKKKSTPVLAIVLPIVFAGLLTIIIVSFYIWRKKRLPTKTPLIENTEDLEDFESIFIDLSTLQSATSNFDESNRLGEGGFGVVFKGVFPDGQEVAVKRLSNCSNQGLGQLKNELSLVAKLQHKNLVRLIGVCLEEGEKVLVYEYMPNKSLDTVLFDPEKSKQLDWGKRYNILYGIARGLQYLHEHSQLKIIHRDLKASNILLDSDMKPKIADFGMAKIFGDDQTRNATSRVVGTLGYMSPEYAMRGQYSTKLDVFSFGVLVLEIVTGRRNSYAVVSEHCEDLFSLVWRHWNEGTVTEIVDPSLGNHYSRGDILKCINIGLLCVQQNPVDRPPMSAIILMLSSGTVTLQAPYRPAYIFGRNRSYTETMDVPLPSGPHSSITELEPR

SEQ ID NO: 9571 - protein, 46 aa, Synechococcus sp. WH 5701
GIKEFSSWPTIPQIYVKGEFMGGSDILIEMYNSGELKEKLEIALAS

SEQ ID NO: 9572 - protein, 79 aa, Glycine max
ASLMISSPAVTTVNRAGAGMVAPFTDLKFMAGFPTGKTDHDVTSIASNGGIVQCMHVSPPIGLIKHGTLYYLPDLDDAQ

SEQ ID NO: 9573 - protein, 159 aa, Bifidobacterium animalis
MAAGPVLVVDFGAQYAQLIARRVREANVYSELVPHSMPVEEMLAKKPSAIILSGGPASVYEPGAPTIDKSIFTAGVPVLGICYGFQVMAHELGGDVDKAALGEYGKTEAVVDDATGILDSSPSLQTTWMSHGVAVNKAPAGFEVTAHTEGAPVAAMEDP

SEQ ID NO: 9574 - protein, 327 aa, Glycine max
MASSSSLHLSQALLARAVYLHGSSSSDRVSLSFPSFSGLKSHSTCKAAAATSSRRRGACPSTNVVRAAAVETLDQTTEVSLVEKSVNTIRFLAIDAVEKANSGHPGLPMGCAPMGHILYDEVMRYNPKNPTWFNRDRFILSAGHGCMLQYALLHLAGYDSVLEEDLKEFRQWGSRTPGHPENFETVGIEVTTGPLGQGIANAVGLALAEKHLAARFNKPDNEIVDHYTYVILGDGCQMEGISNEACSLAGHWGLGKLIALYDDNHISIDGDTEVAFTENVDQRFEALGWHVIWVKNGNTGYDEIRAAIKEAKAVKDKPTLIKVTTTI

SEQ ID NO: 9575 - protein, 301 aa, Oryza sativa (japonica cultivar-group)
MRAAAAPDPSPAPARSMLKRLFDRQLLRVSPAERIVAVGGGEKDEVEPSSVCLDGMVRSFLEDGSGVGAAVERAGGHGARRCNCFHGGGSSDDDDDEDDAAASSDVAETIKGLVHCATLRERNLLADVCGHVERHRAGGARRRELLGLVAASLRAAGHDAAVCVSRWDKSPTHPAGEHAYVDVLLPPASDRGARERVLVDVDFRSAFEVARPTKAYRALLQRLPAVFVGKDDRLRLLVAASADAARASLRKRGLHLPPWRKPEYMRAKWLSPYDREPAPPDEASASAAAAEVAGEEAPAAA

SEQ ID NO: 9576 - protein, 99 aa, Brassica napus
  misc_feature (48)..(48): Xaa can be any naturally occurring amino acid
  misc_feature (72)..(72): Xaa can be any naturally occurring amino acid
  misc_feature (80)..(80): Xaa can be any naturally occurring amino acid
  misc_feature (83)..(85): Xaa can be any naturally occurring amino acid
MATLDSDVNMIPAGESSSSVGASSSSKKAKRFEAKKRSAVALWAWDIXVDNCAICRNHIMDLCIECQANPVXATSEECPXAVXXXYPLPFLHPPLPPSI

SEQ ID NO: 9577 - protein, 960 aa, Arabidopsis thaliana
MDEGQGPYVNGNGQKEQDTDNIPQEDEDGKDINQDESHVDHSNNIDDTNDDLVVENPPVLRRSVKQVQRPSYLDDYALLADIDCEKLLLSINDEPNNYQEAKELIKWTNACEEEIKLLVGLATSNGWEIHHLDVKTAFLHGEFKEDVYVSQPEGFEKKGEEQKVFKLSKALYGFRHDPRAWNTKLDQILKSLKFTKCSKESGVYQKSEGTKLLLVAIRVHGCNKSCKEAIWLQDLLSELTGQSFVKSKIYIDNKSAIELTKNPVFHGRSKHIHRRYHFIQECVENEQIEVEFVPREELRADIQTKALPRIKFKSMRSLFGVQDLSKVNLKLMGENVGNFINAGWILRDVEGYYIEATQSKAQICNTILEAELQSLLMAMQHMWIRGHRYLFFEGDNSKILKLITGKTRSFTLHIDSRNKSLATEVYKCEDSMDSRNKQQGIWAMRMRVMLRVHKVWDTIEPGLTDDNKNDVATALIFQSIPEALTLQVGTTLQIRKTSGLLKDLVENENSLGSNKSVDRHCKNQDISNSQGNTQENLMYANADGSRYRGRGGRGNRGRGRGRSNYQTDQEQTKEKKEKSNVICYRCDKLEHYASVCPDRKQNQQEANNVETIEADEALYMHEIVYLNEENLIPRKGKLKFGDGSCVDIGGKGSIIFEGKNGEQTLLPDIYFIPDLRSNILSLGQAYIIIRKRVSNAHHPQSTQIVPPIRVFVRQNFQRRILNLDMGSHEQSPENNGSSTVSKKVADIWQRMNEGVPNKRVNFVSTALPAKNSANSNWKSYLGVNVKKKDTCVSDVQKSVLNHSCSEEAKSIAAAALAAVRNATVTAAAASSRGKIEITEVKDFAGQEIEVKRLVEADSKEALERGNKGSSSSSAAPSAVDAVLEQIKKKQKLSVLDKTKKDWGEYKEEHKGVEDELDKYKKSSDQYLDKVGFLERADYRQFEKERDARLALQSKRRHDDV

SEQ ID NO: 9578 - protein, 801 aa, Arabidopsis thaliana
MLRRLGWLIGLSQRSRQTKSIDAEPYVARVKPVLMIDTVQEIAIYIHRFHNLDLFQQGWYQIKISMRWEDGDNNSCGIPSRVVQYEALDSTSNDSYGVWKIDDKDSSFLTQPFRIKYARQDVRLCMMVSFTMPLERYEGSATSAVILKFELLYSPIMEDIPVTHSDACAAAVHEFRIPPKALSGVHSYCPVHFDTFHAVLIDVSVHVSVMKSAAYKRPAILSSDASNGKNLTSGNIQSSKKAFTQIASADKKLVSFVKALLGARDTLLEEMQRLSKAVGQTVDLSEFVSSMDNALLSDSGSTGKSVEVEGSGQGKLQNNLELNGPFDLASDDWLHNFSKEHLSRTFHLLGTQLHYLWNTFLTLHRDNYTKILEYLRDIWTKDRRAEWSIWMVYSKVEMPHHFISGMEDISNHSSHKRVSTGLKLNDPAQVASTRAELHRRSIAQMRINNRAIQDMHIFGDPMRVPIVIIERVWNAPRRTFSDNSYMRHVDRIDSSLLNGHDDESGTKKHINPQHTGRELKIVVFVHGFQGHHLDLRLIRNQWLLIDPKIEFLMSEANEERTHGDFREMGQRLAQEVVSFFKRKKDKHARYGRLKNIKLSFVGHSIGNVIIRAAIADSLMDPYRKYFHTYISLSGPHLGYLYSSNSLFNSGLWLLKKLKSTQVIHQLTLTDDPDLQNTFFYKLCKQETLCSFKNIILLSSPQDGYVPYHSARIESCQPASFDNSKRGVAFLEMLNNCMDQIRGPSPETPHHQRVFMRCDVNFDTTLYGRNLNSFIGRAAHIEFLESDVFARFIMWSFQDLFR

SEQ ID NO: 9579 - protein, 549 aa, Haemophilus somnus 129PT
MQNINPTQTNAWKALEQHQKDLDQVTIQQLFEQEPTRFNDYSLKFAEQILVDYSKNNINQQTLSLLRQLAKECALNEATEAMFNGEKINRTENRAVLHTALRSCANTPVYVDGKDVMPEVNAVLAKMKSFCQRVISGDWKGYTGKAITDVVNIGIGGSDLGPYMVTEALRPYKNHLTMHFVSNVDGTHIAETLKKVNPETTLFLVASKTFTTQETMTNAISARKWFLAAAQDESQIANHFAALSTNAKEVEKFGIDTNNMFEFWDWVGGRYSLWSAIGLSIALSIGFDNFEQLLAGAHEMDNHFRTAPMEQNIPATLALIGIWNCNFLGAETEAMLPYDQYLHRFAAYFQQGNMESNGKYVARNGEVINNYQTGPIIWGEPGTNGQHAFYQLIHQGTKIIPCDFIAPAQTHNPLSDHHSKLLSNFFAQTEALAFGKTQQEVEAEFVKAGKSLDEVKEIVPFKVFTGNKPTNSILVQKITPFTLGALIAMYEHKIFVQGVIFNIYSFDQWGVELGKQLANRILPELTGDESISSHDSSTNGLINQFKAWR

SEQ ID NO: 9580 - protein, 262 aa, Hordeum vulgare
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGHS

SEQ ID NO: 9581 - protein, 216 aa, Oryza sativa
AFPSLHFLPSKNKARGSPSSLPCRQEAMSLAPSIPSIKVKVGGVAAVAVSPPRHRACRSSFAVIRSSKAEGAPRRPAAPPLSPPPKTPTLSTPPTLSQPPTPVKPAAPSSSPPPSQDPEPKQAAAPVAVAAPAAAGAVTLEYQRKVAKDLQDYFKQKKLDEADQGPFFGFLGKNEISNGRWAMDANRVRNRLGFCSTSEDPSLQFWDCGFGLIADV

SEQ ID NO: 9582 - protein, 438 aa, Debaryomyces hansenii CBS767
MVSSAINLMKTIIGAGLLSMPYTYSTDGSIIGTVIILLAALTSGYGLFLQGYVSKYAPLGHATFFNICSITYPSLSVVFDIAIAVQCFGCAISYLVLIGDLMPTIITSISFVSDEHYRTFWILVSTVICVPLSFMKNLSSLQYTSILGLVAIFYMALLVITHFLIDDIPDSSKGEIKLFPPNILGMFSTFSIAVFAFTGHQNMFSIINEAKDKSLKSITELINIAIIVSSVLFIVVGLAGYSTFGDKVNGNVILLYPNSWTTTLGRLCIVFMVVFSFPLMLHPARISVNNIYHTVYSKIMEKEDHGDTDDETTALLDDASQEIHESGSVLEDLSMKTTIVPFSRNVFLAITTILLITGYTFAITIKSFAFVLAIIGATGSTAISFILPGLFGYKLIGSEVDYPSKTDLLLKSCSLALVIWGFGVMFLCLYTTLFMDSY

SEQ ID NO: 9583 - protein, 653 aa, Marchantia polymorpha
MQAPAVPAVQQQQQHCPISVTSSGSRFTTPAVVQAFRLSSSCFFHSSSSSLRILRSRADQPLRRALSIPHHRIEAMASGQHAPISESAAWADLKQHVKTIEGTHLRNLMQDNNRCEELIKEYDGIVVDLSRQRVIHDTVDKLLNLAEEAKLKEKIDQMFDGVHINETENRSVLHAALRAPRDEVINCDGQNVVPAVWDVLDKIDAFSDQIRSGSWLGSTGKPLTDVVAIGIGGSFLGPLFVHTAMQTEPGCAQAAKGRRLRFLANVDPIDVARALLDLNQETTLVVIVSKTFTTAETMLNARTVRTWITSALGVEAVSKHMVAVSTNLKLVKEFGIDPANAFGFWDWVGGRYSVCSAVGVLPLALQYGFSHVKKFLQGAWSIDDHFRSAPLESNLPVLLGLMSVWNVSFLGCPARAILPYCQALAKLAPHIQQVSMESNGKGVSLDGVPLPFGTGEIDFGEPGTNGQHSFYQLIHQGRVIPCDFIGIIKSQQSVYLKGEQVSNHDELMCNFFAQADALAYGKTREELVAEKVPEALIPHKMFSGNRQSLSILLPNLTPYTVGQLLALYEHRVAVQGWIWGINSFDQWGVELGKSLAGKVRTQMNAARTKTQPLSGFNYSTTTLLTRYLQGKTQLLYPDPHDVFPSNVLPGFEK

SEQ ID NO: 9584 - protein, 220 aa, Spinacia oleracea
RNLLSVAYKNVVGARRASWRIISSIEQKEESRGNEDHVSVIRDYRSRIEKELSDNCDGILKLLDTKLVPAASSGDSKVFYLKMKGDYHRYLAEFKTGAQRKEAAESTLTAYKAAQDIANAELAPTHPIRLGLALNFSVFYYEILNSPDRACNLAKQAFVEAIAELDTLGEDSYKDSTLIMQLLRDNLTLWTSDMQDEAADEITEEAAKQQKAVNNNKIAY

SEQ ID NO: 9585 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTVSTFVFNPFSSDGGFGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDELGPSQMETTFDVMSGLDMADTMVLFRNAVKQICRRRGYLASFMCKPKIEGFIASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 9586 - protein, 428 aa, Frankia sp. EAN1pec
MDASDLVTRDRAVVWHPYASVRDQAPLFAVASAAGVRLTLTDGRELLDGMSSWWAAIHGYRHPVLDQAARDQLDRMSHVMFGGLTHEPAVALAELLVRVTPPGLERVFFCDSGSVAVEVAIKMALQYQAGRGRPGRTRLLTIRRGYHGDTSGAMSVCDPDTGMHHLFTGLLARHLFAPAPAPGFDEPVTDDDLADVERLLAAHEGEIAAVVLEPVVQGAGAMRFYAPGWLARVRELCDRHRVLLVADEIATGFGRTGELFGCDHAGITPDIMCVGKAMTGGYLTMGATLCTTEVADGVCASEAGAFMHGPTFMANPLAAAVSRASVELLLASPWRERVRVVHDALAAGLAPAADLPGVADVRTLGAIGVIETHRPVDMAVIQPLLVELGVWVRPFGRLVYAMPPFVMEPADVATLTAAMVAAVAATTG

SEQ ID NO: 9587 - protein, 292 aa, Streptococcus pyogenes MGAS8232
MSERLSGHTLLVSLLATPIRHSLSPKMHNEAYAKLGLDYAYLAFEVGTEQLADAVQGIRALGIRGSNVSMPNKEAILPLLDDLSPAAELVGAVNTVVNKDGKGHLVGHITDGIGALRALADEGVSVKNKIITLAGVGGAGKAIAVQLAFDGAKEIRLFNRQATRLSSVQKLVTKLNQLTRTKVTLQDLEDQTAFKEAIRESHLFIDATSVGMKPLENLSLITDPELIRPDLVVFDIVYSPAETKLLAFARQHGAQKVINGLGMVLYQGAEAFKLITGQDMPVDAIKPLLGDK

SEQ ID NO: 9588 - protein, 402 aa, Frankia sp. EAN1pec
MSHDRTGVSPPVLLTVGPATATSRASLPAVPVEPAPPAVAAVPVEPSRPVATAVAVRPPTPVGPAAACPPPVSTAGRRTLAKAAVGAAAAGESAASPRAAGAAPELDPRPKSRAEQILLALFLGGPLLAVALAVPFAWGWGLSWHDVVIGAVMYVIGGLGITVGYHRHFTHGAFKARRGLRIALALAGSMAIEMSVIDWVAAHRRHHRFSDRDGDPHSPWRFGPGTRSLARGLLHAHVGWLFAPRRTNAQRYCPDLLADRDIRRISDRFGWLVAVSMLLPPLVGGLWAGSWTGALTAFFWASLVRVFLLHHVTFSINSICHVLGATPFATRDHSGNVWWLAVPSFGEAWHNLHHADPTSARHGVLRGQIDLSAGLIAVFERLGWAHDVRWPDSERIAAKRAA

SEQ ID NO: 9589 - protein, 346 aa, Bacillus clausii KSM-K16
MMEYDVVVIGGGQAGLAVGYYLKKQKRPFLIVDEQNEAGDSWRKRYDSLVLFTPRCYSSLPGLDFSGDPNGYPSKDEMADYLWTYKETFQLPVVYETKVEKLEKTRDRFKVWTSEGKIYDAKQVIIATGAFHTPFIPPLANSIQPGIAQLHAFDYKGPEQIVAGPVLIVGAGNTGVQIAAELVEHHDVVLACGNKPNVLPQSVLGKNVFWWFDKLGLSKATVHSPLGKWLQKRDPIIGNDFYTVRKRAKLKGRLINVTDSKAYFAEGSPVSVQTIIWATGYRNDYSWIDIDGVFDQEQKPIHVRGVTNVNGLFFVGLSWQYKRGSALVKGVGEDAAYMVSQLSKHS

SEQ ID NO: 9590 - protein, 759 aa, Sulfolobus neozealandicus
MEPLSDNEKKSSINFSPKVNDTSNINNSLTLNENSNNKINKNETSKNELKDVQSSTTYSNEDLVDKATVDYSQALEDFILNYEEQGVKVYLRKKEEVEKRKAKSFYINWNHLYTWFEQHKNEYPLNLALELLEDPLELLKSISGWVYDLFARGKEPLQLSEYGKTVDKPDFHVRITDIPRKLEMRKIGTQFIQVGKLVEIKGVVFSKTLPKPKLIKGHYRHLRSDCLGEFDFPNTEIEELEITPKHCPLCGKTGEIVLISERSVYTSWQKVVIQETTEELPPGEVPRQLELELLDDLVDTVKIGDKIDVVGVLMAKPKPKNVNGALISDFYIKVNSIRVLESTVTDFEISEEDEQRIRELAKRQDIVDVIIKSIAPSIYGHEFEKEGIALALFGGVPSVRKDGTRRRGDIHVLIIGDPGTAKSQLLQFVKNLIPRSIFVDGKNATGVGLSGTVVIDPDTKEWRIEGGAIALADGGFLLIDEFDKIPEEERSRINTAMEQQIVKLDKANQHFELDARTTVIAVANPRYIRYIEDRTVAENISFKPDILSRFDLISVVIDKHDEEQDRKLAEHISNNELGTEEAGNSVIDTDTLRKYVIYARKYIKPKFTKEALDTLKEFFVTIRNKTKDLTDFPLEITTRQYEALLRISQAYAKMRLSNQVEQQDVERAIKFVSEMLRRFKADIETGVTQDMMNKMIRILDLIDSFRNSPINDGCAKFGDILLNAEEQYGMDDDTVTRIINLLREKGQIREVKENCYKPA

SEQ ID NO: 9591 - protein, 419 aa, Zea mays
MASLIPPCLSVPTAPGRARLAAPGAPRRRRMAVVRAKIREIFMPALSSTMMEGKIVSWTAAEGDRVGKGDPVVVVESDKADMDVETFHDGIVAVVLVPAGGTAPVGAPIALLAESEEEVALARARAQALSQGQSQAPSPPHAAAALGPPPPAPVAPPATKGIATPYAKKLAKQHRVDIAGVVGTGPHGRVTAADVEAAAGIKHKRPPPPPPPASVDAAPLVPASAVLPPVPGGTVVPFTTMQAAVSKNMVESLRVPTFRVSYSMITDKLDALYEKVKSKGVTKTVLLVKAAAVALTQHPVVNASCRDGKSFSYNNDVNIGVAVALEGGLLTPVLEDADKGAIMAVGASRPTVVADKDGFFSIKSEMLLNLKAQIICDPSACSLEHVNVTADHRIIYGADLAAFLQTFAKIVEDPECLTL

SEQ ID NO: 9592 - protein, 817 aa, Oryza sativa (japonica cultivar-group)
MGASRKLQGEIDRVLKKVQEGVDVFDSIWNKVYDTENANQKEKFEADLKKEIKKLQRYRDQIKTWIQSSEIKDKKDPKEKAKAETRDWLNNVVSDLENQIDNFEAEVEGLSIKKGKQRPPRLVHLEKSITRHKAHIKKLESILRLLDNDELSPEQVNDVKDFLDDYVERNQEDFDEFSDVEELYSTLPMEKVEALEDMVSLAPSSLVKGVASVSTTAVLSTKSSVATSPTQATVSAAPSLSVSQDQAEETASQESNPESAPQTPPSKVGSQPSVPVVPTTISTSTAAVSVSAETISSPVRPIVPTTTAAVLPASVTARSAPENIPAVTSAPANSSSTLKDDDNMSFPSRRSSPAVTEIGLGRGITRGLTSQGLGSAPISIGPVSGNGSVSALTDLSKRNMLNTDERINSGGISQQLISPLGNKAQPQQVLRTTDTISSDSSNTNESTVLGGRIFSPPVVSGVQWRPQNTAGLQNQSEAGQFCGRPEISADQREKYLQRLQQVQQQGSLLNVSHITGISQKQFPSQQPNPLLQQFNSQSSSISSQAGIGLGQVQVPESGHTKSEEQQQSFAEDVSVESVATAGANKHMSEDDTKIPFSNPSASITEGTQLSRDPDLPAGQPLQPGMSSSGVGVIGRRSVSDLGAIGDNLSVASASTSHDLLYNLQMLEAAFHRLPQPKDSERVKNYIPKHPAVTPASFPQIQAPVVSNPAFWERMGGDSLSTDLLFFAFYYQQNTYQQFLSARELKKQSWRFHRKYNTWFQRHVEPQVTTDEYERGSYVYFDFHVIDDGTGSGWCQRIKNDFTFEYNFLEDELSVQTN

SEQ ID NO: 9593 - protein, 950 aa, Frankia sp. EAN1pec
MSRAGAGRPSARVPGKGGDTHAAAGRCAAAPRPVAVHPAWFTRRGRRACAPRTGRRAPPRGRPVARARRPWGTIESTMTPHTSTPENTSPDLAPGGSAPGGTPGSAPGPAAGSPSLADRLPAGPEPDADALFDAFGAWVTDQGLELYPAQTEALIEVVSGAHVILATPTGSGKSLVATGAHFAALGWGRRTFYTAPIKALVSEKFFALCAVFGPARVGMMTGDASVNETAPIICCTAEILANIALRDSATADVGQVVMDEFHYYADPDRGWAWQVPLIELPDTQFLLMSATLGDVTRFEEDLTRRTGRPTAVVRSAQRPVPLFHRYVTTPLHETIEELLETRQAPVYVVHFTQASALERAQALMSVNVSTRAEKDAIAEMIGGFRFTAGFGKTLSRLVRHGIGVHHAGMLPKYRRLVELLAQAGLLKVICGTDTLGVGINVPIRTVVFTALSKYDGTRTRILTAREFHQIAGRAGRAGYDTVGNVVVQAPEHVVENEKALAKAGDDPKKRRKVVRRKPPEGFVSWGVPTFERLVAAEPEPLTSQFAVSHSMLLNVVNRPGDAFSAMRHLLTDNHESPAAQRRLIRRAIAIYRALLAAGVVEKLDAPDETGRTVRLTVDLQLDFALNQPLSPFALAAIELLDRESPDYPLDVLSLLESTLDNPRQVLSAQQFRARGEAVAAMKAEGVDYDRRMELLDEVTWPKPLDELLHAALATYRRGHPWVDDYELSPKSVARDMYERAMTFAEYVDFYGLARSEGLLLRYLADAFKALRQTVPEDARTEELTDLTEWLGELVRQVDSSLLDEWEALRDPAPDSGAAPGGLVERTSAVTANTRAFRVLVRNALFRRVELAALRRYDLLGDLDAAAGFDAQAWRDALEPYFDTHAEIGTGPDARGPGLLIVETAADRWTLRQIFDDPAGDHDWGISAEVDLAASDEAGIAVLRVTAVDQL

SEQ ID NO: 9594 - protein, 257 aa, Brassica napus
NKQSSHICLRQRKDCSSILLSSTPKKNNSSLQMKKKGKVYPSPPPTQPPSSSSSSSRYLNEDKSLSVLSLLPATILVLVSVLSTEDREVLAYLITRGNCGRASTTTKKNKSSKNHHKPPVFDCECFDCYTSYWLRWDSSPNRELIHEVIEAFENHQGENSVSRNKSKRGKKKEKPGRRVELVSESSVSESHVSTPDDSLGRLSEAEVVEREPQDVEEESTVEIPAAAGADQKGLARKVLPDVLGLLNSSFWRLWNPN

SEQ ID NO: 9595 - protein, 678 aa, Saccharomyces cerevisiae
QFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 9596 - protein, 325 aa, Oryza sativa (indica cultivar-group)
MEKRMETLEQIKETLRETSKLVPDIVRAAVGLEHHYQTVELPHDDGCVKSFAAAFLRPQEQEQAHGDGEVQQAVRMESASCYVPDHDEDAHFVHDAAGVVGVADGVGGYRRRVGVDAGAFSRGLMTSAFAQLVTAEPGTPVCPYTLLERAYEETLESGAQGGSTAVILSLADGNVLRWAYIGDSAFAVLRDGRVVVRSVQQQRYFNAPYYLGGRRGDEGMTVGMVGEMKVRRGDVVMAGTDGLFDNMSDAELEKVVQIGTALGFSPKNMADIIGGTAYEMSRCLLKDSPFAVEWRKQHENEEEHFYGGKVDDITVVVACIVSSDS

SEQ ID NO: 9597 - protein, 315 aa, Oryza sativa (indica cultivar-group)
MEALPQIRQTLSEIDRRIPDALRVAMGLRLRPTAGAALVEVTRFAASCQPRPCPEGGDDPMECDEPAPARALRMEAASCFLPDHDEDSHFVRPEAGVVALADGVGGYRAPGVDAAAFARALVYNAFEMVVATTPGGAGGICPYALLGWAYEQAVSARTQGASTAVILSLAGATLKYAYIGDSAFAVFRDGKLFFRSEAQVHSFNYPFQLSVKNGNSVTSAARGGVEVKEGDVVVAGTDGLFDNVASEELQRIVAMGRALGLSPKQTADVVAGFAYEASTTMGRDTPFSLESRKKQGTIFRRGKRDDITVVVAYIV

SEQ ID NO: 9598 - protein, 110 aa, Peptostreptococcus micros
VQGFGNVGSNTAKHLERMSGNILSISEYDKEKGVYTIYNENGFNISELISHFEKYNTLYNYKNAKHISIDQFYSLDVDVIIPCALENSITEDEAQKIRAKLIVEGANGPT

SEQ ID NO: 9599 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDESLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 9600 - protein, 123 aa, Brassica napus
GVRALFKVCDGATTVFIQDCWGLDDDSFSLAKAFRRVRFLSLEGCSVLTTGSLKSVVLRWEKLESIRVMSCKNIKASEFSPALSSLFSLLKELTWRPDTRFLFSSRLQGAGIGKKGSKFFKKK

SEQ ID NO: 9601 - protein, 238 aa, Glycine max
  misc_feature (112)..(112): Xaa can be any naturally occurring amino acid
CKVSSFKCSSAFTNVFLQGFLRAGAMSSPYLPATTDSLALATEAKDPSEAISILYRVLDDPSSSPDALRMKEQAITNLTKLLTDENRGEDLRSLLTQLRPFFSLIPKAKTFXRQRVEARLAALLMESKEYSEALTLLSGLVKEVRRLDDKLLLVDIDLLESKLHFSLRNLPKAKAALTAARTAANAIYVPPAQQGAIDLQSGILHAEEKDYKTAYSYFFEAFESFNALDDPRGGGLRS

SEQ ID NO: 9602 - protein, 366 aa, Xanthomonas axonopodis pv. citri str. 306
MLFETLDTTGHEQVIFCHNRDAGLKAIIALHSTRLGPALGGVRMRPYASSEAALNDALRLSRTMTYKNALAGLNVGGGKAVIIGDPRTDKTEALFRAFGRFVDTLGGRYITSEDVGTDVNDMEQIYLESEYVTGVHQVHRGSGDPAPFTAYGALQALMASLNRKLGHEEVGKASIAIQGLGHIGMELVKLLKERGAKLYVADLNQALVDRAVAEYGAEAVRPDEIHQVSADVFAPCALEGAINEDTLPQLKAKIICGTANNQLASAAIGEELHRRGILYAPDYVVNAGGVMNVSLEIDGYNRERAMRLIRSIYHNLEKVFDLSTQLDVSPQQAADQIAEARIEAISKLKLPLGRTAPRFLHKLRGE

SEQ ID NO: 9603 - protein, 123 aa, Rhizobium leguminosarum bv. viciae
MNRPHAIIVMGVSGCGKSSAGEKLAEALHLVFVEGDALHPTANVEKMSKGIPLTDEDRMPWLDRIGEDMKASLEKSEGIIVSCSALKRIYRDRLRAAVGGNLFFVYLEGSRALLMKKVEEMMA

SEQ ID NO: 9604 - protein, 576 aa, Zea mays
MAVKDCGGHKGCECERERLYRRCCAAVVALILLVLFIVLVVWLVLRPHKPRFYLQDLSVLCLNVTPPASTYLFTTMQATVAARNPNERVGVYYDQADAYAEYKGVAITVPTRLPVQYQGPRDASVWSPFLRAPEGGVQLPPQLAVALAQDETAGYVLVDVRVDGWVRWKHINPHPSTLRSATRSSSPRRRPPGASPPRARSSGTASFPSEEQWDSLLPERGAAGQRAPRADEGERRERLAVLVPPPGQLNGDGRPGYQDMEGEGYFTNLLQDGLHNEINTEIQQTLPINDSNPSSKANQKHKGKNFTEDEDRLLISAWLNVSMDSTQGTNQTRDFWKRIYLYYEANKGDLGRNISERTQTSLLHRWGTIQEAVEQAEILFKEQDHPKHRSFTFRHCWLVLRNQPKWLDKLRQLAEIKASSKKQKTTKNSSPGIVDLTTQDGHDKDPQEIVNSSMDAPKRPPGKKKAKEALRRGGNDACTEALELLWAKKREDEVAKELKREERYAMSYALDKERLELDKERHVLEKERLENEANNIYLKTIAEEQKIMLLDLNSMTELQREYYTSLQAEIVARRRN

SEQ ID NO: 9605 - protein, 350 aa, Staphylococcus epidermidis RP62A
MKAAVWYGQKDVRVEDREPKAIKDNEVQVKVSWAGICGTDLHEYLEGPIFISTDQPDPLLGQTAPVTLGHEFSGVVENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 9606 - protein, 548 aa, Nicotiana tabacum
MTTTPIANHPNIFTHQSSSSPLAFLNRTSFIPFSSISKRNSVNCNGWRTRCSVAKDYTVPSSAVDGGPAAELDCVIVGAGISGLCIAQVMSANYPNLMVTEARDRAGGNITTVERDGYLWEEGPNSFQPSDPMLTMAVDCGLKDDLVLGDPNAPRFVLWKGKLRPVPSKLTDLAFFDLMSIPGKLRAGFGAIGLRPSPPGHEESVEQFVRRNLGGEVFERLIEPFCSGVYAGDPSKLSMKAAFGKVWKLEETGGSIIGGTFKAIKERSSTPKAPRDPRLPKPKGQTVGSFRKGLRMLPDAISARLGSKLKLSWKLSSITKSEKGGYHLTYETPEGVVSLQSRSIVMTVPSYVASNILRPLSVAAADALSNFYYPPVGAVTISYPQEAIRDERLVDGELKGFGQLHPRTQGVETLGTIYSSSLFPNRAPKGRVLLLNYIGGAKNPEILSKTESQLVEVVDRDLRKMLIKPKAQDPLVVGVRVWPQAIPQFLVGHLDTLSTAKAAMNDNGLEGLFLGGNYVSGVALGRCVEGAYEVASEVTGFLSRYAYK

SEQ ID NO: 9607 - protein, 395 aa, Frankia sp. CcI3
MGITSGPMTARIVVFGATGYTGRLVTAELVAAGHRPVLAGRTETRVRALAAAYDGLETTVADAADVVDAADVVDAADGASLARLLGLGTGDVLVSTVGPFRRFGRPVVAAAAAVGAHYLDCSGEGAFLRHVFTEVGPRAAASGAALIPGAGFDFVPGNLAGALALQAAGGEARRLDVGYLVMGALGMSSGTRATLLAALTEPVIVLRGGVLVERPLAREVRSFRSSGKVTGGSGGRRGHPAVLWSGGEPFTLPRLAPALTDVATYIGGVDRGIRVGQALSFPLSGLRRFPPSRALLAAAARSALRTTGRGPDRAARARAGAQVFALARDAAGRELATVRLEGRDPYAFTARIMAWMAGHLAAGTVARAGALGPVDAFGVEDLERAAAAAGLRRVG

SEQ ID NO: 9608 - protein, 498 aa, Rhodobacter sphaeroides 2.4.1
MTLLTTEDYKAIAAGLTLPTGAFIDGRFRPAQSGATFETRNPATGQLLAEVAACGPADVDLAVQKARDAFEDGRWSRLPPRARKEVLIRLAKLLKRHARELAVMESLDSGKTIYDCETVDLPETIHCLTWHAELIDKIYDQTAPASDDHLALVLREPVGVVGLVLPWNFPLLMLAWKIGPALAAGCSVIVKPAEETPLTALRVAELATEAGVPPGVFNVLPGHGPEVGEPIGRHMDIDAVSFTGSTETGRRFLRYAAESNLKEVTLEMGGKNPAVVLDDAENLDRVAAHVVTGAFWNMGENCSAASRLIVQSGVKEALIARILAHAREWPMGDPLDPANRVGALVSPAHLDKVRSYLAEGPTVLLGGKAHGAFVEPTILEITDREAAPAREEIFGPVLSVLTVESFDEAIALANDTPYGLAASIFTANVKKALRGARALRAGTVTVNSFGEGDITTPFGGFRQSGFGGRDNGIHAHDQYTQLKTIWIDLADDAAEAVS

SEQ ID NO: 9609 - protein, 137 aa, Daucus carota
MGSKNSASVALFFTLNILFFALVSSTEKCPDPYKPKPKPTPKPTPTPYPSAGKCPRDALKLGVCADVLNLVHNVVIGSPPTLPCCSLLEGLVNLEAAVCLCTAIKANILGKNLNLPIALSLVLNNCGKQVPNGFECT

SEQ ID NO: 9610 - protein, 286 aa, Arabidopsis thaliana
  misc_feature (269)..(269): Xaa can be any naturally occurring amino acid
MEVERDQHKPPLSLQNNKIPSSQNFPVVDLSNTNGELVARKVAKASEEWGIFQVVNHGIPTELIRRLHKVDTQFFELPESKKEAVAKPANSKEIQGYEMDDVQGRRSHIFHNLYPSSSVNYAFWPKNPPEYREVTEEFAKHAKQLAEEILGLLSEGLARFTTAGYLMKINYYRPCPEPDWVMGIKAHTDFNGLTLLIPNEIFGLQVFKEDRWLDVDYIYPAVIIIIGDQIMKMSNGRYNNVLHRALMDKKKTRMSSVVHIKPPYDMVVXPFPELTSGDNPPKFEPL

SEQ ID NO: 9611 - protein, 872 aa, Frankia sp. CcI3
MRRVRAGSSGGARWLGAESGAHRRDSADCRSSGKVGSPPVHTGKRRPPLSAPVKAATGGNRSQTFGPGVRPTDEGVAGGFVDIATICPLETWTGGAVGEPILAIDYGTCSASAALAVDGRIEPVKEPASGSASWPASVFVDGGSLIVGTLAERRKRIWPAAYRGEVKRDLARDSAVSLDGRSYPAHVLVTAVLSALKAEAEQQLGGAALSRAVVTIPASYDPAGPLRRTMIAAAEAAGFVDVDLLAEPVAAAWSPVVGVAPEPGSLMLVYDLGGGTFEGALVAVGEDGRHEMLSHSALHDCGGRELDQILFDEILGLYGPGLEPLLNPPGIGETFQTTANRTRHELLDFARAVKHQLSDIAVVEDVFSPAGLLVSMQRDRFAQLASPILARTMACCQHLLKSSGYGPDKLSGVLLVGGSSRIPVVTDILEGRLGVGTDWPGQQIYLPADPELAVVLGAAAWASSVSTRRTTAARPNPVLQPARWDIPGGRATMVRWLVEPGERFDASAVLARVRLTDGSLFDLAAEAPGSLIHTHAAPGTPVRDADWLATTLPSGPVPMGSAVPADLRGFERSSRPSHHVEVTARATLKGHERDVTSAAFSPDGKLLATTSKDGTRLWDVATGRTSVTLSGRKSLVVHGCAFSSDGKLLATTGSDKTARIWDVDAARQTVTLTGHRGPVYGCAFSPDGSLLATTSTDRTVRLWGSSTGKNLATLNGHRGSVYGCAFSPDGRLLVTAGAESTLLWNVTVGEIIMSLPGHTNFAGGCAFSPDGRLLATSGNEGTRLTDASSGTTVLTLPGSAQSCAFSPDGHLLATASTDDTAQLWDVATGSAIATLTGHSSTVMSCAFAPYGLLLATTSTDMTARLWDIIYTP

SEQ ID NO: 9612 - protein, 110 aa, Peptostreptococcus anaerobius
VQGFGNVGAFTVKNIQKLGGKVVALAEWCKEVGPYAIFKEDGLDFQDMWDYRAEKGNLVDFPGAKMISMDEFWSSQVDVVVPAALENAITAEVAEKIQAKLVCEDANGPT

SEQ ID NO: 9613 - protein, 357 aa, Glycine max
MERENWREHINSNSNGNYYDRFVCDYDNGERSPAKPSSPPRLGYIEHHVSKFDTLAGVAIKYGVEVADIRKMNSLVTDHQMFALKTLHIPLPARHPPSPYLSNGSSTPGHGNSDHSPPNQAHHDLLDSFQSLRIKSSERKVSPAMNSLQGYYGLKGTPSPSEDGPFPRNLPMSDRPLSHHRKSRSLVNVILEEIMEKSDDALAAETREVGSNKWNDKLGLRHQKSVADFIRIPELLLREDNSSSGVLPSRTGKGLALRQKAANRTTATTDSEPIGLNPAALGMGDASLIDGSSGVRKSSSTSCLQDQDNSGSSSIWPTKMWNLKPDLQALSTAAIGKPIFDGFPKPITGRKNKAALD

SEQ ID NO: 9614 - protein, 110 aa, Peptoniphilus indolicus
VQGFGNVGQFTVKNIERQGGKVCAIAEWDRNEGNYALYNANGLDFKELAAYKAEHKTLIGFPGAERITEEEFWTKEYDIIVPAALENVITGERAKTINAKLICEGANGPT

SEQ ID NO: 9615 - protein, 476 aa, Leuconostoc mesenteroides subsp. mesenteroides ATCC 8293
MSESKTRTGWLHKATPASFTTSDRHLRKTLGVKEMLALGIGTIVSTAIFTLPGIVAANHAGPAVAISFVIAAIVSGLAAFAYAEFASALPFAGSAYSWANVVFGEVFGWIAGWALLAEYFIAVAFVASGWSANFKLFLGSHNLVLPKALAGSFAAGNGGVIDIASLFAVLIVAVLLWRGTNTTARVENVLVVGKVLVILIFIGVGLTAIHPGNYVPFIPAHKAGTDFGGWSGIFAGASQIFLAYIGFDSIAASSAEAKDPKKTMPRGIIGSLIVATILFVTVALVLVGMFHYTEYKDNAAPAAWALLHSGHEFTSNLLSVVALIGMFTAIIGMMLAGSRLLYAFGRDGLLPSFLGKVNDKGLPNNALLVLSVIAILIGSVFSFTELAGLISAGTLIAFIIVSLGIYALRPREGKDIQEPGFKMPFYPVMPALAALGSGFIFYELDNQAKIYAFGWFVVGIIIYAVYGSKHSKLSQK

SEQ ID NO: 9616 - protein, 110 aa, Peptoniphilus asaccharolyticus
VQGFGNVGTFTVKNIERQGGKVCAIAEWDRNEGNYALYNENGIDFKELLAYKEANKTLIGFPGAERITDEEFWTKEYDIIVPAALENVITGERAKTINAKLVCEDANGPT

SEQ ID NO: 9617 - protein, 1104 aa, Emericella nidulans
MPLLDGPRNGETVTASAHNGIPIIDGVDPSTLRGDIDQDPNRRQKIVVVGLGMVAVAFIEKLVKLDSERRKYDIVVIGEEPHIAYNRVGLSSYFEHRKIEDLYLNPKEWYGSFKDRSFDYYLNTRVTDVFPQHKTVKTSTGDIVSYDILVLATGSDAVLPTSTPGHDAKGIFVYRTISDLERLMEFAANHKGQTGVTVGGGLLGLEAAKAMTDLEDFGSVKLIDRNKWVLARQLDGDAGSLVTKKIRDLGLEVLHEKRVAKIHTDDDNNVTGILFEDGQELDCCCICFAIGIRPRDELGGSTGIQCAKRGGFVIDESLRTSVNDIYAIGECASWENQTFGIIAPGIEMADVLSFNLTNPDKEPKRFNRPDLSTKLKLLGVDVASFGDFFADRDGPKFLPGQRPSAESIGAADPNREEEPQVKALTYRDPFGGVYKKYLFTMDGKYLLGGMMIGDTKDYVKLNQMVKSQKPLEVPPSEFILGAQSGGEENADDLDDSTQICSCHNVTKGDVVESVKSGTCKTIADVKSCTKAGTGCGGCMPLVQSIFNKTMLDMGQEVSNNLCVHIPYSRADLYNVIAIRQLRTFDDVMKSAGKCPDSLGCEICKPAIASILSSLFNPHLMDKEYHELQETNDRFLANIQRNGTFSVVPRVPGGEITADKLIAIGQVAKKYNLYCKITGGQRIDMFGARKQDLLDIWTELVDAGMESGHRYAKSLRTVKSCVGTTWCRFGVGDSVGMAIRLEQRYKSIRAPHKFKGAVSGCVRECAEAQNKDFGLIATEKGFNIFVGGNGGAKPRHSELLAKDVPPEEVIPILDRYVIFYIRTADKLQRTARWLESLPGGIEYLKDVVLNDKLGIAAEMERQMQELVDSYFCEWTETVRNPKRRKYFQQFANTDETVENVEIVKEREQVRPTYWPKDGANEDFKGHQWSSLSWQPVIKADYFSDGPPAISSANIKRGDTQLAIFKVKGKYYATQQMCPHKRTFVLSDGLIGDDDNGKYWVSCPYHKRNFELNGEQAGRCQNDEAMNIATFPVEEREDGWIYMKLPPVEELDSVLGTEKWKVKKGEAVDPFEAYDKKYSGMKGKRAGAKGIEGSKPTRSPSNTIDW

SEQ ID NO: 9618 - protein, 444 aa, Leuconostoc mesenteroides subsp. mesenteroides ATCC 8293
MSKNKEILEEEKIHLANATRVKYFDIVIDHGKGAIITDADGHEYIDLLASASATNTGHSHPKVVEAITSQAQKLIQYTPAYFANTVTAKLADRLVNVAPGNFQKQVAFGNSGSDANDAIIKFARGYTGRQYVVSFTGAYHGSTYGSLSISGVSLNMTRKIGPLLPNTVKVPFPDQTQRIAGESDNDFSERLFKQFKLPFETYLPADEVALVIIEPIQGDGGIIKAPQHYVELVYEFTREHGIVFAVDEVNQGLGRTGKMWSIDHFGIAPDLMSVGKSIASGLPLSAVIGRKEIMDSLQAPANVYTTAGNPVTAAAALATLDVIEEENLVARSRQLGELAKAFFESAAKRYAFIGDVRLYGLNGGIDIINDHGEPDNEATNKLIYRIFELGAIMISLRGNTLRFQPPLVIQEEELQRAFEILEKAFSDLASGKIALPKTDNHIGW

SEQ ID NO: 9619 - protein, 425 aa, Medicago truncatula
MASAIVRRNIIRSNNLKRLSCWRLNNNKQLLNNVEDACTIYTEAVGGVGLPSYMRGAVFREPNKPLTIEEFHIPRPKAGELLIKTKGCGVCHSDLHVMKGEIPFSSPCVVGHEITGEVVEHGQHTDSKTIERLPIGSRVVGAFIMPCGNCSYCSKGHDDLCEAFFAYNRAKGTLYDGETRLFLRGSGNPIYMYSMGGLAEYCVVPANALAVLPNSMPYTESAILGCAVFTAYGAMAHAAEVRPGDTVAVIGTGGVGSSCLQIARAFGASDIIAVDVQDEKLEKAKTLGATHTINSAKEDPIEKILEITGGKGVDVAVEALGRPQTFAQCTQSVKDGGKAVMIGLAQAGSLGEVDINRLVRRKIKVIGSYGGRARQDLPKLIRLAETGIFDLGHAVTRKYTFEESGKAFQDLNEGKIVGRAVIEIV

SEQ ID NO: 9620 - protein, 505 aa, Glycine max
MAMANKEREKKFFFVGSLVNYAAELKLLLATLFLLCGVATLLQFLPSRFTISSSDLRFCISRVSLTPPPPSTPPPPFTSLSTPPTPLSSTQKHLPNGTIKRVFNPHGSAAYNFITMGAYRGGLNTFAIVGLSSKPLHVYGKPTYVCEWIPDLPSLQNSSKPIITKGLKYLPDWGYGHVYTVVVVNCTFNGTAVNGDNTGGKLVLHASTSGAGDTGFNVTDRIEVLHEAPGALNASLFMSKPKYDYFYCGSSLYGNLNPQRVREWIAYHVRFFGPKSHFVIHDAGGVHEEVLEVLKPWMELGFVTLQDIRDQERFDGYYHNQFMVVNDCLHRYKFMAKWMFFFDVDEYIYVPPKTTIKSVLHSLSEYDQFTIEQMPMSSKICLSEDYGKTYRKWGFEKLVYRDSITGIRRDRKYAVQPRSLYATGVHMSMDLSGKTTHKTEGRIKYFHYHGTISERRETCKILVNTTQVTQNKIPYVMDTTMRDTAGVIKKFELKMIGTRLQKTRQ

SEQ ID NO: 9621 - protein, 322 aa, Saccharum arundinaceum
MAPALSFPIIDMGLLGGEERPAAMELLRDACENWGFFEILNHGISTELMDEVEKLTKDHYKRVREQRFLEFASKTLKDAEGVKAENLDWESTFFVRHLPESNIAEIPDLDDEYRRVMKRFAGELEALAERLLDLLCENLGLDKGYLARAFRGPSKGTPTFGTKVSSYPPCPRPDLVNGLRAHTDAGGIILLFQDDRVGGLQLLKDGEWVDVPPMRHSIVVNLGDQLEVITNGRYKSVMHRVVAQPDGNRMSIASFYNPGSDAVIFPAPELVKVEEAAAETYPRFVFEDYMKLYVRHKFEAKEPRFEAFKSMETSSSNCIAIA

SEQ ID NO: 9622 - protein, 606 aa, Agrobacterium tumefaciens str. C58
MALRNIAIIAHVDHGKTTLVDELLKQSGSFRDNQRVAERVMDSNDLEKERGITILAKATSVEWKGVRINIVDTPGHADFGGEVERILSMVDGAIVLVDSSEGPMPQTKFVVSKALKVGLRPIVAINKIDRPDGRHEEVINEVFDLFANLDATDEQLDFPILYGSGRDGWMNVNPEGPKDQGLAPLLDLVLEHVPEPKVEEGPFRLIGTILEANPFLGRIITGRIASGSIKPNQAVKVLGQDGKLIETGRISKILAFRGIERTAIEEAHAGDIVAIAGLSKGTVADTFCDPSVTEAMTAQPIDPPTVTMSFIVNDSPLAGTEGDKVTSRVIRDRLFKEAEGNVALKIEEAEGKDSFFVSGRGELQLAVLIETMRREGFELAVSRPRVVMHKDENGTLLEPIEEVVIDVDEEHSGVVVQKMSERKAEMAELRPSGGNRVRLKFYAPTRGLIGYQSELLTDTRGTAIMNRLFHDYQPFKGQIAGRVNGVLLSNGSGEAVAYAMFNLEDRGPMIIEPGEKVYAGMIIGIHTRDNDLEVNVLKGKQLTNIRAAGKDEAVKLTPPIRMTLDRALSWIQEDELMEVTPKSIRLRKMFLDANDRKRFEKAKLAI

SEQ ID NO: 9623 - protein, 363 aa, Escherichia coli O6
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 9624 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKNVANHFDGKLNILVNNAGIVIYKEAKDYTMEDYSLIMSINFEAAYHLSVLAHPLLKASQRGNVVFISSISGASALPYEAVYGATKGAMDQLTRCLAFEWAKDNIRVNGVAPGVIASSMVEMTIQDPEQKENLDKLIDRCALHRMGEPKELAAVVAFLCFPAASYVTGQIIYVDGGFMANGGF

SEQ ID NO: 9625 - protein, 113 aa, Corynebacterium efficiens
MNILDKVDSAYLRDDVPAFRPGDTLDVHVKVIEGTNTRTQLFKGVVIRRQGSGIRETFTVRKVSFGIGVERTFPVHSPNLEKIEVVRRGDVRRAKLYYLRELRGKAARIKEKR

SEQ ID NO: 9626 - protein, 345 aa, Debaryomyces hansenii CBS767
MSADFWSSSQRNRWQLTRHSLLESRRKLLLLEKKMIQNGFIKDYPNVEYDANTRIYLHNLLIKLGRRLNVRQIALATAEIYMSRFLIKVLLKEINVYLLVTTCLYAACKIEECPQHIRLITSEARNLWPEYIPQDVTKLAEFEFYLIEEMDLFLVLHHPYRSLLQIRDYLNENFALYGFSLSDDELQNSWSLINDSYITDLHLLLPPHIIAIATIYITIVLKKNISSLRLGANSMSNDTVGMDPHTKPNSNSIHAEDLMALATGGSAINDIGNPSSGTNGFHDIELDENTIKINKFMTFLDHSHVNLNEVVEAIQDIITLYAIWNRYNEMSVKKVLQDMLLNRSV

SEQ ID NO: 9627 - protein, 558 aa, Sphingomonas paucimobilis
MAQGSDIEIAREAKMQNIAEVGAKVGIPQDALLNYGPYKAKLSWDFINSVQGNQDGKLILVTAINPTPAGEGKTTTTVGLADGLNRIGKKTVAALREPSLGPCFGVKGGAAGGGYAQVVPMEDINLHFTGDFHAITSANNLLAALIDNHIYWGNKLGLDPRRIAWRRVLDMNDRALRSIVNSLGGVSNGYPREDGFDITVASEVMAILCLSSDLKDLERRLGNIHAGYTRERKAVLASELNASGAMTVLLKDALQPNMVQTLENNPVLIHGGPFANIAHGCNSVLATKTALKIADYVVTEAGFGADLGAEKFFDIKCRKAGLKPSAAVIVATIRALKMHGGVDKADLGTANPEAVRKGGVNLARHIENVRQFGVPVVVAINQFITDTDEEMAMVKEIAEAAGAEAVLCSHWANGSAGTEELARKVVALAESGSSNFAPLYEDSMPLFEKIDTIAKRIYRATEATADSSVRNKLKGWEADGFGHLPVCMAKTQYSFSTDPALRGAPTDHVVPVRDVILSAGAEFIVAVCGDIMRMPGLPKVPSADFIKLDEQGQIQGLF

SEQ ID NO: 9628 - protein, 569 aa, Zea mays
IPGRTGRARAAVSVPPPAGEQVPTERLEPRVEERAGGYWVLKEKYRAGLNPQEKVKLEKEPMALFMEGGIQDLARVPMEQIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYVTNNSQGNPTITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFVGGRVGSDSHLADVYRKSVPCKDLVPIVADLLVERFGAVPREREEDEE

SEQ ID NO: 9629 - protein, 594 aa, Spinacia oleracea
MASLPVNKIIPSSTTLLSSSNNNRRRNNSSIRCQKAVSPAAETAAVSPSVDAARLEPRVEERDGFWVLKEEFRSGINPAEKVKIEKDPMKLFIEDGISDLATLSMEEVDKSKHNKDDIDVRLKWLGLFHRRKHHYGRFMMRLKLPNGVTTSEQTRYLASVIKKYGKDGCADVTTRQNWQIRGVVLPDVPEIIKGLESVGLTSLQSGMDNVRNPVGNPLAGIDPHEIVDTRPFTNLISQFVTANSRGNLSITNLPRKWNPCVIGSHDLYEHPHINDLAYMPATKNGKFGFNLLVGGFFSIKRCEEAIPLDAWVSAEDVVPVCKAMLEAFRDLGFRGNRQKCRMMWLIDELGMEAFRGEVEKRMPEQVLERASSEELVQKDWERREYLGVHPQKQQGLSFVGLHIPVGRLQADEMEELARIADVYGSGELRLTVEQNIIIPNVENSKIDSLLNEPLLKERYSPEPPILMKGLVACTGSQFCGQAIIETKARALKVTEEVQRLVSVTRPVRMHWTGCPNSCGQVQVADIGFMGCMTRDENGKPCEGADVFVGGRIGSDSHLGDIYKKAVPCKDLVPVVAEILINQFGAVPREREEAE

SEQ ID NO: 9630 - protein, 733 aa, Magnaporthe grisea 70-15
MPPRRSARAAAAAAPSASQPASQSASPLEDCVVAISGAFPNLTQAQTKDKITSLGGTVSPSVNNKTTHLITTEQDFLANTTKVKAATAKDILIVRYDWLSDCETKGKRLPEKQYDVSAKANAAQAVVQSQQSQAASKAKGTKKRAASVASDDESDKDKGKQPAKKRKAANGKANGKANGNADATKQESEDESEPAKAKPAKGKKAVKKEVEEEPKVDGQVAKSKDVHVPLDEGCLLSGYSVYIDSNGHIWDASLNQTNASNNNNKFYRLQVIRNAQGDFQTWTRWGRVGERGSTATLGSGTEESAISQFEKKFKDKSGLDWANRMAPPKPKKYTFIERSYNQDSDEEEEAAEEEEKDDKWVPPECTLEEPVQDLMKLIFNQQYFDAAMSSLNYDANKLPLGKLSKQTISRGFQALKELSALLDDSSIAATLYPDMTVQQAIEHLSNAYYSVIPHAFGRNRPPVIQESSLLKKEVELMESLSDMKDASNIMGKDKVGDPVHPLTKMYNGLNLREMTALEKDSNEYRLLKEYLNDSRGQTHGHNYTVREIFRIEREGEKERFEKQSPISDAGDRRLLWHGSRVTNYGGILSQGLRIAPPEAPVSGYMFGKGIYLADMSSKSANYCCSYISGNEALLLLCEAQLGDPMQELTDSDYNAGENAAEKGMYSTWGRGMTGPSKWKDAAGVHDSLKGVKMPDTSVKPGNTNYPNAWLQYNEYIVYDLAQVRLRYLLRVKM

SEQ ID NO: 9631 - protein, 263 aa, Brassica napus
MCGILAVLGCTDDSQAKRVRVLELSRRLRHRGPDWSGIYQHGDNYLAHERLAIVDPDSGDQPLFNEDKTIVVTVNGEIYNHEELRKDLKNHKFRTGSDCDVISHLYEEHGENFVDMLDGVFSFVLLDTRDNSFMVARDAIGVTSLYIGWGLDGSVWISSEMKGLHEDCEHFEVFPPGVLYSSKSGGFKQWYNPPWYNESVPSTPYEPLAVRHAFEAAVTKRLMSDVPFGVLLSGGLDSSLVASITARHMASTKAAKRWGSQPP

SEQ ID NO: 9632 - protein, 300 aa, Candidatus Protochlamydia amoebophila UWE25
MYLKGLYTALITPFTPTGQLDEEGLKKLIQIQLHHQVDGVVVLGTTGESPTLTQIEKRRIIEIALEEIQGRIKVIVGTGSYSTQQAIEQTLQAKQMGADAALIVTPYYNKPTQEGIFKHFEAINQAVSFPICLYNIQGRTGQNIQTHTLKRISTLSSIIGVKETSGDINQIMDVIEAFRQSHPNFAILSGDDALTLPMIALGGHGIISVVSNLVPAAMKSLVNAALNGNFKKARIIHNQLYSFIKAAFIETNPIPIKAALSLSKLPAGSCRLPLCDLSQNHSQKLAQILNELPQEWISHG

SEQ ID NO: 9633 - protein, 458 aa, Schizosaccharomyces pombe 972h-
MDFGLTNNSIKAFEDQKLLHIHQSCVSYPSDTLICSIPVSAKNVDLNIPFKNILWVDKTGPNSVTLSYVSRSSKVATKCWVDFVENSDQFCEYLLDVAYKGIKRSRRFIVFINPHGGKGKAKHIWESEAEPVFSSAHSICEVVLTRRKDHAKSIAKNLDVGSYDGILSVGGDGLFHEVINGLGERDDYLEAFKLPVCMIPGGSGNAFSYNATGQLKPALTALEILKGRPTSFDLMTFEQKGKKAYSFLTANYGIIADCDIGTENWRFMGENRAYLGFFLRLFQKPDWKCSIEMDVVSSDRTEIKHMYEKSKNLAPMSESSDSDKTVSTSPESHLLTFEINDLSIFCAGLLPYIAPDAKMFPAASNDDGLIDVVIVYSKQFRKSLLSMFTQLDNGGFYYSKHLNYYKVRSFRFTPVNTGKRHYFALDGESYPLEPFECRVAPKLGTTLSPVAGFQLLDI

SEQ ID NO: 9634 - protein, 511 aa, Bacillus clausii KSM-K16
MRIVTGEEMASIDAITMNKVGLPGAVLMENAGRGIARKLLDHYGRKRRFFIVIGSGNNGGDGFVVARVLKDEGAEVQVFIVPEESRYKGDAKLHKRVFEQSGYRWKYWKDIESQWPAMLYETDIIVDALLGTGISGQVKEPYASVIASINKLKNEIVSIDLPSGVPAGSAELNHEAIKADRTLTLQWTKVSYYLEETKPYYGEVDVVPIGIPPNTLRHLASQRYIWGKNEVVNSWVMSKPNAHKGDNGRVGIIAGSEAMPGAAALAGSAAVRSGAGFTTIATVAQNVPVIASHVKEAMYTIFSEKHGYLAPTETELAAFMDNKQSIAVGPGLGRTPALTKMVAYLLVHFKGVLILDADALHCLKECGPIVQERTAPTVITPHPGEMAMLIDQSVSYVNKNRFEVAESYAEQYGVYVVLKGPNTIVAEPSGCISVNVTGNAGLAKGGSGDVLTGMVAALVARQRIQPALSSAVFFHGYAADLLAKQRHVLATITPSDIIEHLPEAFSIVDDD

SEQ ID NO: 9635 - protein, 141 aa, Hordeum vulgare subsp. vulgare
MEYQGQTGRATDKVEEYGQPVAGHGGATGGPTGTHGAAAAAGTGQLQPTRDDHKTDGVLRRSGSSSSSSSEDDGVGGRRKKGMKEKIKEKLPGGAHKDAAGQQHTPAAGEYAGTGTHGAEATGEKKGVMDKIKEKLPGGQH

SEQ ID NO: 9636 - protein, 802 aa, Frankia sp. EAN1pec
MAVSVVPMIRPGSATPLGVWWDGEGVNVAVVAPGADAVDFCVFDGQDGSGGQDGSGATGRTGLGTGPAPGTDGGAETTSGGETRYRLPERDGGVWHGYIPGVGPGQAYGLRAHGPYAPGRGERYNPAKLLLDPYARRVTGSFVPHPAVHGYVAGDPYGQDPDNRDSAPYVPKGVVTGPVTRPPAGSVAGSAAGSVTGPDPAANRPRTAWADTILYELHVRGFTMLHPGVPERLRGTYAGLAHPAVVDHLLRIGVTAVELLPVHAHISETTLLENSRSNYWGYNTLAFFAPHPGYAATDDPVAEFRAMVAALHDAGIEVLLDVVYNHTAEGSERGPTLSLRGLDNIAYYRVEPTDPRRYRDVTGCGNTVDATSPHVVRLICDSLRYWVSEMGVDGFRFDLATALARSPDGFEPAAPLLTAIQADPLLSSVKLIAEPWDLGWGGYQVGAFPAPWAEWNGRFRDTLRDIFSDRTGSVADLGYRITGSSDIYEHSGRRPWASVNFVTAHDGFPLADLVSYNEKHNEANGEGNRDGESENRSSNHGAEGPTDDPKILTNRRRARRALISTLLLSAGVPMLLAGDELGRSQGGNNNAYCQDNAVSWLAWPNGTAGTPEAGGPGDGPASEVPASEVPAADPAGPDPALVTLVGGLSRLRRAAPVLRRQRFFRGGAPTPQRLPDITWFRQDGVVMSAADWNAPQVAILVAHLAGEGIEWTDAAGTPVTGESLLLVIHPEGEDRTVVLPGAPWATWYDLLLDTAADDLAGFPDTITEPRRTLAAGAQLDVAGRTVLILRALGGSDRSVAAE

SEQ ID NO: 9637 - protein, 381 aa, Oryza sativa (indica cultivar-group)
MAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRRASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDDINKALELMLENKCLRCVIHMPQ

SEQ ID NO: 9638 - protein, 110 aa, Peptoniphilus harei
VQGFGNVGSFTVKNIERQGGKVYALAEWDKKEGNYALYNENGLDFKKLLDYKNEHHTLIGYPDAKQISADDFWTGEWDILIPAALDNVISGDVAQKLNVKLVCEEANGPT

SEQ ID NO: 9639 - protein, 162 aa, Zea mays
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 9640 - protein, 795 aa, Kluyveromyces lactis NRRL Y-1140
MLPVVPVFNAVNALKEKTYLYLSSQLVLDGKDMTKDDILEFVQNSHGQNISVLLKDAKFEDDDLIVLLNNGVVTLFIDSDDYAAHLVEIGVPSIRLTLLKDGAYQFSFGQIQEIQQSQLVKASEISLETFTNSVLSGMKTDRPDGLYTTLVVDENERSLGLVYSNKESVSLAIETQTGIYFSRSRNEIWRKGATSGNVQKLLSIELDCDGDALKFVVRQGGSGSFCHLETESCFGNFRHGLYGLQKLLQERLLNAPEGSYTKRLFNDSDLLTAKIKEEAEELTEAVDKKDIAWECADLFYFAMARLVANGVSLEDVERNLNTKHLKITRRKGDAKPKFLKKEPVAVHEEDGKIVLNVVSASDKAAVEKAVTRPIQKTAEIMNLVNPIIENVIKNGDKALVELTAKFDGVQLETPVLEAPYPEEYLDGLTDELRDALDLSIENVKKFHAAQMQSETLDVETQPGVVCSRFPRPIEKVGLYIPGGTAILPSTALMLGVPAQVAGCKEIVFASPPRKSDGRVSPEVVYVASKVGASKIVLAGGAQAIAAMAYGTESVPKVDKILGPGNQFVTAAKMYVQNDTQALCSIDMPAGPSEVLVICDEEADVDFVASDLLSQAEHGIDSQVILVGVSLSDSKIEALQNAVHEQAMQLPRVDIVRKCIAHSSIILCDSYEEAFKMSNQYAPEHLILQISNAEDYVKDVDHAGSIFVGAYTPESCGDYSSGTNHTLPTYGYARQYSGVNTATFQKFITSQVVTPVGLEHIGHAVMSVAKVEGLDAHRNAVKIRMSKLGLLPSGFE

SEQ ID NO: 9641 - protein, 411 aa, Nicotiana plumbaginifolia
MNALAATNRNFKLASRLLGLDSKLEQCLLIPFREIKVECTIPKDDGSLATFIGFRVQHDNARGPMKGGIRYHPEVDPDEVNALAQLMTWKTRVANIPYGGAKGGIGCSPSDLSISELERLTRVFTQKIHDLIGVHTDVPAPDMGTNPQTMAWILDEYSKFHGYSPAVVTGKPIDLGGSLGRDAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNAKDIKAKFIVEAANHPTDPEADEILAKKGVVILPDIYANSGGVTVSYFEWVQNIQGFMWDEERVNTELKDYMNRGFKDVKDMCKTHNCDLRMGAFTLGVNRVARATTLRGWEA

SEQ ID NO: 9642 - protein, 279 aa, Rhodobacter sphaeroides 2.4.1
MTELTRIPLAGVIGSPIAHSRSPALHGYWLKRYGLKGHYIPMDVAQADLRDVLAAMPRMGFVGCNVTIPHKESVIGLADIVTDRAALIGAANTLIFGKDGKIHADNTDGTGFTANLRQNAPAWQPQSGPAVVWGAGGAARAVIAALIEVGVPEIRLANRSRARADALRSDFGAKVHVHDWVQAGNILEDAMTVVNTTSLGMVGKPEFRVPLDALNPKAVVTDLVYAPLRTRLLVEAEAAGCRTVDGLGMLLHQAAPGFERWFGVRPEVDEETRAAVLAT

SEQ ID NO: 9643 - protein, 638 aa, Magnaporthe grisea 70-15
MSWRNQGITGSNNIPLGKTRRFGGEAEPEDAQPSFNSGSNSAPSQPSYSGGFNGGDRDAKRGRSPEPRSEADGPKRRKKRNRWGDATDNKAAGLMGLPTAVMANMTAEQLEAYTLHLRIEEITQKLKIDDVVPADGDRSPSPAPQYDNQGRRVNTREYRYRKKLEDERHKLIEKAIKTIPNYHPPSDYRRPTKTQEKVYVPVNDYPEINFIGLLIGPRGNTLKKMESESGAKIAIRGKGSVKEGKGRSDAAHTSNQEEDLHCLIMADTEEKVNKAKKLIHNVIETAASIPEGQNELKRNQLRELAALNGTLRDDENQACQNCGQIGHRKWECPEKQNYTTNIICRVCGNAGHMARDCPDRQRGASWRNDGPGFRSAGRIGAGPTSGAEVVDQEYEALMQEINGGPGGAAPARIEAGPGGPPTGPSGGGDNARPWQRGPTGGAAPWRQRNNDRENNDDGPRGGGFGGGSGGPAPWARDRQNRQHEDRDRGDGDQPWRNRDRGDRDHRDRDRERDRDRDRGYNSHGGDNGYSAASASAPAPWSQPAGAPGYGAYPGYGSYGGPPGMGAPGMPAPPGLPGAPPGLPGAPGLNAPPGLPSDFNVSALIAQYSGGAPPPPPPSGDAPPPPPGDQSPPPPPPGA

SEQ ID NO: 9644 - protein, 446 aa, Agrobacterium tumefaciens str. C58
MREKCSAFDFLDMQTIFRLFDRPVVRCMERWDNVMSVMQAPAGLAVKAPLIANSDLMSGKPSLIGLTREEMGEALAEIGVPQKQVKMRVSQLWNWLYVRGVSDFDNMTNVAKELREKLKAAFTIARPEIVEEQISNDGTRKWLMRFPPRGAGRPVEIETVYIPEEGRGTLCISSQVGCSLTCSFCHTGTQRLVRNLTAEEILSQLLLARDRLGDFPDGSTPVGAYVPSEGRKVSNIVMMGMGEPLYNFEHVKTALLIATDGDGLSLSKRRVTLSTSGVVPEIFRTGDEIGVMLAISLHAVRDDLRDMLVPINKKYPLKELIEACRNYPGVSNARRITFEYVMLKDVNDSLEDAKMLVQLLKGVPAKINLIPFNPWPGTNYQCSEWAQIEKFADFINQAGYASPIRTPRGRDILAACGQLKSESERMRKTERLAFEAMMIANHGADD

SEQ ID NO: 9645 - protein, 400 aa, Cryptococcus neoformans var. neoformans B-3501A
MCSSHATAVESVSPAPRKSQYEVKYDPDLVLKSAEFKELKQGDKELEDPKANLACAYDEKHNVKMINKPIPKARQDEVVVHIKATGICGSDVHFWKHGQIGPTMIVTDTCGAGHESAGEVVEVGPGVEQWKVGDRVAIECGVPCGQASCGPCVTGRYNACPQVVFFSTPPYHGTLTRYHAHPASWLHRLPDNLSYEEGALCEPLAVALAALERAGNRLGDPVLICGAGPIGLVTLLASHAAGCTPIVITDLQASRLEVAKKLIPTVKTVQIERSWTSKETSEAIKEAAGTGIRVAIDATGFESSITAAIYSVVFGGKVFVIGAGPSEQKYPFGYCSANEIDLQFQYRYAHQYPKALRIVSGGLINLKPLLTHTFPLNKAVEAFHVAADPTKGAIKVQIID

SEQ ID NO: 9646 - protein, 554 aa, Methanococcus maripaludis S2
MPTINVNKVDLERLSNISLSDKLIEDRFPMMGVEVEEIFEEVDKNGKKQNMVQFSINPDRPDYLSVEGLARGFRGFMGITTGIQEFEVLDSDIKVTVEENETRPYVAFALVKNVLMDEFVLESMINLQEKLHWAIGRDRKKLAIGIHDFDKVKAPFTYKEIKGDEIKFVPLGYEDEEMTPREIIEKHEKGIKYAHLIQNDKFPIILDANGEVLSLPPIINGTLTKVTPTSKNLLIDITGTEKEAVEETLNIIVCALVERRGTIVSVNVNGKKYPDLTPKSRIISVESINKKLGLNLNPGEIIQALKKSGMDALYEDGNLIVKIPAYRNDILQNVDLKEEIAINYGYEKFDGKLPSVATTGSKDPVEKKCSAMSDLMIGLGFYEVMNLTLSNQDTLFEKMNLKVDEKDYIEVLKPASIEHRVLRTSILPLLLETLYINKHNALPQKIFEVGDCVVIDEEDTETDTKCKNIKKIAGAITHPLTNFNEIKSSTEALLREFFEGFEFENYEHPAFIPGRCAKILKSGKEVGFFGEIHPEVILNFELEHPVVGFEITIE

SEQ ID NO: 9647 - protein, 292 aa, Sinorhizobium meliloti
MFEGSITALVTPFADDRIDEVALHDLVEWQIEEGSFGLVPCGTTGESPTLSKSEHEQVVEITIKTANGRVPVIAGAGSNSTAEAIAFVRHAQNAGADGVLIVSPYYNKPTQEGIYQHFKAIDAASTIPIIVYNIPGRSAIEIHVETLARIFEDCPNVKGVKDATGNLLRPSLERMACGEDFNLLTGEDGTALGYMAHGGHGCISVTANVAPALCADFQQACLNGDFAAALKLQDRLMPLHRALFLETNPAGAKYALQRLGRMRGDLRLPLVTISPSFQEEIDDAMRHAGILL

SEQ ID NO: 9648 - protein, 373 aa, Methylobacillus flagellatus KT
MAKRDYYEVLGVNRDATDEEIKKAYRKLAMKYHPDRNPDNPKAEEHFKEAKEAYEVLSDDQKRAAYDQYGHAGVDPSAAAGAGAGGFGNFADAFGDIFGDIFGGGGGGRRSNVYRGADLRYNMEISLEEAARGTETKIRIPVMAECETCHGSGARPGTQPVTCSTCGGHGQVRMQQGFFSVQQTCPKCHGSGKMVKDPCPTCHGGGRVKQHKTLSVKIPAGVDEGDRIRLSGEGEAGVNGGPPGDLYVVVHLKKHPIFERDGANLHCEMPISFTTAALGGEIEIPTLDGHAKMKVPPETQTGAVFRLRGKGIKPLRSNEHGDLFCHVIVETPVKLTERQKELLRELEDINQQDSGKHSPREKSWMTKVKDFFQ

SEQ ID NO: 9649 - protein, 216 aa, Silicibacter pomeroyi DSS-3
MKLARPLPNYLVQRYHGWKATTYTENQVWYRRLASEGQRPRAMVISCCDSRVHVTSIFGADQGEFFIHRNVANLVPPYLPDGDHHGTSAAVEYAVTVLKVAHLIVLGHSQCGGVRGCLDMCKGHAPQLEAKESFVGRWMDILKPKYDHVAKIEDEDEQVRQLEKHAVVASLENLMTFPFIASAVEEGSLSLHGLWTDIGEGGLQCYEPGDERFVPV

SEQ ID NO: 9650 - protein, 528 aa, Synechococcus sp. WH 7805
MSQAPNEGQRQPAIVILDFGSQYSELIARRVRETEVFSVVLGYSTTAEELRRMAPKGIILSGGPSSVYAEHAPLCDPEIWNLGIPVLGVCYGMQLMVQQLGGRVVAATGKAEYGKAPLEVDDPTDLLTNVANGSTMWMSHGDSVEALPEGFVRLAHTANTPEAAVANHQRRLYGVQFHPEVVHSTCGMAMIRNFVYHICGCEPDWTTAAFIEEAVKQVRSQVGDKRVLLALSGGVDSSTLAFLLKKAIGDQLTCMFIDQGFMRKGEPEFLMDFFDRKFNIHVEYINARQRFLEKLKDITDPEQKRKIIGTEFIRVFEEESRRLGPFDYLAQGTLYPDVIESAGTNVDPKTGERVAVKIKSHHNVGGLPKDLQFKLVEPLRKLFKDEVRKVGRSLGLPEEIVRRHPFPGPGLAIRILGEVTAEKLNCLRDADLIVREEVKEAGLYHEIWQAFAVLLPVRSVGVMGDKRTYAWPIVLRCVSSEDGMTADWSRLPYDLMETISNRIVNEVKGVNRVVLDITSKPPGTIEWE

SEQ ID NO: 9651 - protein, 416 aa, Kluyveromyces lactis
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNNVIIGGGDTATVAKKYGVVDKISHVSTGGGASLELLEGKELPGVTFLSNKQ

SEQ ID NO: 9652 - protein, 400 aa, Oryza sativa (indica cultivar-group)
MATAQVLFHRFYCKKSFVRFSVKRVAASCVWLAGKLEESPRRSKHIIIVFHRMECRRENVPIEHLDVLSKKYSDLKHDLVRTERHLLKEMGFICHVEHPHKFISNYLATLEAPELTQEAWNLANDSLRTTLCVRFKSEVVACGVVYAAARRHGVPLPEDPPWWNVFDADEAGIQEVCRVLAHLYSLPKSQYIQVYKDNDSFTHRRTSDTNASKESPATTVASDKGTPVPSSSSQEKDALIKAESDNVKEKCDDDGKTLPSEPNGKEGPAVNLKSEKSESNVDRSRERERDRSRGRDRDSRGRDSDRDSKGRDSDRERERDREADRDRQRRHHSKDRSSGIAIDYSALALFISMLRFPDVAWCPSNAGYSDKEKSRHRSSRDRGDHYSSHSSRDKDRHRRQ

SEQ ID NO: 9653 - protein, 110 aa, Clostridium lituseburense
VSGFGNVGSNTAKHLERMSGNILSISEYDKEKGVYTIYNENGFNISELISHFEKYNTLYNYKNAKHISIDQFYSLDVDVIIPCALENSITEDEAQKIRAKLIVEGANGPT

SEQ ID NO: 9654 - protein, 263 aa, Triticum aestivum
  misc_feature (255)..(255): Xaa can be any naturally occurring amino acid
HYRTSLYKKAGWYRSGIPGISSTHASADIGPRRYMEDEHIRIDDLSAHLGSLLVCPLPSAFYGVFDGHGGPDAAAYMKRHAMRFLFEDREFPQALQVDDVFLQSVEECIRSAFLQADLALADNLDISRSSGTTALAALVFGRQLLVANTGDCRAVLCRRGIAMEMSRDHRANYAEECERVAASGGYIEDGYLNGVLSLTRALGDWDMKVPDCSTSPLIAEPEFQQATLSEDDEFLIMGCDGIWDVMTSQHAVSVXRRGLRKHD

SEQ ID NO: 9655 - protein, 255 aa, Hordeum vulgare subsp. vulgare
MEDERSTQSYQGAEADQVEATDRGLLGNLLGKKKEEEDKKKEEELVTGMEKVSVEEPEVKEDGEKKETLFSKLHRSSSSSSSSSDEEEEEEVIDENGEVIKRKKKKGLKGKLKEKLPGHKDNEAEHVTGLPAPMAPASVQTHHDTDVVVEKIDGDAKTEATPAVPEEEKKGFLEKIKEKLPGGHKKPEDAAAVPATHAAPAPVHAPAPAAEEVSSPDAKEKKGLLGKIMDKLPGYHKTEEEDKAAAPSGEHKPRA

SEQ ID NO: 9656 - protein, 146 aa, Hordeum vulgare subsp. vulgare
MEFQGQHDNPANRVDEYGNPFPLAGGMGGAHAAPGTGGQFQARREEHKTRGILHRSGSSSSSSSSEDDGMGGRRKKGMKEKIKEKLPGGHKDNQQHMATGTGTGGAYGPGTGTGGAYGQQGHAGMAGTGEKKGIMDKIKEKLPGQH

SEQ ID NO: 9657 - protein, 330 aa, Coccidioides immitis RS
MGTVETAVPQTIPTIDISPFLWQDATEEAVQDVVEAVRRACTTYGFFYLTGHGVSTREQNKALSCSKRFFELPMEERMKVAISKSVGKSFRGYEPPGIQVHQEGLLPDTKEAFIIGAEIPEDDPDCGSFSRGPNLWPDAIPESEFRTPIMEYQSTMVNLVKVLLKILARGLPAAWNCPPDVFDKFAENPSIPMRLLHYAPQPVKHENQFGVGDHTDFGGIAILLQEPNTEGLEVWYPPTKTWIPVPVKENSYVINIGDMLQKWTAGYYRSARHRVINSSVNHRYSVPFFLNGNLKLKTVALDGSGIETVVGEHIRQRLINTMGESGRVLA

SEQ ID NO: 9658 - protein, 465 aa, Schizosaccharomyces pombe 972h-
MAPSEKKLTEDKKNSSLNKKIETSNSSSEKSSENNNGDSQNNEAPKTFKELGVIDELCEACEKLGFKTPTPIQQEAIPVVLNKRDVIGLAQTGSGKTAAFALPVIQELWNNPSPFFAVVLAPTRELAYQISEQFEAIGGSIGVRSVVIVGGMDMVTQAVALSKKPHVLVCTPGRLMDHLENTKGFSLKNLKYLIMDEADRLLDMDFGPIIDKILKIIPHERRTLLFSATMTSKVEKLQRASLHQPVRVAVSSKFSTVDTLIQRYLFFPFKHKDTYLVYLVNELAGNSIIIFARTVNDTQRLAILLRTLGFSAIPLHGQLSQSNRLGALNKFKSGARSTLVATDVAARGLDIPLVDVVINYDIPTDSKAYIHRVGRTARAGRAGKSIALVTQYDLEPFLRIEATIGKKMQEYEIDKEGVFLLSERVGEAQREAIIQMKEIHDRRKSKGKLHTKRKRDDLDREEQIY

SEQ ID NO: 9659 - protein, 316 aa, Buchnera aphidicola str. APS (Acyrthosiphon pisum)
MNQLSALKQFSIIVADTSDIKSICKYQPEDATTNPSLILQAVSSNTNQNFVDQAVQYAKKKGGLYKDQIINASDKILVDLGIEILKKIPGYISSEVDARLSFSTEASILKAKKIIDLYEEQGISRNRVLIKLAATWECIKAAEELKKDSILCNLTLLFSFAQARACAESNVFLISPFVGRIYDWYISQNLLSKSFLGKDPGVISVCKIYEYYKKYGYKTIIMGASFRNIQQILYLSGCDRLTISPVLLKELESNTAKIDRNLAPPSFISVPPVALSEEEFRWEHNQDAMAVQKLSDGIRNFGKDQLRLEKIFSKKI

SEQ ID NO: 9660 - protein, 151 aa, Oryza sativa (indica cultivar-group)
MDPYAILKCRSQEQRSSIASVLWCIADEWNDLTVKIIPKECIAMCNFCYVDCGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 9661 - protein, 665 aa, Buchnera aphidicola str. APS (Acyrthosiphon pisum)
MYSRKELANAIRMLSIDAVQNAQSGHPGMPMGMADIAEVLWRSFLKHNPANPNWNDRDRFILSNGHGSMLLYSLLHLTGYNLPIEELKKFRQLNSKTPGHPETGETPGVETTTGPLGQGLANAVGMAIAERTLSSYFNRPGYDIINHYTWVFVGDGCLMEGISHEVCSLAGTLNLGKLIVFYDKNGISIDGKTAHWFTDDTAKRFESYNWHVLDNIDGHDSESIERSIKQAKLITNQPSIIICNTIIGFGSPNKSGTAESHGAPLGEVEISLIREQLKWNYPPFQIPKEIYKKWNFIEEGSKLEKKWNEKFSLYQSKYPDLSTEYLRRINKKLPVEWDRVTNNYISFLQKNRQSIASRKASQNTLEKYAMILPELIGGSADLSPSNLTMWSRCNSIKDNLSGNYIHYGVREFGMTAIANGISHHGGFIPYTATFLMFVEYARNAVRMAALMCTKHIFVYTHDSIGLGEDGPTHQPVEQLSSLRITPNIDVWRPSDQVETAVAWKKAIEKTSGPTALILSRQNLDQFERSSEQLENISYGAYILYDSKKRLDIIFISTGSELNVTLIAAKKLASLGYSVRVVSMPCTSVFDRQDASYKEFVLPTYVAKRVAVEASIEDFWYKYVGINGVIIGMKTFGESAPAEDLFKKFGFTVQNIFNKSLILLKS

SEQ ID NO: 9662 - protein, 298 aa, Xanthomonas axonopodis pv. citri str. 306
MDSQTDEPLDEARADRIDWLRAVPFIALHLACLAVFWVGASWFAVGMAVALYALRMFALTGFYHRYFSHRAFKTSRVLQFVFAAIGATCVQRGPLWWAAHHRNHHRHTDTGRDPHSPAQHGFWWSHTGWFLTPRNFRTDWEVIPDLRRFAELRFLDRFDIVMPVLLALGLYLLGDWLAVAAPALKTSGAQLLVWGFVISTVALFHATFTINSLAHRFGSRRFDTRDDSRNNWLLALLTFGEGWHNNHHFFPGSARQGLRWWEYDMTWYGLTAMSWVGLVWDLKPMPKLLTQRAERVKR

SEQ ID NO: 9663 - protein, 679 aa, Oryza sativa (japonica cultivar-group)
MATLARRSMVALGRRALCSGSDLEAAAREVVCSGAGSLDEVGGALDRLGVAVSPAMVARVIDACSERMGSGRRLLRFLSWCRSKDAGGIGDEALDSAIAALARMGDLTAMRIAVADAEKDGRRMSPETFTVVVEALVKLGKEDEAVRLFRGLERQRLLPRRDAGDGGEGVWSSSLAMVQALCMKGHAREAQGVVWHHKSELSVEPMVSIVQRSLLHGWCVHGNAKEARRVLDDIKSSCTPLGLPSFNDYLHCLCHRNLKFNPSALVTEAMDVLSEMRSYGVTPDASSLNILLSCLGRARRVKESYRILYLMREGKAGCSPDWVSYYLVVRVLYLTGRIIRGKRLVDDMLESGVLPTAKFFHGLIGVLCGTEKVDHGLDMFRLMKRCQLVDTHTYDLLIEKLCRNGRFENGKELWDDAKKNGFMLGCSEDLLDPLKTEEQQQDFGVLLKQGAEGRVFVSTFVGRKCVIKERFSKKYRHPLLDSKLTLKRLNAEARCMTKARKLGVPTPVLYAVDPLLHTLTFEYVDGLSVKDILLGFGSNGINEEQLIDIATQIGNAVGKLHDGGLVHGDLTTSNMIIKNNTNQLVLIDFGLSFISTIPEDKAVDLYVLERALISMHSSCGDVMEKILTAYRKASKQWCATTNKLAQACASIGKCDLTLTLTAVNGTRPTCVWAVLGPAG

SEQ ID NO: 9664 - protein, 294 aa, Buchnera aphidicola str. APS (Acyrthosiphon pisum)
MFKGSIVALITPMDEKGQICRISLEKLINYHVASKTEAIVSIGTTGESATLSQEEHINIVMLTLELADGRIPVIAGTGANATTEAISLTKRFEKSGVAGCLSVTPYYNRPTQEGLYQHFKAISENTELPQILYNVPSRTGCDLLPETVAKLSHFNNIIGIKEATGDLSRIHKIKELVKTNFLLISGDDATALDFMQLGGQGVISVTANIAAKEMMEICSYALKGDFINARSINKRLMLLHEALFIEPNPIPVKWLAKKIGLIKSDTLRLPMTPVLDSTRFQLEKAIQYANLKIS

SEQ ID NO: 9665 - protein, 1411 aa, Arabidopsis thaliana
MKAVAFPAKIANLSFPSNCCSLFFRSPATFLSPALPCRKLTKGIRGLEGLMSQCLSSSSQSLSFSSNSFSSQPESELLQALPSSKPKSPPLQLPWLIVGLGNPGKKYQGTRHNVGFEMVDALADAEGISMNTVNFKALFGKGVIGNIPIMLAKPQTFMNLSGESVGQIVSFYKIPLKQVLVVYDDLDLPFGKLRLLPKGGHGGHNGYNAFHSLSGLMRSIIDRLKGSRDFPRLRIGIGRPPGKMDTANFVLRQFNRQEQEELDHTFQTGLEAIRILLLEGFNKSATFVNTRKSMEQLTMYGGDEVSAIVVDLGSHTCKAGYAGEDAPKAVFPSVIGAVDGVEAMDVDVDSTKTNSNSEDSKTESEKEKSKRKLYVGSQAMSYRRDHMEVLSPIKDGIVSDWDLVDNIWEHAFNCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSESVKTLTYESLNNIARCINGFSALLLTLLPGKSNVLEGLHGWELRPTLRGPRLPRWMHNGVSSFNHFIHELSVDSDTSSLDYSSGDDDSDGMSTPPSPLSQSSLRSWASLPANYESHWTDWITFIVWWALLPARILLWVPLYLLRLLARRNSRMQPLSPGRYQHSSRPCFSKAISGKEHDVPNRTTDKRRGVIEDLQLGIEIFIETIFDFFHKAAHLLLSPSETFGIVLSWFSSSSHSSKGNYGDVSDDEIIQTAILGDNDSSLTERRTTTSLYNTDTRTCQDVITELGYPYEAIRVVTSDGYGLLLERIPRRDARKAVYLQHGVMDSSMGWVSNGVVGSPAFAAYDQGYDVFLGNFRGLVSRDHVKKNISSKDFWRYSINEHATEDIPAMIEKIHEIKTSELKLYQPTMEEVVNEDQPYKLCVVSHSLGGAAVLMYVITRKIEEKPHRLSRLILLSPAGFHYDSNMCFTLMEYTFLFLGPVLSRIVPAFYIPTKFFRMLLNKLARDFHNYPAVGGLVQTLMSYVVGGDSSNWVGVMGLPHYNMNDMPGISFRVAQHLAQIKHSGKFKMFDYGSSSANMDVYGSPEPLDLGEFYGLIDVPVDLVAGKKDKVIRPSMVRKHYRVMRDSGVDVSYNEFEYAHLDFTFSHREELLAYVMSRLLLVEPTQTQTVHKKGMKLKKKMETGKPHL

SEQ ID NO: 9666 - protein, 371 aa, Rubrobacter xylanophilus DSM 9941
MPKKSVGLSGAIAGDTAICTVGSSGDSLEYRGYPIEELAERATFEEVMHLLIRGELPDRRQLEEYTGRLSGMRKIPQELRDVLERIPASTHPMEVLRTGCSMLGTLEHEGEGRDAREIGERLISCLPSVLLYWHHFAGSGKRIETDTGEHSLAGHFLRLLHGREPGEEERRAVDVSLILYAEHEFNASTFTARIIASTGSDFYSAITGAIGALRGPLHGGANEAAMAFIERFRSAEEAERGLREALSRGERLMGFGHPVYTRVDPRSDIIKGWSRRLSEGHEEGYLYEVSERIERILHEEKNLFPNLDFYSASAYRFCGIPTEMFTPLFVFSRTSGWTAHVIEQRESGKIIRPSANYTGPERRPFVPLEER

SEQ ID NO: 9667 - protein, 494 aa, Paxillus involutus
  misc_feature (141)..(141): Xaa can be any naturally occurring amino acid
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTXVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 9668 - protein, 381 aa, Cryptococcus neoformans var. neoformans B-3501A
MPIATETYPIPPFDRPVPTTEDLDWADLTELPLDLFYDPKGRAQLVESVKHALEVDDLGFWSVTNAGFSDEEIDHQFAIAQAFFNLPIEERKSNAIDAKNGGYLGYRAPYERTIADTDVLDNMELVNIPKYTDDYKDYPRHDIFKSHETVIADFHRKCWQQIAKPLFVLFALAMELPENYFVERHEYNKPSQDHLRYMQYHPRTPEDDAKCNNLWSWAHTDYGSLTLLFSQTVSGLQVKFSDGTYHDIKYKKGSVIVNIADTLSFMTKGYLRSTIHRVTVPPGIQSSIHRIGVLYGCRPNDNVPVITAPSPLLERLGLISDADRNAKEEDAVTAGEYVAARVKAVHGSNTYGTAPGTKFTHKNLEVLENFADTSSGKKGAI

SEQ ID NO: 9669 - protein, 331 aa, Rubrobacter xylanophilus DSM 9941
MTEVAGARELGREQLLDAYRTMRTIREFEERLHVEFATGEIPGFVHLYAGEEAIAAGVCAHLDEDDYIASTHRGHGHAIAKGCDVKAMMKEIYGKAEGICHGKGGSMHIADLDKGMLGANGIVGGGPPLVCGAGLSAKVRGTRQVAVSFTGDGGSNQGTFLESLNLAAVWGLPCVFVVENNGYAEATSTNFSVRGLDIAKRADGFGIPGVVVDGHDFFAVHEAAGEAVERARNGGGPTLIECKVNRYYGHFEGDAQTYRAPNEVEEIRREKDCLMLFRRRVVSAGLVEEEELDRIDDEVRNLIDEAVEEAKAAPDPSPEELLTDVYVSYQG

SEQ ID NO: 9670 - protein, 494 aa, Paxillus involutus
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 9671 - protein, 339 aa, Rubrobacter xylanophilus DSM 9941
MARRITFMQAINEALRQEMERDETVVVFGEDNAGGAGAPGEDDAWGGVMGVTKGLYPSFPGRVLDTPISESAFIGAAAGAACSGLRPVAELMFVDFMGVCFDQIFNQAAKFRYMFGGKAKTPMVIRTMYGAGIRAASQHSQSLYPIFTHIPGLKVVVPSNPYDAKGLMIASIRDDDPVIFFENKVLYQMEGEVPEEPYAIPLGEAEYVREGEDVTIVAIGRMVSMAEQAAEALADEGIECEIIDPRTTSPLDTETVFESVENTGRLVVVDESNPRCSLAADICALVAQERFEDLKAAPKMVTAPHTPPPFSPALEDLYVPDPERIAAAVREVAGAGARA

SEQ ID NO: 9672 - protein, 494 aa, Paxillus involutus
  misc_feature (314)..(314): Xaa can be any naturally occurring amino acid
KLQQIYDAEHPRLILKELFSQDPHRFAKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGXWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 9673 - protein, 524 aa, Medicago truncatula
MASSTLSTPSPNLLKHQNRPSSTTSSRRSSTFLPPIRSSVSEKPPFQVSISQPQTTKLPIRKIPGDYGIPFIQPYKDRLDYFYNQGRDEYFKSRIQKYQSTIFRTNVPPGPFIAQNPNVVVLLDGKSFPVLFDASKIDKTDVFTGTYTPSTELTGGYRVLSYLDPSEPKHEQLKKLMFFLLKSRSRHVIPEFQSCYREFFNALENQLAENGHASFADNNDQAAFNFLNRALFGVNPVDTELGLDGPKMVQKWVLFQLGPVLKLGLPKFVEDSMIHNFRLPFRLIKKDYQRLYDFFYASSGFALEEAERLDVSKEEACHNLLFATCFNSFGGMKLFFPNLMKWIGRGGVRLHTKLATEIREAVRSAGGEITMAAMENMPLMKSVVYEAFRIDPPVPLQFGRAKRDMVIENHENGFLVKKGELLLGYQPFATKDPKIFERAEEFVADRFVGDEGEKLLKHVLWSNGPESQSPTVGNKQCAGKDFTTLISRLLVVELFLRYDSFEIQVGNSPLGPSITLTSLKRSSF

SEQ ID NO: 9674 - protein, 482 aa, Medicago truncatula
MASSSETSSTNLPLKPIPGSYGLPIIGPLHDRHDYFYNQGRDKYFQTRIEKYNSTVLKLNMPPGGFIAPDPKVIALLDGASFPILFDNAKVEKRDVLDGTFMPSTDFFGGYRTCAFQDTAEPSHSLLKRFIFHILSSKHDTFIPLFQTNLTEHFTDLEKELAGKHQKASFNTSIGGITFNFLFKLITDKNPSETKIGDSGPTLVQTWLAAQLAPLATAGLPKIFNYLEDVLIRTIPIPAWTVKSSYNKLYEGLMEAGTTVLDEAEKMGIKREEACHNLVFTLGFNAFGGLTNQFPILIKWVGLAGADLHKKLADEIRAIVREEGGVNLYALDKMTLTKSTVYEALRIEPAVPYQYAKAREDLVVQSHDASFEIKKGEMIFGYQPFATKDAKIFDKPEDFIAERFIGDGEKLLKHVFWSNGRETDEATPDNKICPAKNLVVLLCRLYLVEFFLNYDTFTFDFKPSVLGPTITIKSLVKASSTV

SEQ ID NO: 9675 - protein, 788 aa, Rhodobacter sphaeroides 2.4.1
MQAELKAIEQRLLWLSHWMIHHANHIRPKVDGIKVGGHQASSASMVSILTALYFSALRPEDRVAVKPHAGPLFHAMQYLMGNLDRAKMENFRGYGGVQSYPSRTKDTDDVDFSTGSVGLGVAITAFASLIQDYVRAKPWGADVAPGRMIALMGDAELDEGNIHECLQEGWKHGLRNCWWIVDYNRQSLDGVVQEGLWSRIEGLFTAFGWEVVRLKHGVLQRAAFAEPGGERLRAWIDSCPNDLYSALTYEGGAVWRAQLMEDLGDQGEVNALIGRRSDEELALLMENLGGNCVDTMAEAFAAVDHDRPTCFLAYTVKGWGTPIAGHKDNHGGLMTKAQMADWQRRMGVPEGQEWEPFAGVADPEALRRFLRSVPFFAAGPRRMTDAPLAVPPIALTSEREISTQAAFGKILDELARGDSPLAARIVTTSPDVTGTTGLGPWVNRRGLFARAARADRFRERRIASTAKWDAGPEGQHIELGIAEMNLFLTLGAAGLSHALFGRRLIPVGTVYDPFVCRGLDALNYACYQDARFLIAGTPSGVTLAPEGGAHQSISTPLIGMAQDGLAAFEPAFVDELSVIMEWAFDYLQRDGHEGRDPRTWLRDATGGSVYLRLTTNPLEQPGRRHDDAFRQGAVDGGYWLRPPGSNCEVVIAYQGAVAPEAIRAAGQMAEARRDVGVLAVTSADRLNAGWTAAQRARALGETGASALVERLLADVPRDCLIVTVIDGHPATLAWLGGVRGHRTLSLGVEHFGQTGTIGDLYRHFGIDARSIVERVSGLTEGRRIPARA

SEQ ID NO: 9676 - protein, 417 aa, Oryza sativa (japonica cultivar-group)
MEEGAKIGREHEQQQQQHGRVNGSGRVAAVGGGSGGGGDEIEIEVAAAAGASPSRQHGGLHGDVQAPTWKRFLAHVGPGFVISIAYLDPSNLQTDLVAGSSHRYSLLWVLLFGFIFVLTVQSLAANLGIITGRHLAELCMGEYPKYVKYCLWLLAELGVIAATIPGVLGTALAYNMLLHIPFWAGVLACGACTFLILGLQGYGARKMEFTISVLMLVMATCFFMELGKVNPPAGGVIEGLFIPRPKGDYSTSDAVAMFGSLVVPHNLFLHSSLVLTRKMPYTSKGRKDASTFFLLENALALFIALLVNVAIVSISGTICANNLSFADTSTCSSLTLNSTYVLLKNILGKSSSTVYGVALLVSGQSCMVATSYAGQYIMQIVLSFVLPFALIPLIKFSSSCTNIGPYKNATSSFWTRS

SEQ ID NO: 9677 - protein, 728 aa, Oryza sativa (japonica cultivar-group)
MDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 9678 - protein, 187 aa, Brassica napus
  misc_feature (171)..(171): Xaa can be any naturally occurring amino acid
MTTKGEKRIVSEEDKIFAKNFNIMDHPDIPTGLPPHLQLQRTRVLCKNDAPIHTASVGYSGAYNAVGVDNSVKLENFSENFKVDVIEIPKDGMELTFDMIGIDAAIANAFRRILLAELPTMAFEKVFIANNTSIVQDEVLAQRMGLVPIAADPKLFEYLSENDQPNEKNTXVFKLHAKCAKGEDVEV

SEQ ID NO: 9679 - protein, 440 aa, Streptococcus pyogenes MGAS8232
MADNWKKSTRGKALLVIEAIFDQGAYTNIALNQQLSNKALSAKDRALLTEIVYGTVSRKISLEWYLAHYVKDRDKLDKWVYYLLMLSLYQLIYLDKLPAHAIVNDAVGIAKNRGNKKGAEKFVNAILRQFTSHPLPDMETIKRRNKYYSVKYSLPVWLVKKLEDQFGSDRAVAIMESLFVRSKASIRVTDPLKLEEVAEALDAERSLLSATGLTKASGHFAASDYFTNGDITIQDESSQLVAPTLNIDGDDIILDACSAPGGKTSHIASYLKTGKVIALDLYDHKLELVKENANRLGVADNIETRKLDAREVHRHFEKDSFDKILVDAPCSGIGLIRRKPDIKYNKESQDFNALQAIQLEILSSVCQTLRKGGIITYSTCTIFDEENRQVIEAFLQSHPNFEQVKLNHTQADIIKDGYLIITPEQYQTDGFFIGQVRRVL

SEQ ID NO: 9680 - protein, 404 aa, Tropheryma whipplei str. Twist
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRITGRMIHSSFELAELVLSETLVATVPGEAFGTKGHLRLSYALDETSLLEGTGRLVEFFDTANSDMTKVF

SEQ ID NO: 9681 - protein, 411 aa, Schizosaccharomyces pombe 972h-
MVHKKKNVDIPSSQKYLGIQHVNFYSNAFGKESLRFQLRELILPIVRKETRLLYKIQSFFRNPWLDVYFMYTATLGTHVFFMLALPIFFWSGCIYYTLDITQLFAAGVYFSGCIKDYFCLPRPRSPPMVRLTLSSDAEYEYGFPSTHTTNAMATGFYSLFLLLSMSDSMSSISYYFLLSLVLLYIASISLGRIYCGMHGFMDVSTGTILGVTLAIFQWKYADFFHNVWSSSSTSVPILSVVLALFFIWFHPQPAERCICLEDSISFISVIMGIDLGTWFASPESLSHLHDNLNSYFLLKFFVRVLFGVCMILIWKSFAKQALLAVLPPIFKSLRLSYLEPKSQSEKGIRAATGSNHSPGNIGTELGVITSHQSHPHPVRFDIETIARIIVYSGIGFLCTYFAPKVFLKWKI

SEQ ID NO: 9682 - protein, 463 aa, Candida glabrata CBS 138
MPNLSHQWESVSLKEAYARNLPAQAERLKRFKSEFGSTVIGEVTVEQALGGMRGVTGLVWEGSVLDPEEGIKFRGLTIDEVRVSLGVAGEREPQPEALFWLLLTGQIPNEDQVAQLSRELAARGELPGHVETLLDTLPRDLHPMAQLSIAVTALEGESHFARAYLAGVPRGELWEHTYEDALNLIAKLPAIAGRIYHNVFGGAQGAQGQGTQGAFVLDPQADYSENLCRALGVQPDGETEDFHNLMRLYLTIHADHEGGNVSAHTTHLVGSALSSPYLSFAAGLDGLAGPLHGRANQEVLEWLLVLKGELVREGKTVTDREAIRQYLWRTLNSGKVVPGYGHAVLRKTDPRFLAQREFGRTRFPGDELYQLVSTVYEVAPQVLKEHGKTRNPYPNVDAHSGVLLTHYGLDQPSFYTVLFGISRCFGVMAQLITDRALGAPIERPKSLSTDRYIELATRHHNKL

SEQ ID NO: 9683 - protein, 496 aa, Oryza sativa (indica cultivar-group)
MGVHSALSVQCISFPTCRLCRRLNHTDQRHIQQAKSVRVGVADTTTQAQAQALHRLVSRGSPRPAVPCRGEPSISAAPSKHHPKAVQFARPVSHLLCLPLTPYYECPVATTAHKHTRTRRGCLLSLPAFPLLCSPLPARALGSCIAPPSTEMVAAAEWWEATIAAYTGLSPAAFFTAVAVAAALYVAVSGLLTRRPPPLPRRQEEARASQPLPPPVQLGEVTEEELRVYDGSDPNKPLLMAIKGQIYDVTQSRMFYGPGGPYALFAGRDASRALAKMSFELDDLTGDVSGLGPIELEALHEWEGKFMSKYVKVGTIKKIIPVSEGDAATHGGTSDRGIDVGTIESNRVPEPEENGATSHADAVEKSDADVSTHSHEDVVEKSDELLESGVDTRSTHEDAVGKPKEETEDADVQKTISTEVAGEGKGAPDEDERNTCSLEDAIEKPKETAYIDVKDTSGHEVAGEPKEAPDVDGNNTSSNQDAVDEPKEASHEAKEA

SEQ ID NO: 9684 - protein, 620 aa, Kluyveromyces lactis NRRL Y-1140
MTGATGSSNSDFISPVGSDVKHNDKSDTIIQSEGFPSIEGEAEYYEKTFSQSDEEYAAKSSVWHRFKDSFKRADHINTNIHGNAELELNPSQSLLPEKGASLKRDIKPRHVVMMSLATGIGTGLLVGNGKALATGGPAGLTIGYAIMGSCLYSIIQAAGELAVAYPTLTGNFNNYPSFLVDPAMCFATAALYCIQWLCVFPLEVISAAITIKYWNTSINPNVWCVIFYVMIIGINMCGSAGYAEADFFFNTCKILMFAGFFILGIIINCGGAGDSVYIGGKYWNDPGAFNGDTGISRFKAIVSTLVTAAFAFGASEAVALTASEQANPRKAIPSAAKQVLYRIIAIYLASIILVGFLVPYNSPELMGSGSSSVHSSPYVIAVASHGVKVVPSFINAVILISVLSVGNFSFYSSSRILLCLSEIGYAPKFFQYVDRQGRPLYAMIVGALVGCICFVSASSAEESVFTWLMAVSGLSQLFTWTNICISHVRFRKAMQVQNRSIGELGFRSQVGVWGSYYGIFMMILVFIGQFWVALFPVGGTDGADAENFFANYLAMPVFLALYFGFKIWKKDWRLYIPASEIDLISHRKIFDEEILKQEDEEYKIKMKHASIWVKLSNFWC

SEQ ID NO: 9685 - protein, 462 aa, Bacillus clausii KSM-K16
MTTYLFPPDFWWGTAVSATQIEGAADRDGKGKNIWDHWYEIEPNRFFNEVGPAKTSQFYDRYKDDIALMKKLGHTSFRFSISWSRLIPAGNGAVNEKAVQFYDQVIDELLAAGITPFVNLFHFDMPMAMQKIGGFENREVAYAFARYAEICFTHFGDRVKTWFTHNEPIVPVEGGYLYEFHYPKVVDFKRAVQVGYHTMLSSALAIERYRRLGQGGKIGIILNLTPSYPRAEENERDVEAAKLADAFFNRSFLDPSVKGTFPQELVAILKQYGLMPHVEEGDKAVISGNTVDLLGVNYYQPRRVKAKETPIGDGPLMPGTFFDSYDMPGKKINPHRGWEIYEKGIYDLLMNIKDHYGNIECFISENGMGVEGEEKFRDEAGVIQDDYRIEFISNHLRWLHKALTEGANVKGYHLWTFMDNWSWTNAYKNRYGFVSVDLEKDGKRTVKKSGWWFKTVIENNGF

SEQ ID NO: 9686 - protein, 1112 aa, Kluyveromyces lactis NRRL Y-1140
MNGNGITTLKGDTIGPWKLGSTLGVGSTGKVVMAYNETKGQQAAVKIISKSIFNAQGSTMIGGNDPDVLPYGIEREIIIMKLLNHPNVLRLYDVWETSKDLYMVLEYVEKGELFNLLVERGPLPENEAVRFFRQIIIGISYCHALGIVHRDLKPENLLLDHKFNVKLADFGMAALESKDKLLETSCGSPHYAAPEIVSGLPYHGFESDVWSCGVILYALLTGRLPFDEEDGNIRNLLLKVQSGKFEMPGDDEISSEAQDLIARILTVDPEQRIKTREILKHPLLRKYPSIKDSKSIRNLPREDTYLNPLSLEGGNQCVDETILQNLVVLWHGRNKEDIITKLMEPGANLEKTFYALLHRFKHDNYQDQLKQQELQKKQSVSSNSLMYVGSLPSPNKSDSPVTTPKKKRTSIIVASSSHKRPVSMQKLSSQHSSPVKNGSIGKRLSKTFPSNKRISQLVSNSSSPTPAAHKRVSRINDSAAPPVPKEMLRDYKRQSKRQSKRFSLLPNMKRGSITTKLIATYAKLSEDSEWEYIEKETKRTSQDFATLMDQIFEHEKYEQIRKEKEELERKVNEAREKEEAERKERERIEREEQERLEREERKRAERQKELQDQMEDEIAKLKAEYEAVQGSSDERNTANGRSVSAPIETDRTANKRDSTFGIKNDINELINTRNFSLQTRPVSRLDPGIIAAESRLSANLEDDQASKEKTILETIRRSKFLGSQFNLNVELEKAQKDLVSKERQEQLRKYSEQTAKYEVQKLPKNAKAVATLRDDEVEPRKLSEVKVPQFTRRSKHFSSSNKRFSVLSLYSTKTSFTNLVDHLKNDNYLEPLPGQPEYSSSKVAQEPEFMFETVEELDENSKLFEVPETEEGKLASAARKESTDARKQSTNDKDINLPSLPPLQVSHDVADENGALGLGIYQPNDQTQKPHKTMLIDESIDENISSTSDVSRTEVVKKPPLNDVVRKNNNERKPLEEITPKVENKRKISFFRKFSQGSEKKLGPESFDSQLKAGVSAPKMYKALDRLLNEWTNYGLKHVESSPNDFVISGKLTSDNILSLRSTGFKITVLPGEGNGSIIQFTKKSGSTKTFNRLVKEIEKILEKEKVLVFSF

SEQ ID NO: 9687 - protein, 353 aa, Buchnera aphidicola str. APS (Acyrthosiphon pisum)
MKNKILFIDRDGTLIDEPINTFQVDSINKLVFKKYVISSLRKLVELDYKLIMITNQDGLGTESFPLQDFSTAHLFMLSVFRSEGVIFDDILICPHFLDDDCVCRKPKIKMIEPWLDKIDLKKSYVIGDRDTDMQLSNNLKIKGIKYKEDICNWLHITKYIIKHNRYAEIIRRTKETKVSIKVWLDLEETSKIDTGVKFFDHMLEQLSVHSGICMNISVQGDLDIDDHHTIEDTGIVLGEALLQALGKKNGLSRFGFYLPMDESRSNCIMDISNRPYLNFKAKFNHKMAGDLSTNMVEHFFYSLCYSMKITLHLYAEGKNDHHCIESLFKVFGRTLRQAIKIEGNMLPTSKGIL

SEQ ID NO: 9688 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFAEYFQQGDMESNGKFVTKGGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 9689 - protein, 215 aa, Buchnera aphidicola str. APS (Acyrthosiphon pisum)
MLKKHDLLNLDWTKTNGMIPVIIQDYSSSEVLMHGYMNQDALTKTQEDGLVTFYSRTKNCLWTKGEISGNYLKVIEISTDCDNDTLLILVAAQGKTCHLGNSSCFISNKYNINFLFKLEEIIEERKNKFSDNSYTSSLYKSGTSRIAQKVGEEAIETILAAMNKDQIELINEASDLIYHLVVLLHDQDLNFNLVIDNLKKRREKNLNTNSEKLLK

SEQ ID NO: 9690 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFADYFQQGDMESNGKFVTKGGERVDYQTGPIIWGAAGTNGQHSLYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 9691 - protein, 485 aa, Medicago truncatula
MASSKQEQSSTNKELPLKQIPGSYGLPFIGPIFDRHDYFYNQGRDKFFSTRIQKYNSTIFRTNMPPGPFISSNPRVIALLDAASFPILFDNKKVEKLNVLDGTFMPSTKFTGGYRVCAYLDTTEPNHALIKGFYLNTLLLRKDTFIPLFKTILSDGFNEIEDGLSSKSGKADFNSMVSVASFNFMFKLFCDDKNPSETILGDQGPKMFDTWLLFQLAPLATLGPPKIFNYLEDILLRTVPFPACLTRSSYKKLYEAFSTSATTMLNEAEKAGLKRSEALHNIIFTAGFNAYGGLKNQFPILFKWLGSSGEELHKELANEIRTVVKQEGGVTIQSLEKMPLVKSVVYEAMRIEPAVPYQYAKAREDLIVKSHDAAFEIKKGEMIFGYQPFATKDPRVFDDPEVFVAKRFVGEGEKLLKYVLWSNGKETEEPSVGNKQCPGKNLVVLLCRLLLVEFFLRYDTFENETKNNAFGAAVSITSLTKASSV

SEQ ID NO: 9692 - protein, 465 aa, Xanthomonas axonopodis pv. citri str. 306
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 9693 - protein, 161 aa, Antirrhinum hispanicum
ASEVAEKKTLTLTSSDGQDFTVSESGGCLSEMIKNMVEDDCVTTAIPIPVVDSKTLAKVIVFLDKHGDSTISSDDMKKFDEEYVTGVEMGILFDLAAAANYLNIKDMMEVVTQKIADIMENKSVAWVRKTFGIENDLDPEEEKALQDEYPWAFEGLDPDSD

SEQ ID NO: 9694 - protein, 461 aa, Mesorhizobium sp. ZJ15B7
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9695 - protein, 279 aa, Zea mays
MATPAAEKPEDVEIREVWADNLETEFAVIRDIVDDYPYVAMDTEFPGVVCRPLGTYKSAAEFNYATLKANVDMLKLIQLGLTLSDEHGGLPALGPDGRPCVWQFNFRGFDPRTDVAAADSIDLLRRSGIDFSRHAADGVDSRCFAELLMSSGVVLNSDVHWVTFHSGYDFGYLLKLLTGTNLPDTLPGFFDLIKIYFPVIYDIKHLMRFSNSLHGGLNKLAELLDVARVGICHQAGSDSLLTALSFKKLKEAYFNGLTEKYAGVLYGLGFEGVETTSAH

SEQ ID NO: 9696 - protein, 517 aa, Streptococcus mutans UA159
MTDIKDIQKIIVLDYGSQYNQLIARRIREFGIFSELRSHKVTADEVRAINPIGIVLSGGPSSVYAEDAFDIDKEILDLGIPVLGICYGMQLLTEKLGGKVVPAGQTGNSEYGQSTLHLTENSELFKETPAEQTVLMSHGDAVTEIPEGFQLVGKSSDCPYAAIENVEKKIFGIQFHPEVRHTEYGNAILRNFAFNVCKAKGDWSMDSFIDMEIEKIREQVGNRKVLLGLSGGVDSSVVGVLLQKAIGDQLTCIFVDHGLLRKGEGDQVMEMLGGRFGLNIIRVDASKRFLDLLAGIDDPEKKRKIIGNEFVYVFDDEASKQKGVDFLAQGTLYTDVIESGTETAQTIKSHHNVGGLPEDMQFELIEPLNTLFKDEVRTLGTALGMPDEIVWRQPFPGPGLAIRVMGEITAEKLETVRESDAILREEIAAAGLNRDIWQYFTVNTGVRSVGVMGDGRTYDYTIAIRAITSIDGMTADFARIPWEVLQKISVRIVNEVEHVNRIVYDITSKPPATVEWE

SEQ ID NO: 9697 - protein, 957 aa, Kluyveromyces lactis
MTQSLPLLNGTEAYKLVTTQGLYDKTVKFYEKYLQLVHDKRVGTLTNSLITLKLVVDNSFKPLDVVNDKDWRAIVSSALVFSCTNIQHFRDLAAGETIQAYPNETNPIEIYLKDPNGYIIGITETKNAISIKPTLPKQSVEASLISSRSSRIDIASSGVSTDSSYPAIPKTAKAQKSIAVMTSGGDAPGMNANVRAIVRTAIFKGCNAFVVMEGYEGLVKGGPNYIKQVYWETVRNWSCEGGTNIGTARCKEFREREGRLLGALHLIEAGVDALIVCGGDGSLTGADLFRSEWPSLIRELLDQGRINKVQFDRYQHLNICGTVGSIDNDMSTTDATIGAYSALDRICQAIDYIEATANSHSRAFVVEVMGRNCGWLALLAGISTSADYILIPEKPASSREWQDQMCDIISKHRSRGKRTTIVIVAEGAISADLTPISSKDVHKVLVDRLGLDCRITTLGHVQRGGTAVAYDRILATLQGVEAVNAVLESTPDTPSPLIAINENKITRKPLVESVQLTKSVAEIHSKDFKKAMQLRDSEFVEHLDNFMAINSAHHIEPKLPEHTHMKIAIVNVGAPAGGMNSAVYSMATYCMSQGHKPYAIYNGWTGLTRHESVRSLNWKDLLGWQSRGGSEIGTNRHTPEEADIGLIAYYFQKYGFDGIIIVGGFEAFVSLHQLERARENYTAFRIPMVLIPATLSNNVPGTEYSLGSDTALNSLMQYCDIIKQSAASTRGRVFVVDVQGGNSGYLATHAAVAVGAQVSYVPEEGISLEQLTQDIENLTESLREAEGRGKFGQLILKSTNASKVLTPEVLAEVITQEAEGHFDAKCAIPGHVQQGGLPSPIDRTRGTRFAIRAVGFIESQHKVLAAEANLDDDDFDFDTPKIIATASVLGVKGSDIVFSSIRQLYDFETELNKRTPKTIHWQSTRPLRTICRKEKTYEIKNVSASSKFPLKWMYIIM

SEQ ID NO: 9698 - protein, 341 aa, Synechococcus sp. WH 7805
MTLRVAINGFGRIGRNVMRGWLSRGADTGLEIVGMNSTSDPKTSAHLLTYDSILGHIDRSVQIETTDETMIVNGKEIKFFADRNPLNCPWKDWGVDLVIESTGVFNTDEKASMHLEAGASKVILTAPGKGDGVGTFVVGVNDDQYRHEDWNILSNASCTTNCLAPIVKVLDQSFGLDWGLMTTIHSYTGDQRILDNSHRDLRRARAAALNMVPTTTGAAKAVALVYPEVKGKLTGFAMRVPTPNVSAVDLTFGPSRATNVEEVKAVIKAASENGMKGIIKYSDLPLVSTDYAGTNESTIFDADLTYAMGDKAVKILAWYDNEWGYSQRVVDLAEVVARNWK

SEQ ID NO: 9699 - protein, 403 aa, Silicibacter pomeroyi DSS-3
MSHIVVIGAGQAGASLVARLRKDGFEGEITLIGAEPVPPYQRPPLSKAYLLGEMEKERLFLRPESFYAEQNIALRLNARVSAIDPAAKTVSLGGEVIPYDQLALTTGSEPRRLPAAIGGDLAGVHVVRDLADIDAMAPSVTEGARALIVGGGYIGLEAAAVCAKRGVQVTLVEMADRILQRVAAPETSAYFRALHTGHGVDIREGVGLTRLIGAQGRVTGAVLTDGSELPVDLVVVGVGIAPATALAEAAGLVLENGIRTDAQGRTSDPSIWAAGDCASFPYKGGRIRLESVPNAIDQAETVAQNMQGAGKDYVAQPWFWSDQYDVKLQIAGLNTGYDRVVTRPGEGQTVSFWYYTGDQLVAVDAMNDPRAYMVGKRLIDSGKTADPAIVADPAADLKPLLKA

SEQ ID NO: 9700 - protein, 275 aa, Brassica napus
MSLFLKDDSIQIREVWSDNLQEEMDLIREVVDDFPYVAMDTEFPGIVVRPVGTFKSNADYHYETLKLNVNILNIIQLGLTFSNEQGNLPTCGTDSKYCIWQFNFREFDLDSDIFAVDSIDLLKQSGIDFAKNTRQGIESSRFAELLMSSGIVLNGNVHWVTFHSGYDFGYLLKLLTCKNLPDSQTSFFELINVYFPTVYDIKHLMKFCNSLHGGLNKLAELLEVERVGICHQAGLDSLLTSCTFRKLKENFFVGPLQKYAGVLYGLGVENGQVAL

SEQ ID NO: 9701 - protein, 1043 aa, Vibrio parahaemolyticus RIMD 2210633
MFTATNVLTPEFIGQPLDKLWSLISPLYMVDESQWLEQLLPLATPTTEEKSAITNQTTKLIEAIRADKKSIQMIDALLLEYSLDTQEGILLMCLAEALMRIPDAATADALIKDKLSVADWKSHLKNSDSVFVNASTWGLMLTGKVVGLGEQGTQSPSQAVNRLVNKFSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEERVMTELYETLMQLLKRAIEVDVAITIDAEEADRLELSLKLFEKIYRSDLVKGWGKFGLVVQAYSKRALPVLVWLNALAKEQGDLIPLRLVKGAYWDSEIKWSQQAGYENYPVYTRKEATDVAYLACARFLLSEGVRGNIFPQFASHNAHTVTAIAVMAQHKDFEFQRLHGMGDSLYNHVMEKYGQPVRIYAPVGSHADLLPYLVRRLLENGANSSFVHRLVDARCPISELTHHPVDALTSFATLNNDKIPMPSGIFPERKNSYGVNIDIESEAKPFEAQVESFLNNKWVAGPVINGERFAESMIKENLAEIITAPYDRRVEVGQVAFATLDHVSAAIEAAQAAFPEWKGTAIEQKAKCLETLADLMEANLAELVAICHQEAGKTIHDSIDEVREAVDFCRYYAKQAQNLQPFELEGFDGVKRISSREGLGVFVCISPWNFPLAIFLGQVTAALVAGNTVVAKPAEQTSLIAARAIDLMLEAGFPAGVIQLLPGRGGEIGHALTSHDAIAGVAFTGSTATAQRINVTLAERTAKPVPFIAETGGQNAMIVDSTALPEQVVRDVIRSAFASAGQRCSALRVLFVQEDVADRIITLIQGAMKELHVGLPYLHKTDVGPVIDRNAKQKLLAHLEQMSSTQKKVAQLQLEEACQYGDFVAPSAFEISGIDVLKEEQFGPILHIVRFKASELPNVVEQINQTGFGLTMGIHSRNETTYRWIEKHARVGNCYINRDQVGAVVGVQPFGGQGLSGTGPKAGGPHYLYRFTQHLLAQAENA

SEQ ID NO: 9702 - protein, 466 aa, Tropheryma whipplei str. Twist
MRTNFEWFEEAKRFIPGGVNSPVRAYAAVGGTPRFLAKAQGAYVTDIEGREYVDLVSSWGPLILGHAHPKVIDAVINTAHRGMSYGAPTTLEVELAELVCNRICNAQGIKPVERLRLVSTGTESCMTAIRLARCFTGRDLIVKFSGHYHGHADPFLIDAGSGLVGHPSSGGVPESVAKNTLVVPYNDLAVLEYLFEAYPNQIACIITEACPANMGVIPPDPGFNARVADLGHSHGALIIFDEVITGFRVGSGGFWALETSLASQQPTQAVSEGSVSDSAYSAYVPDLFTFAKVLGGGLPIGAIGGRAEIMDLLSPSGPVYQAGTLSGNPLATAAGLATLRLADSNIYEHMNRVARALINEIQSAFHDAGVPCTVQSAGNLFGISFSAIAPRDFTQATSQEHWRYSNFFHSMLNSGVLLPPSVYEAWFVSAAFDDRAIERVVNALPDAVRAAGSAPARPKGFEPPTF

SEQ ID NO: 9703 - protein, 125 aa, Cucumis sativus
AVASVNSASPAQASMVAPFTGLKSSAGFPITRKNNVDITTLASNGGKVQCMKVWPPLGLRKFETLSYLPDMSNEQLSKECDYLLRNGWVPCVEFDIGSGFVYRENHRSPGYYDGRYWTMWKLPMF

SEQ ID NO: 9704 - protein, 547 aa, Buchnera aphidicola str. APS (Acyrthosiphon pisum)
MSSVFRKILVTCALPYANGSIHIGHMLEHIQADIWVRYHRMRGHEVWFVSADDAHGTAIMLKAQDLEISPNKLIKNIRIEHQIDFSNFKISHDNYYSTHSLENLYLSRKIFTCLNEKGLIKEKKIFQLYDTVKKIFLPDRFIKGTCPICKSKNQYGDNCEICSATYEPTDLINPISVISGKKPILKNTKHLYFDLPSFTNMLKKWIHSGVLEESVIKKTEEWFKVGLKSWAISRDAPYFGFKIPNYPNKYFYVWLDAPIGYISAFKNLCFKSKKLNFNELWNQNSNYELYHFIGKDIIYFHTLFWPAILEAVSFRQPSGIFVHGHLTMNGLKLSKSRGALIKASDWIQYFDSDSLRYYYASKLSNKTHDIEINLEDFIQKINSDIVNKLVNLAARNASFINKYFNGYLSDKLSNIKLYKYFVNTSSSIEDFFENREFSFIVKESMRLLDVANQYINEKKPWKIKRTEENIRELQNICTMGINLFRIIMIFLKPIVPDLAIKTESFLISKLTWDGIKKPLLSHQINKFFPLYKRIDVEKMFEFMNICR

SEQ ID NO: 9705 - protein, 103 aa, Schizosaccharomyces pombe 972h-
MVKQVSDSSEFKSIVCQDKLVVVDFFATWCGPCKAIAPKFEQFSNTYSDATFIKVDVDQLSEIAAEAGVHAMPSFFLYKNGEKIEEIVGANPAKLEASIKANL

SEQ ID NO: 9706 - protein, 173 aa, Pseudomonas aeruginosa PAO1
MHPPLQALVIMGVAGCGKSSVSQALCQRSGAHGIEGDSFHPAANIRKMSAGIPLTDDDRAGWLDTLAEQLRQAVAAGKLPVLTCSALKRAYRDRLRRAVPGLGIVYLELTPAVAAERVAQRPGHFMPATLIDSQFAALEPPLDEPLTLRLDATLPVECLAQAAHAWWLEHAAA

SEQ ID NO: 9707 - protein, 338 aa, Arabidopsis thaliana
TLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFGLTRDEAIQNLLFVLGFNAYGGFSVFLPSLIGRITGDNSGLQERIRTEVRRVCGSGSDLNFKTVNEMELVKSVVYETLRFSPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRYDTITGDSGSIKAVVKAK

SEQ ID NO: 9708 - protein, 461 aa, Mesorhizobium sp. JS5A15
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDRAQEMGSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9709 - protein, 461 aa, Mesorhizobium sp. HN14A16
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9710 - protein, 200 aa, Oryza sativa (indica cultivar-group)
MAAPLRRSLPSLGRTLLSPSPAPARMLSAAASDALVEIKPGEIGMVSGIPEEHLRRKVRCFADLTSDLCSGDRLASPRGSVWESLEMSRTWEECAALQVVIYSPARTASQQGSGKVGRWKINFVSTQKWENPLMGWTSTGDPYANVGEAGLTFDSADSAKAFAEKHGWDYVVRKRHTPLLKAKSYAENFKWRGPPKAEQA

SEQ ID NO: 9711 - protein, 461 aa, Mesorhizobium sp. HB5A4
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLLYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9712 - protein, 346 aa, Oryza sativa (indica cultivar-group)
MRTTARPTAAATALALILVLVFSPSPAAAAARMFKTIDARRSQHLDLGGSLVGPESVAFDGKGRGPYSGVSDGRVMRWNGEAAGWSTYTYSPSYTENKCAASTLPTVQTESKCGRSLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAISADRTHLIVALTGPCKLMRYWIRGPKVGKSEPFVDLPGYPDNVRPDEKGGYWVALHREKYELPFGPDNHLVAMRVSAGGKLVQQMRGPKSLRPTEVMERKDGKIYMGNVELPYVGVVKSI

SEQ ID NO: 9713 - protein, 347 aa, Oryza sativa (indica cultivar-group)
MRTTARPTAAATALALILVLVFSPSPATAATARMFKTIDARRSQHLDLTGSLVGPESVAFDGKGHGPYSGVSDGRVMRWNGEAAGWSTYTYSPSYTKNKCAASTLPTVQTESKCGRPLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAIGVDRTHLIVALTGPCKLMRYWIQGSKAGKSEPFAELPGYPDNVRPDGKGGYWVALHREKYELPFGPDNHLVAMRVSAGGKLVQQMRGPKSLRPTEVMERKDGKIYMGNVELPYVGVVKST

SEQ ID NO: 9714 - protein, 179 aa, Agrobacterium tumefaciens str. C58
MTNIIQQLEAEQAAKIEAKRTLPEFSPGDTLRVNVRVTEGNRTRVQAYEGVCIARSGGGLSESFTVRKISYGEGVERVFPIYSPLVEGVEIVRRGKVRRAKLYYLRDRRGKAARIVENTGTRARKLNESERQAAAEEKARLEAEKVAAAQALAAEKAAAEAAEAKAAEEAAKAAEATAE

SEQ ID NO: 9715 - protein, 350 aa, Oryza sativa (indica cultivar-group)
MRSTARQAATAAAFALIVFLVLLSPSPTAAATATTRMFKTIDARRSQHLDLGGSLVGPESVAFDGKGRGPYSGVSDGRIMRWNGEAAGWSTYTYSPSYTKNKCAASTLPTVQTESKCGRPLGLRFHYKTGNLYIADAYMGLMRVGPKGGEATVLATKADGVPLRFTNGVDIDQVTGDVYFTDSSMNYQRSQHEQVTATKDSTGRLMKYDPRTNQVTVLQSNITYPNGVAISADRTHLIVALTGPCKLMRHWIRGPKTGKSEPFADLPGYPDNVRPDGKGGYWIALHREKYELPFGPDSHLVAMRVSAGGKLVQQMRGPKSLRPTEVMDRKDGKIYMGNVELPYVGVVKSS

SEQ ID NO: 9716 - protein, 556 aa, Streptococcus mutans UA159
MKTDIEIAQSVDLRPITNVVKKLGFDFDDLELYGKYKAKLTFDKIKAVEENAPGKLVLVTAINPTPAGEGKSTITIGLADALNKIGKKTMIAIREPSLGPVMGIKGGAAGGGYAQVLPMEDINLHFTGDMHAITTANNALSALIDNHLHQGNELGIDQRRIIWKRVVDLNDRALRHVTVGLGSPINGIPREDGFDITVASEIMAILCLATNVEDLKERLANIVIGYRFDRSPVYVRDLEVQGALALILKEAIKPNLVQTIYGTPAFVHGGPFANIAHGCNSVLATSTALRLADYTITEAGFGADLGAEKFLDIKAPNLPTSPDAVVIVATIRALKMNGGVAKDALNQENVEAVKAGFANLARHVENMRKYGVPVVVAINEFITDTNDEIAVLRNLCAAIDVPVELASVWANGADGGVDLANTLINTIENNPSHYKRLYDNNLSVEEKVTEIAKEIYRADKVIFEKKAKTQIAQIVKNGWDNLPICMAKTQYSFSDDPKLLGAPTGFDITIRELVPKLGAGFIVALTGDVMTMPGLPKKPAALNMDVAADGTALGLF

SEQ ID NO: 9717 - protein, 460 aa, Oryza sativa (japonica cultivar-group)
MAGKKRKSASSDKQPKQQQQRLPLGADADAVADAAKRRRSGASKKHQAEEEASIPSSLSAKILREALTQQQEESLADQRPAAAATAAPSPSFSFPVPKKDGEEDEDDDDVDEFDGFDAQSEYDGGVPEIDEEDEKALAAFMSKDTSSKRSLGDIILEKIREKDAEISTEGRTPVKLDSSIIELYKGVGEFLSRYTSGKIPKGFKRIPSLECWPDVLQLTEPENWSPNAVYQATRLFSSNMNAKNAVRFYEAILLPRVRNDIRKNKRLHFALYQSLKKCLYKPAAFFKGILLPLCQERNCTLREAVIIGSIISKVSIPPLHASAALMKLAEMEYCGTTSYFIKLFLDKKYALPYRVVDAVFAHFMRFIDEERVMPVIWHQSLLAFVERYKNELEKKDKEKLARLLDHQKHYLVTPEIRRELRMSCNRGEKDTIMSICSPVSVITKPIEEDRWNVPEVPMEE

SEQ ID NO: 9718 - protein, 801 aa, Staphylococcus epidermidis RP62A
MAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTTFTSLKVSGCDLYSAGQIVEDEDVHGVEIFNSVDNIYKKVYLSQGQVVGAVLYGDTDDGSRFYNMMKKHETLEDYTLVSLLHKGDEDAGTSIADMSDDETICGCNGVDKGTIVNAITSKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYLRIMEAKKAVENEPWETIVENKEAQKIFEVEKV

SEQ ID NO: 9719 - protein, 1068 aa, Methylobacillus flagellatus KT
MAKRTDIKSILIIGAGPIVIGQACEFDYSGAQACKALREEGYRVILVNSNPATIMTDPDMADATYIEPVTWQMVEKIIAIERPDALLPTMGGQTALNCALDLAKHGVLEKYHVELIGASKEAIDKAEDREKFKAAMTKIGLGSARSAVAHSMEEALQVQASIGYPAIIRPSFTMGGSGGGIAYNREEFMTICERGLEASPTSELLIEESLLGWKEYEMEVVRDSQDNCIIICSIENLDPMGVHTGDSITVAPAQTLTDKEYQIMRNASLAVLREIGVDTGGSNVQFAINPDDGRMIVIEMNPRVSRSSALASKATGFPIAKVAAKLAVGFTLDELRNEITGGATPASFEPSIDYVVTKIPRFAFEKFPQADSRLTTQMKSVGEVMAIGRTFQESFQKALRGLEVGADGLDEKTTDLDEIQKELGEPGPERIWFVGDAFRAGLSVDQVFDLSKIDRWFLVQIEDIIKREQALKGRHLADLDRDALFQLKRRGFSDKRLAKLLGTDQHAVRAYRQALNVRPVYKRVDTCAAEFATDTAYMYSTYEEECEANPTSKRKIMVLGGGPNRIGQGIEFDYCCVHAAFALREDGYETIMVNCNPETVSTDYDTSDRLYFEPLTLEDVLEIVALEKPEGVIVQYGGQTPLKLARDLEKAGVPIIGTSPDAIDRAEDRERFQQMLQELDLKQPPNRTARTPEEAIRLAQEIGYPLVVRPSYVLGGRAMEIVHEQAQLERYMREAVKVSNESPVLLDRFLNDALEVDVDALSDGEDVIIGGIMEHVEQAGVHSGDSACSLPPYSLSPAMQDELREQTVKMAKALGVVGLMNVQFAIQGETVYVLEVNPRASRTVPFVSKACGLQLAKIAARCMTGRKLKAQGVTREVVPPYYSVKEAVFPFIKFPGVDTILGPEMKSTGEVMGVGKTFAEAFVKSQLGSGTKLPKGGKAFISVRREDRERVVEIAQALAGLGFKLVATRGTAGALTEAGLSVTPVNKVAEGRPHIVDMIKNGEISFIVNVTEDKRAVADSYEIRRSALQQKVTYYTTLAGAKAACIGMAHMQELEVQSLQSLHKQLAQ

SEQ ID NO: 9720 - protein, 557 aa, Kluyveromyces lactis
MASKNTYSDFKLATELPAWNQLQSLYEQKGKKLNVKDEFAKDNSRYEKFAKTFVNYDGSKILFDFSKNLVDDEILKSLIQLAKEAKVTSLRDAMFNGEPINFTEGRAVYHVALRNRSLKPMYVDGTNVTPEVDAVLQHMKEFTEEVRSGAWKGYTGKSITDVVNIGIGGSDLGPVMVTEALKHYATNLKVHFVSNIDGTHIAETLKDLDHETTLFLIASKTFTTAETITNATQLELKNWFLSKNGGDQSHISKHFAALSTNATEVEKFGIDTKNMFGFENWVGGRYSVWSAIGLSVALYIGFDNFEAFLKGAEAVDKHFVETPLEDNIPLLGGLLSVWYNNFFDAQTHLVAPFDQYLHRFPAYLQQLSMESNGKSVTRGNVFANYSTGSILFGEPATNAQHSFFQLIHQGTKLIPSDFILAAQSHNPIENNLHQKMLASNFFAQAEALMVGKDEEQVKSEGATGGLVPHKVFSGNRPTTSILAQKITPATLGALIAYYEHVTFTEGRIWNINSFDQWGVELGKVLAKVIGSELATDNKISSHDSSTNGLINQFKEWI

SEQ ID NO: 9721 - protein, 534 aa, Zea mays
MTTRALGAVALRFLREYVRASDLAGAAAVLFACSAPRSRVSSRPGEPMLWPGVGIIPTLFAHLAAGDVYDWGAAVLLARSRGTFAYRGTWGGGSSGVVTSVPANVEHVLRANFDNYPKGPYYRERFAELLGGGIFNADGDSWRAQRNAASAEMHSARFVQFSAGTVERLVRRELLPLLEALSGRGGPESAAAAVDLQDVLLRFAFDNICAAPFGVEAGCLADGLRDVPFARAFERATELSLTRFYTPPFVWKSKRLLGVGSERALVESARAVREFAERTVADRRAELRKVGDLAGRCDLLSRLMSSPPAAGYSDEFLRDFCISFILAGRDTSSVALTWFFWLLASHPHVEARVLDDVARGGGDVSAMDYLHAALTESMRLYPPVPVDFKEALEDDVLPDGTLVRARQRVIYYTYAMGRDKATWGPDCLEFRPERWLSKSGAFAGGAESPYKYVVFNAGPRLCVGKRFAYTQMKMAAAAVLARFRVEVLPGQEVKPKLNTTLYMKNGLMVRFVRREQRHELGHPLPAAAADAGED

SEQ ID NO: 9722 - protein, 376 aa, Synechococcus sp. WH 7805
MADYYELLGVSRDADADTLKRAYRRLARQYHPDINKEPGAEDRFKEIGRAYEVLSDPQTRGRYDQFGEAGLGGAAGMPDMGDMGGFADLFETFFSGFGGAAGGGRQQRRRGPQQGDDLRYDLTIDFEQAVFGQEREIRVPHLETCTTCGGSGAKSGSGPTTCSTCGGVGQVRRATRTPFGSFTQVAECPTCNGSGQVIADPCNACGGQGVVQVRKKLRINIPAGVDTGTRLRVAGEGNAGLRGGPSGDLYVFLTVKNHPTLRRDGLTVLSEVKVSYLQAILGDTIEVETVDGPTSLEIPAGTQPNAVITLENKGIPKLGNPVARGNQRVAVTVKLPTRLNNEERGLLEELAGHHSARGEQHHHHKSGLFARLFGQR

SEQ ID NO: 9723 - protein, 485 aa, Agrobacterium tumefaciens str. C58
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAERAGSGVSH

SEQ ID NO: 9724 - protein, 136 aa, Pseudomonas syringae pv. syringae B728a
MLQDKEKLMTITRYGAGSTAGGGQPRPFARAVEADGWLHVSGQVPAQDGEIIVGGIVEQTHQTMRNLIAILEEAGYALKDVIRVGVWLEDPRDFWSFNKVFGEYFTPEHAPARACVQASMMVDCKVEIDCIAYKRK

SEQ ID NO: 9725 - protein, 494 aa, Oryza sativa (japonica cultivar-group)
MQRRRGLAALAVLLALAARGADASVHEYSGGGFAPRANSFFFHGGSEGLYASDPTSNSSASFIRFDSVTFRRTQESAGRHEAMQQKTGLVEAIIVEIQDRSKIGGSYLHSDAICCTPELDKEKSCKVGEVIIQPNPDNPDWPKRVQTFFSGRDEEASMVTQVVSINKTGMYYLYFMFCDPQLKGLKITGRTVWRNPQGYLPGKMAPMMTFYGFMSLAYLVLGLLWFLQFVRCWKDILQLHYHITAVIALGMCEMAFWYFEYANFNSTGNRPMAITLWAVTFTAVKKTISRLLLLVVSMGYGVVRPTLGGVTSKVGALGVVYFIASEGLELVENLGNINDFSGKTRLFLVLPVAILDATFIIWIFSSLSRTLEKLQLRRSMAKLELYRKFTNSLALSVLISIAWIGYELYFNATDPLSELWRRAWIIPAFWNVLSYVLLAIICILWSPSRNPTGFAYSEDTADEADEEGLSLVGSAVKGTGDIVNMHVFPEDKRA

SEQ ID NO: 9726 - protein, 146 aa, Arabidopsis thaliana
DRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 9727 - protein, 487 aa, Agrobacterium tumefaciens str. C58
MLGRRAEGWNSFVHMRCTTVGSPALQRFAIDMVRRNLPILRRTYRWVPLSFAFDEKSKGGKHMVSEKALISKITWRLMPFLGLLYLIAYIDRQNVSYAKLQMVDALSLSEYAYGLGASLFFIGYFLFEVPSNLFLNRFGASKWFARILVSWGAVTIALAYTQNATMFYILRFLLGLCEAGFFPGVLFLMTLWFPRDYRGRMIGLFMIFSALANAVGAPLGGMLLDLDGFLGYAGWEWVFLATGIPAVIAGIVTFFYLDDTPDKAKFLTQDEKDWLKNRLAEENKGMEEHAEDGFKALVNPRVLFMALCYVGFPLAAYGLSYWLPTIVKSFGVSNTTNGFINIIPWIIVAIALFVVPSAADKAKNKTPYIVGPAFVGAFCLLMSALLSDPVLQFAFLCVAAAGIFAGQPVFWSLPGRFLKGAGAAAGIAAINSVGNLGGFVAQNVVPWIKDQTGSTIAPMFFLAFCLALAGVLVIIATRKMGNQVKAA

SEQ ID NO: 9728 - protein, 356 aa, Neisseria meningitidis MC58
MTKHIAILRGDGIGPEIVAETVRVLDKLIAQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENAVQKVLQQGLRTSDIYEEGTKLVSCSEMGDAVLAAL

SEQ ID NO: 9729 - protein, 350 aa, Oryza sativa (indica cultivar-group)
MRSTARQAVTAAAFALIVFLVLLSPSPTGAATATTRMFKTIDARRSQHLDLGGSLVGPESVAFDGKGRGPYSGVSDGRIMRWNGEAAGWSTYTYSPSYTKNKCAASTLPTVQTESKCGRPLGLRFHYKTGNLYIADAYMGLMRVGPKGGEATVLAMKADGVPLRFTNGVDIDQVTGDVYFTDSSMNYQRSQHEQVTATKDSTGRLMKYDPRTNQVTVLQSNITYPNGVAMSADRTHLIVALTGPCKLMRHWIRGPKTGKSEPFVDLPGYPDNVRPDGKGGYWIALHREKYELPFGPDSHLVAMRVSAGGKLVQQMRGPKSLRPTEVMERKDGKIYMGNVELPYVGVVKSS

SEQ ID NO: 9730 - protein, 163 aa, Oryza sativa
MEHQGQHGHVTSRVDEYGNPVGTGAGHGQMGTAGMGTHGTTGGMGTHGTTGTGGGQFQPMREEHKTGGVLQRSGSSSSSSSEDDGMGGRRKKGIKEKIKEKLPGGNKGEQQHAMGGTGGAYGQQGHGTGMTTGTTGAHGTTTTDTGEKKGIMDKIKEKLPGQH

SEQ ID NO: 9731 - protein, 104 aa, Brassica napus
MLYGYQPLATRDPKIFERAEEFVPERFLGEEGERLLQHVVWSNGPQTENPTVGNKQCAGKDFVVLVARLFLIEIFRRYDSFDIEVGSSPLGSSVTFTSLRKASF

SEQ ID NO: 9732 - protein, 205 aa, Haemophilus influenzae 86-028NP
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPVLLLLTKADKLSQSARSKQVKMVREAILPFQGDIQVEAFSAQNKIGIDKLAAKLDFWFSPLFAK

SEQ ID NO: 9733 - protein, 706 aa, Cryptococcus neoformans var. neoformans B-3501A
MHLVTVATCQLRQWSLDFEGNCERILRSIAIAKSRGATLRVGPELEVPGYGCDTMLHSWEVLAKILQSEEAKGIVCDIGMPLEHKNNNYNCRVIIFNGKILLIRPKMWMANDGNYRELRHFTPWHKHRQVEKHSLPHMIRIVTGQTYVPFGDAVIATEDTVIGVELCEELFTPASPHILMGLDGVEIFTNSSGSHHELRKLNRRVELIKEATMKLGGIYLYANQQGCDGDRLYYDGACLIAMNGQILAQGPQFSLSEVEVVSATVDLRAVRAHRTTSSRRMQSAQAEAYERVVADTRLDGGEQIKVGLRETKGSMDVRYHTPEEEIALGPACWLWDYLRRSRTQGYFLPLSGGIDSCATAIIVHSMCRLVVEAAAKGDEQVITDARRITNEPEDSTYIPEDPREFAGRIFHTCYMGTENSSSETRERAKNLADAIGAYHVDLNMDTAVSAVKGIFSFVTGKTPQFKAHGGTNAENLALQNIQARLRMVVSYMFAQLLPWVRGKNGGLLVLGSANVDESLRGYFTKYDCSSADVNPIGGISKVDLKRFIAWAQVKFDLPILYNFLHAVPTAELIPIGPDNIIQSDEIEMGMTYDELSVYGRLRKVEKCGPFSMFGKLVQEWGSFLSPKEIAEKVKHFFFMYAINRHKMTTITPSVHMESYSPDDNRFDLRPFLYPSQFTHQFRKIDELAGKLPDMAQKPKVDTNEVD

SEQ ID NO: 9734 - protein, 474 aa, Oryza sativa (indica cultivar-group)
MSPVINGPLAVPLRCACPSATTGRINNLLTYVVQEGDNVTSIARRFNSTHGDVLAANTLLVPLVHPPHSRVVLANATITSTTPPESQKFYVSSPCSNGLLAGLGIGVGCGVSAWAAVLAVFLLWRRRRRRPVGDSSGMARETPLVAAVRGAVETLAAYSYADIETATAGFAEERRVAAGSSVYRAVINGEAFAVKRVAAGGDDVRGEVDVLGRVNHSGLVRLRGLCANGDDTYLVLEFAENGALSEWLHPGSAAACLRRVLGWKQRVLVALDVAGGLNYLHHFSNPPYVHKNLNSGNVLLDANLRAKVSSLGFARAVAVAVAAGDDSIALMTHHVVGTHGYLAPEYLEHGLISPKLDVFSFGVILLELLSGKTAAFVTDDDGQNMLLWQAADGLVDGDGAWFKLRAFMDPQLQGHYPIGVASAVAALAVRCVAREPRARPSMEEVFVTLSAVYNLTVDWDPQNYSASASMVRGR

SEQ ID NO: 9735 - protein, 611 aa, Cleome spinosa
MAAKDSCSPLRCMSPEVESSVHTQMVTAGIEGAISGEYCTNRRMERTFSGTRRVFVQTDTGCVLGIEFDRRDNAHTVKRRVQLALNIPTEEKSLTCGDVVLKNDLSTVRHDSPLLLTRNLMHRSSSSPCLSPTSKDLQQRDFSCPIEILGYSNCFSKTKRLAKEIEKAMELGIDPVPVCSGLGGAYYFRDRRGENCAIVKPTDEEPYAPNNPKGFVGKSLGQPGLKRSVRVGETGFREVAAYLLDHDHFANVPPTALVKVTHRIFNLNEGVNINKHQMRDRVGKIASLQQYIPHDFDASDYGTSGFPVSAVHKIGILDIRILNTDRHAGNLLVRQLEDVAGFSQVELVPIDHGLCLPENLEDPYFEWIHWPQSSIPFSEEELEYIANLDPFRDSDMLRMELPMIREACLRVLVLCTTFLKKAAVFGLCLAEIGEMMSREFRGDEEEPSELELLCMEARTLLRDTLPNRDQSDSDCEEQKSKASASSNTLFELDELEELDKGKSEKSGISRIPTCPRLPTSMKENKDRGKSGFTCHGIPRKGQSAGRSLRQQSLNKESLGSSSFVKLSDMSEEEWLQYLEIFQKMLNPAFTRRNSSRSDQKLRHRLGTSCRF

SEQ ID NO: 9736 - protein, 457 aa, Oryza sativa (indica cultivar-group)
MEVFYYLVFGGLAAVVAGLELGKSAKDRVTTSQAFNSFKNNYVLVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDSQWLSITFSKAIFLGNGLVAIVSGLFANLLADNLGFGPVAPFDAAACFLAIGMAIIMSSWSENYGDPSESKDLMSQFKVAAKAIASDEKIALLGAIQSLFEGSMYTFVFLWTPALSPNEEDIPHGFIFATFMLSSMLGSSIAARLLARKLKVEGYMQIVFTISAFTLFLPVVTNILVPTSSVKGGSISFGGTLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMDDEDEPLNP

SEQ ID NO: 9737 - protein, 197 aa, Synechococcus sp. WH 7805
MSIFVGNLPFRAEQEDVIELFAAFGEVTNCALPLERDTGRKRGFAFVEMADDAAEAAAIEALQGAELMGRPLRINKAEPRGSAPRRGGGGGGYGGGGGGGYGGGGGGGYGGGGGGGYRGGGGGYNDGGGGYGGGGERRSGARGWEDRSYGGGSGAAGGGGYSDGGGGDDGRSRRRRGGAAPSEGGGDDYSGYGGAEG

SEQ ID NO: 9738 - protein, 169 aa, Triticum aestivum
MERLLPSQNLWTPSSPVTTPLFKHPPTILLSFSIHHCCKLGRVFLILCSSPSTRIGHSMGVDRGSTSVQFDDFLPSMAKKLGAEGLIQELCKGFQLLMDPRAGRITFQSLKRNAARLGLGELRDDELQEMMREGDMDGDSALDQTEFCILMVRLSPELMEQESHRMFEC

SEQ ID NO: 9739 - protein, 652 aa, Frankia sp. CcI3
MVSRTDRSSSSTSKAVTSSPSTSSLSSAASSPSVSSSSSSSSVSAAGMTAVSTGPLTGSRKTWLVGADPDLRVPMREIVLTTGDTVVVYDTSGPYTDPGVTIDVRRGLPATRDSWIAQRGDTAPDERRTVPGTGASGPGTLGSGTPGSGTPGSGPLGLGGTDLDGRVRVPRRAVPGRPSITQLGYARRGQITREMEFVALREGLPVETVRAEIAAGRAVLPANVNHPESEPMAIGRAFLVKINANLGNSAVTSSIEEEVEKMVWATRWGADTVMDLSTGSDIALTREWIIRNAPVPVGTVPIYQALEKVGGRPEKLSWEVYRDTVIEQCEQGVDYMTVHAGVLLRYVPLTARRRTGIVSRGGSILASWCLAHHEENFLYTHFAELCEIFAAYDVTFSLGDGLRPGSIADANDEAQLAELATLGELTQVAWEHDVQVMIEGPGHVPMNKIEENVQLQRELCHDAPFYTLGPLTTDIAPGYDHITSAIGAAMIGWAGTAMLCYVTPKEHLGLPDRDDVKAGVIAYKIAAHAADLAKGHPGAQAWDDALSDARFEFRWADQFHLALDPDTARAFHDETLPAPAAKSAHFCSMCGPHFCSMKISHQVRAHAGGDGLDPAGHGADPAGDEAVTAGLREKAAEFNAAGNRIYLPVANS

SEQ ID NO: 9740 - protein, 265 aa, Pyrococcus horikoshii OT3
MVLYFIGLGLYDERDITVKGLEIAKKCDYVFAEFYTSLMAGTTLGRIQKLIGKEIRVLSREDVELNFENIVLPLAKENDVAFLTPGDPLVATTHAELRIRAKRAGVESYVIHAPSIYSAVGITGLHIYKFGKSATVAYPEGNWFPTSYYDVIKENAERGLHTLLFLDIKAEKRMYMTANEAMELLLKVEDMKKGGVFTDDTLVVVLARAGSLNPTIRAGYVKDLIREDFGDPPHILIVPGKLHIVEAEYLVEIAGAPREILRVNV

SEQ ID NO: 9741 - protein, 316 aa, Methylomonas aminofaciens
MANLFDQLKEFTTIVADTGDVEAIKSVKPYDATTNPSLLLKASTLPQYAPLIDEAIAYAKSQSGDKAQQIEDAADKLAVLIGQEILKHIPGKISTEVDARLSFDTDAMVQKGRKLIKLYADAGISKDRVLIKLASTWEGIKAGEILEKEGINCNLTLLFSFAQARACAEAGVFLISPFVGRILDWYKAKTGENYTSETDPGVLSVRKIYAYYKEHGYKTVVMGASFRNTGEITALAGCDRLTVSPNLLERAEGYRRYLPRVLVDNGATKQRPALLTEKEFRFDQNEDAMATEKLAEGIRGFVVDQNKLEKALAEKL

SEQ ID NO: 9742 - protein, 376 aa, Lingulodinium polyedrum
MGDEEVAALVVDNGSGMCKAGFAGDDAPRAVFPSIVGRPKMPGIMVGMDQKDSYIGDEAQSKRGVLTLKYPIEHGIVTNWDDMEKIWHHTFYNELRVAPEEHPVLLTEAPLNPKANRERMTQIMFETFNVPAMYVAIQAVLSLYASGRTTGIVMDSGDGVSHTVPIYEGYALPHAILRLDLAGRDLTDYLMKILTERGYSFTTTAEREIVRDVKEKLCYIALDYDSEMKAATESSDKEKTYELPDGNIITVGSERFRCPEVLFQPSLVGKEASGVHDTTFQSIMKCDVDIRKDLYANVVLSGGTTMFIGIGERMAKELTALAPSTMKIKVVAPPERKYSVWIGGSILSSLSTFQQMWITKTEYDEAGPSIVHRKCF

SEQ ID NO: 9743 - protein, 272 aa, Arabidopsis thaliana
MKMKKKGKVYPSPPPPPSSSSSSSSWSIHLNEEDDDSLSVLKLLPATILVLVSVLSAEEREVLAYLITRGTTISDRGNSSSKNKTKTKKKSNKSSKNHKPPVFDCECFDCYTNYWFRWDSSPNRELIHEIIEAFENHHGEENSASRSKSKRGKKKEKPGRRVTDSDSKPALRVTDNGDKDSKPVVEPMNETTVSESSHVSSPVRLSEAEVAEGEPEDEIVVEEDGQEEESTVVVFPAAASNVTGHKGLARKVLPDVLGLFHSNFWRLWNPNA

SEQ ID NO: 9744 - protein, 795 aa, Buchnera aphidicola str. APS (Acyrthosiphon pisum)
MKFSEKWLREWIDPQVSSKILHEQISNSGIEVEHVENFKSEFHGVVVGKIVQCTFHNESNNLKVLKVDIGKKKLLNIICGASNCRNGIKVAVATVGATLPKNITINKKILKGAWSEGMLCSFFELGLFLNDNKIIEFPKETLVGINVYDYFLLEDNIIKVSITSNRPDGLSILGLSRNIAAINDLRISPLKNRLVPAVIQKKINIDIQADKECMNFFGRIIENININVDTPFWMKKKLFFSNVLSENIITNIIHYVLIELGQPLNILDADNINDSIIVRMARHEEDLFLKNNIKISLNENILVFSDSNKILSLPGNINSNIVDVDKNTKNIFLSSYLINRKYISYIIKKMNMNTVLEYHYYGVDPFLQNYAIEYATDLILKICGGVPGPINEKKCNFQIHKNNTIRLHHERLNKIIGFFIDTSVISKILYRLDYQLKFQKTFWDVISPSWRFDILIEEDVIGDILRIYEYNNVHLIPLKEFLNCSKKNELTDSLLKKSAVILINQGYHEVINYGFIDPKIQNLIFPNEENLLLSNPISQDMSCMRLSLWPGLLKNISYNKNRQQKSIRIFESGLCFSIDKRENLGIRQEIFLAAAISGNYIKENWYYNIRKMDFYDLKGDLESILESICQLNEIEFRRKKIHGLHPEQSASIYFRNYLIGSIGAIDPRLEKALNVSSTTFLFEISLNNFSDIKPLKVEEISKFPTVRRDIAILISEEIAAYNVIEQCKIFFINEKVEINLFDIYAYKESHNHKKSLGISFIFQNKKRTFQDNEINLMIDDCIGVLQKKFQAVLRK

SEQ ID NO: 9745 - protein, 379 aa, Ustilago maydis 521
METAAAQNLLIANSYAKVEKVGEGTYASVFLARSINTGQKVAIKKIKIVSNENGMDVTAIREVKFLKELNHPNVIKLVDVFSSGSRSPSLNLVLEFLDTNLEALIKDRTLIFTQADIKSWMAMLCRGLEYCHRYWVLHRDLKPNNLLISPQGELKIADFGLAREHGDPGARMTHQVVTRWYRPPELLLGSRAYSSAVDMWSVGCIFAELMLRVPYLPGESDADQLITIFKALGTPTDKDWPGHKSLPEYTAFEQYPKSNLADLFLAASPEALDFLQKMLLFDPLKRLSANQALHHAYFKQGPPPTPFKQLPRHPTKALDSGDPAAHPLLSDSKEKNEVREKQQNQAHGNGNVNGNSRKRPFDAKEIEERRRLARKLAFA

SEQ ID NO: 9746 - protein, 562 aa, Vibrio parahaemolyticus RIMD 2210633
MNNDKRPLYIPYAGPALMATPLLNKGSAFSAEERSSFNLEGLLPETTETIQEQVERAYQQYKSFESDMDKHIYLRNIQDTNETLFYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGPDYDAFVEEFIQAVQRRWPDALIQFEDFAQKNAMPLLERYKDRICCFNDDIQGTAAVTVGSLLAACKAAGTQLSKQRITFLGAGSAGCGIAEAIIAQMVSEGISDEKARSQVYMVDRWGLLQEGMPNLLDFQQRLVQKHSNTKEWENEGNGFSLLDVMRNAKPTVLIGVSGAPGLFSQEVIEEMHKHCKRPIVFPLSNPTSRVEATPNDIIRWTNGEALVATGSPFDPVVHEGRTYPIAQCNNSYIFPGIGLGVLAVNAKRVTDEMLMESSRALATCSPLAINGRGALLPPLEEIHLVSKKIAFAVAKKAIEQGVALEITDEALNDAIDQAFWQPVYRRYKRTAF

SEQ ID NO: 9747 - protein, 449 aa, Schizosaccharomyces pombe 972h-
MDNIGAADAATSSGISGLLSGNSFLGAGIGLMGFGAGLAILRRGLISGASLVKRRMLVSVEIPSKEKSYNAFLHWMSTVPKRYSNQLAVESNRQLKMPQNAREKPDKQVANRIFSLVPGPGKHYIKYKKCWIQVERERSNRLQDLTTGTPWETITLTTLSRDRGIFSELLLEAQKFMQSAQKNKTTIYTAWATEWKPFGHPRSKRMLSSVVLESNVKKMITDDVHDFLRNSQWYDTRGIPYRRGYLLYGPPGSGKTSFLYALAGELDYDICVLNLAEKGLTDDRLNHLLSNVPPKAVVLLEDVDSAFQGRERSGEVGFHANVTFSGLLNALDGVTSSDERIIFMTTNHPEKLDPALVRPGRVDVKAYLGNATPEQVREMFTRFYGHSPEMADDLSDIVCPKNTSMASLQGLFVMNKSSPADAVDMAKELPDNPPSTPFSFNVHRKSLSV

SEQ ID NO: 9748 - protein, 452 aa, Staphylococcus aureus subsp. aureus N315
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLALTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYVLIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNAWLDNVSLIAIGFLIYGPVMLIGLQALDYVPKKAAGTAAGLTGLFGYLFGAVMANIVLGAVVDKFGWDVGFILLTAISVFAMLSFILTWNKVGQETVHH

SEQ ID NO: 9749 - protein, 667 aa, Oryza sativa (indica cultivar-group)
MSMLPRFLLLLVLLAVPMTAAQQQYEANAQGDCYTDNGSSVLGYTCGTAASPPPPPCTAYLTFRSAPPSYASPITVSYLLNASVPAVAAANSVPVSPPVARDGLLLVPVPCACTAAGYYQHDAGYVIQFDDETYFVMANDTYQGLTTCQALMAQNPAHDSLDLYPGIRLTVPLRCACPSPAQAAAGVRYLVTYLLGWDDDSSTVADRFGADYQAVLFANNLTDDSTVYPFTTMLVPLKHRPKPDVTVLPEPGPPSPAPAPAVSAPPPPAVPSSESGSGRWKKSFRGRCIGIGVGVGFAVLASGALLALFLLRRRWRWRGNGELHDVPLAPDKEGAKATPPPWMLPTTVADVDVRDAVGSMAVYEYGELERATAGFAEERRIGDSSVYRAVINGDVAAAVKRVAGDVGAEVSVLGRVSHSCLVRLFGLCVHRGDTYLVFELAENGALSDWIRGDNGGRALSWRQRMQAALDVADGLNYLHNYTRPPYVHKNLKSSNVLLDADFRAKVSNFGLARAVAGAGGQMTSRVVGTQGYMAPEYLEHGLIGPHLDVFAFGVVLLELLSGKEAAPARDGGEGGDGEALALLLWEEAEGQLVVDGDDDDARGKVAAFMDSRLRGDYPSEVALAMAALALRCVAREPRARPSMVEVFLSLSALHGTTLDWAPHATLS

SEQ ID NO: 9750 - protein, 674 aa, Methanococcus maripaludis S2
  misc_feature (132)..(132): Xaa can be any naturally occurring amino acid
MELDFIHTICPYCGTGCGVDLVVKDGTLVGTNPFKRHPVNEGKTCIKGSYCHEFVHRDDRLKTPLIRKNGELVEASWDEALELISGKLQNYSPEEVGFFSSARCTNEDNYVFQKFARTVIKTNNVDHCARLXHSATVVGLGQAFGSGAMTNSISDIEDADCIFIIGSNTFEQHPLIARRVVRAKEKGTKIIVIDPRYTPTAKQADLYLQLLPGTNIAVLNAIMHVLVKENLVDEEFIKNRTKGYEELKTTLETYTPEYASKLSGVAPELIVEAAKMYGSANAASILYCMGITQFTTGVNNVKSCCNLAMITGNIGKPGTGVNPLRGQNNVQGACDMGALPNVFPGYQAVPANHEKYAEAWNTCVDPNVGLSIPDMLAKAGEQVKCIYVMGENPMVSDPDIHHVEHALKSLDLLIVQDIFLTETAQVADVVLPGASWAEKDGTFSNTERRIQKINKAVDSPGEAIADWKIVKMLAEKMGQGELFNFNTAEEVFQEIAKVTPQYAGVTYERLGVDGLHWPCKTCEDPGTPILHCEKCLTPDGLGNIFAIDYADPDEMADSEYPMTLTTGRIIFHYHTGTMTRRSKHMADEINEGFVEIHPEDAEKMGIKNKQKVKVSTRRGEVVVNAKITPNIKQGVVFMPFHFAETAANILTNPAQDPNCKIPEYKVCAAKVEKI

SEQ ID NO: 9751 - protein, 157 aa, Mesorhizobium septentrionale
MFADGVMFDGSSIAGWKAINESDMVLMPDPDTVHMDPFFAQSTMVILCDILDPVSGESYNRDPRGTAKKAEAYMKSEGIGDTIYVGPEAEFFVFDDVKYKADPYNTGFRLDSTELPSNDDTDYETGNLGHRPRIKGGYFPVPPIDSAQDMRSEMLTV

SEQ ID NO: 9752 - protein, 333 aa, Rhodobacter sphaeroides 2.4.1
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 9753 - protein, 179 aa, Glycine max
MELFFYAVFGGLGAVVAVTELSKSNKDRINTSSAFNSFKNNYLIVYSLMMAGDWLQGPYVYYLYSTYGYGKGDIGQLFIAGFGSSMLFGTIVGSLADKQGRKRACVTYCITYILSCITKHSPHYKVLMLGRILGGIATSLLFSAFESWLVAEHFKAIFLGNGLVAILSGLFGNVLVDTL

SEQ ID NO: 9754 - protein, 347 aa, Schizosaccharomyces pombe 972h-
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 9755 - protein, 352 aa, uncultured rumen bacterium
IGAANNLLAAMLDNHIQQGNSLNIDPRRIVWRRAVDMNDRRLRNIIDGLGARTDGTPRQDGFDITVASEVMAVLCLSSDLKDLKERLGKIVVAYTYDNEPVTAGQLKAQGAMAALLKDAIKPNLVQTLEGTPAFIHGGPFANIAHGCNSITATKMAMKLGEYAITEAGFGADLGAEKFLDIKCRKANIKPDAVVIVATVRALKHHGGVKKENLNEENLEALKNGMPNLLQHVENITKVFKLPCVVAINAFPSDTEKELKLVEDECKKLGVNVALSEVWAKGGDGGKALAEEVVKLCEKENDFTFAYDLNLSIKEKLDTIARRIYHADGVELVGSASKQAKQLEELGFGNLPI

SEQ ID NO: 9756 - protein, 385 aa, uncultured bacterium 578
MKDNKFNTKAIREGYQPTQEQEHSAAIFLTSSFRFDSAEQAAKRFDNKDQGNVYSRFTNPSVVAFEEKLAVLEGAEQCLATASGMSAIFATIMTLLKPGEHMVASRGMFGTTIVLLNTIIQKFNIEVTFVDLPDLNDWKNSVQTNTKLFMLETPSNPLGEVVDLRALSAISKKNNIILAIDNCIMTPALQKPLALGADLVIHSATKYIDGQGRCLAGAIAGNNKLIDEISSFARSTGPTLSAFNAWIIFKGLETLSLRMQAHCENAKKLAVWLNEQEFVKKVHYLGLDSHPHHSIAKEQQSDYGGIVSFEVIGGRKEAFRLINNTKMISITANLGDTKSTITHPATTTHVRLSDEEKQQSNISENLIRISVGLEDIEDIIADIKP

SEQ ID NO: 9757 - protein, 729 aa, Streptococcus pyogenes MGAS8232
MATVSTGSLIFIVKKNSPMMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYQAEYPELAAEYQKAFANEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLNKGAYILSEAKGDLDGIIIATGSEVKLAMDTQEALEAEGIHVRVVSMPSQNIFDEQSAEYKESILPAAVTKRLAIEAGSSFGWAKYVGLAGKTLTIDTWGASAPGNRIFEEYGFTVANATELYKSL

SEQ ID NO: 9758 - protein, 160 aa, Arabidopsis thaliana
MAGEQIKPVASGLLVLNFCMYVIVLGIGGWAMNRAIDHGFEVGPNLELPAHFSPIYFPMGNAATGFFVIFALLAGVVGAASTISGLSHIRSWTVGSLPAAATAATIAWTLTVLAMGFAWKEIELQGRNAKLVRLFSISNLIDKFGNPTIVAFMTRPFSVI

SEQ ID NO: 9759 - protein, 352 aa, uncultured rumen bacterium
ITTANNLLAAMVDNHIQQGNELGIDPRAVVWKRCLDINDRNLRNIVVGLGAKADGMVREDHFVITVASEIMAILCLADDMNDLKKRLGRIIVAYNFNGDPVTADDVGATGSMAALLKDALKPNMIQTLEHTPALVHGGPFANIAHGCNSVRATKMAMKLADYTITEAGFGADLGAEKFFDIKCNMAGLKPDCVVLVATVRALKYNGGVPKDELTNENVDALKKGICNLEKHIENLQKYNVPIVVTLNAFVSDTDREVEFVKNFCEERGCEFALSKVWELGGEGGKELAQAVIDSINNKPSNFKPLYDNNLTIEEKIEKVAKEIYGAKDVAYSKAASRELARLKKLGFDNMPV

SEQ ID NO: 9760 - protein, 555 aa, Aspergillus oryzae
MSIQTVSFQSFTDQKPGTSGLRKKVKVFQQPNYSESFITSILLSIPEGAKDAFLVIGGDGRYYNPEAIQKIAKISAAYGVKKLLVGQNGILSTPAASNLIRVRKATGGILLTASHNPGGPNADFGIKYNLSNGAPAPETVTNKIYETSKTLTSYNYAEIPELDLSSIGSKTYGPLEVEVVHSTSDYVKMMKEIFDFDLIKEFLNTHKDFKVLFDGMHGVTGPYGVDIFVNELGLPSSSTMNCVPSPDFNGGHPDPNLVYAHELVEAVDKNGIHFGAASDGDGDRNMIYGANTFVSPGDSLAIISHHAKLIPYFQKQGVYGLARSMPTSGAVDLVAKAQGLQSYEVPTGWKFFCNLFDNKKISICGEESFGTGSNHIREKDGLWAIVAWLNIIAGVAKEKPDQTPSIASIQNDFWQAYGRTFFTRYDYENVDSDGANKVIAILSDKVANKDSFVGSTVSGRKVTDVGNFSYTDLDGSVSKNQGLYAKFDDGSRIIVRLSGTGSSGATIRLYIEKYESDKSKFGLTASEYLKDNVALALSLLNFKEFIGREEPDVRT

SEQ ID NO: 9761 - protein, 583 aa, Mesembryanthemum crystallinum
MATFKVSRVETKPYDGQKPGTSGLRKKVKVFAQPHYLENFVQSTFDALTADKIKGKTLVVSGDGRYYSEQAIQTIIKMSAANGVKSVWVGQDGLLSTPAVSAVIRERVGKDGSKASGAFILTASHNPGGPNEDFGIKYNMENGGPAQEGVTNKIYENTTTIKEYLIAKELPNVNISKTGVTSFSGPDGQFDVEVFDATETYVKLMKSIFDFQAIKKLLSIPSFTFCYDALHGVAGVYAKRIFVDELGANESSLLNCTPKEDFGGGHPDPNLTYAKELVERMGLGKSNTQGEPPEFGAAADGDADRNMILGKRFFVTPSDSVAIIAANAVEAIPYFSGGLKGVARSMPTSAALDVVAKHLNLKFFEVPTGWKFFGNLMDAGVCSICGEESFGTGSDHVREKDGIWAVLAWLSILAHKNKDNLNGEKLVTVEDIVCQHWATYGRHYYTRYDYENVDAGGAKELMAYLVNLQSDLSKVNNIVKGVHSGVANVIAADEFEYKDPVDGSVSKHQGIRYMFEDGSRLIFRLSGTGSEGATIRLYIEQYEKDSSKTGRDSQEALKPLVDVALKLSKMQEFSGRSEPTVIT

SEQ ID NO: 9762 - protein, 388 aa, Bordetella pertussis Tohama I
MIRSKLPDVGTTIFTVMSRLAIEHKAINLGQGFPDFDPDPELCVLVGKAMAAGHNQYPYMPGVAPLREAIAAKVKTLYGHAYDPETEITVTSGATEALMATVLAAVGPGDEVVVIEPCYDSYLPAIRLAGGTAVPVPLRAPTRDDPYYRIDWQRVRDAIGARTRLLMLNFPHNPTGAVLDESDLDALESIVRETGVLLLSDEVYEHIVFDGKPHASLSRRPLLAEHAFVISSFGKTYHTTGWKVGYCCAPRQLSAELRKVHQFMVFTVSSPMQFALAEYMANPKPYLDLPAFYQAKRDRLAAGLANTRFRPLPSPGTFFMLADYSEITKHAEADFARHLTIDHGVTVIPVSAFYQNPAAPESNHHLVRFCFAKQDATLDAAIERLAHV

SEQ ID NO: 9763 - protein, 331 aa, Agrobacterium tumefaciens str. C58
MITRAVKLVEDNAIESAVRTISMERAGLAALEDALRNGLSEPFCKAIETIGQSNGRLIITGVGKSGHIGAKLAATFASTGTPAFFVHAAEANHGDLGMIGGDDVVLAISKGGESAELRSIINYSRRFSIPLIALTCSENSSLARASDIVLLVPNEQEACPLGLAPTTSTLMQLALGDALAVALLEARNFTAGDFKVFHPGGKLGASLTLVSDIMHTGDRVPLVNKGTAMPEAVGVLSRKHFGCVGILDEDGRLCGIVTEGDMARNLSRNLAELVVDDIMTRSPKTVKKSVLATSALATLEKFHIGALIVVDDDNRPIGLVHFHDLLRIGVA

SEQ ID NO: 9764 - protein, 334 aa, Candida glabrata CBS 138
MSNIVGIEYNRVTNTASTDFPGYSSQGANAWDVERFRETFDIQVSSHEERELNFDMIGIDTSLANAFRRIMIAEVPAVAPEYVYIQNNTSVIQDEVLAHRIGLVPLKVDPEKLERLDTSDPDNLEFHDKNTIVMTLNVKCTRNPDAPKDCTDPTILYNNAHVYARDLKFEPHSSQVETFADCPVVPCDPDILLAKLRPGQEISLSTHCILGEGKDHAKFSPVATASYRLLPHIEILEPITGDSAKRFQACFPKGVIGINENGEAYVLDPRKDTVSREVLRHEEFEGKVKLGRVRDHFVFNVESTGAMQPEDIVLKSIDILKKKAEYLKKCQITQ

SEQ ID NO: 9765 - protein, 232 aa, Triticum aestivum
  misc_feature (199)..(199): Xaa can be any naturally occurring amino acid
  misc_feature (212)..(212): Xaa can be any naturally occurring amino acid
RSRKTGVCPNLLHAFPPSLSLSSPPSLCSFLPSKRQSRTPGSSNQAMSLAPSIPSIKVKVGRIAPPPPYRACKSFAVIRSSKAEGPRRPAAPPLSPPPPMPPKTPALSTPPSLSQPPTPVKPAQPSPPPPETKPAVAAAATPPVGGVVTFEYQRKVAKELQEYFKKKKLEETNQGPFFGWLAKNEIANGRWAMFGFAVXDANRVRNRLGFRXANEDPSLQFWDCGFGLMAHV

SEQ ID NO: 9766 - protein, 709 aa, Arabidopsis thaliana
MGCVNSKQTVSVTPAIDHSGVFRDNVCSGSGRIVVEDLPPVTETKLLSWWSKSGKKSSSKKSGSELGSDFGELSESGRASSNCRSESVSFRLGNLSKYLEAEQVAAGWPAWLSNVAGEAIHGWVPFRSDAFEKLEKIGQGTYSSVFRARETETGRIVALKKVRFDNFEPESVRFMAREILILRKLNHPNIIKLEGIVTSKLSCSIHLVFEYMEHDLTGLLSSPDIDFTTPQIKCYMKQLLSGLDHCHARGVMHRDIKGSNLLVNNEGILKVADFGLANFCNASGNKQPLTSRVVTLWYRPPELLLGATEYGASVDLWSVGCVFAELLIGKPVLQGRTEVEQLHKIFKLCGSPPEDYWKKSKLPHAMLFKPQQHYDGCLRETLKLKGLSDADINLIETLLSIQPHKRGTASTALVSQYFTSKPFACDPSSLPVYSPSKEIDAKHREDTTRKKISGNGRRGTESRKPTRKPPAFAKLAPAEDVRHHSQKFQKRNGHSVHNSIDSDSTLFEKMQKPSNHEKDEASHVKNASQGDVPFSGPLQVSVSSGFAWAKRRKDDICVRSHNRSLSRGHIPNLLGPSPAFSENTDVDSKNNEKEKEEKHGERTDSQDREAYEMLKLSMLKKWRQLERPDSFGGSDEYHSQELSLELYQREEKAAKLGHLGYEDNDEKIEFSGPLLSKSYGVDELLERHERQIRQLVRKSWFQKGKKQGK

SEQ ID NO: 9767 - protein, 467 aa, Lotus japonicus
MNMMRRLKSIASGRTSISSDPGGDSNSKRAKLDQETEKKVNEETKTLGGKDQEQHVDASKESTVGTSDVSTVAKTEKSGFDELPKELHEMKIKDEKSKNNNEKDIEASIVSGNGTETGQIITTAIGGRDGQPKQTISYMAERVVGTGSFGVVFQAKCLETGEAVAIKKVLQDKRYKNRELQVMRTVDHPNIVKLKHCFFSTTDKDELYLNLVLEFVPETVYKVSKQYIRVHQHMPIIYVQLYIYQICRALNYLHQVIGVCHRDIKPQNLLVNPQTHQLKICDFGSAKMLVPGEPNISYICSRYYRAPELIFGATEYTTAIDMWSVGCVLAELLLGHPLFPGESGVDQLVEIIKVLGTPTREEIRCMNPHYNEFKFPQIKAHPWHKVFYKRMPPEAVDLVSRLLQYSPNLRCTALAACAHPFFNDLRDPNASLPNGQPLPPLFNFTPEELAHAPDELRLRLIPEHARS

SEQ ID NO: 9768 - protein, 310 aa, Pseudomonas aeruginosa PAO1
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPGRDPGEVARGWLNPRCRLVFVTHGGAGASVHCTHGSWSRPADTALPLRDTVGAGDTFQAATLAYLRRLDADSPAGLAALSREAIDAMLAFAIRAAAVTCSRVGPDLPFAHEL

SEQ ID NO: 9769 - protein, 426 aa, Lotus japonicus
GRVLGQGNFAKVYHGRNLATNENVAIKVIKKEKLKKDRLVKQIKREVSVMRLVRHPHIVELKEVMATKGKIFLVMEYVKGGELFTKVNKGKLNEDDARKYFQQLISAVDFCHSRGVTHRDLKPENLLLDENEDLKVSDFGLSALPEQRRDDGMLVTPCGTPAYVAPEVLKKKGYDGSKADIWSCGVILYALLSGYLPFQGENVMRIYRKAFKAEYEFPEWISPQAKNLISNLLVADPEKRYSIPEIISDPWFQYGFMRPLAFSMKESAVGEDSTIDHFGGEEEEVPELVAAMGKPARPFYNAFEIISSLSHGFDLRSLFETRKRSPSMFISKYSASAVVAKLEGMAKKLNFRVTGKKEFTVRMQGMKEGRKGKLAMTMEVFEVAPEVAVVEFSKSAGDTLEYVKFCEEQVRPSLKDIVWSWQGDSN

SEQ ID NO: 9770 - protein, 422 aa, Schizosaccharomyces pombe 972h-
MNPSCVVYVGNIPYEMAEEQVIDIFKQSGPVKSFQLVIDPESGQPKGYGFCEYHDPATAASAVRNLNNYDAGTRRLRVDFPTADQIRRLDKLLGPSRYGYYPQSYANQSYTYGNNFGSYPPTQPSTQPLPQSYGYPSYPPAGYRGGSARPSGVLANDEVYRVLAQLAPNEIDYMLSAIKALCLEAPEQAAQLFETNPQLSYAVFQAMLMKRYTSESVVADLLIPAGVNLPGAQEPNRGYFSPMHTYSSAVPGPISVPSAPYGRASSTIAEVSPMYGSHAAPYASTPSAAVGSSRGSTPASATVPISPARGFPTTSAYNPAPPAYGMANPAYGSTGIRSSSIPSSGSIRSPSLTTTSAQATTNATNNITTTTAAQDENATKAALIAQLMALTDDQINVLPPDQKERILQIRQALPSSYKTESK

SEQ ID NO: 9771 - protein, 1079 aa, Buchnera aphidicola str. APS (Acyrthosiphon pisum)
MPKSTDIKSILILGAGPIVIGQACEFDYSGTQACKALKEEGYRIILLNSNPATIMTDPDMADATYVEPIHWEIVEKIIQKEKPDALLPTMGGQTALNCALELDHKGILKKYGVQIIGATVDAIKKAENRKLFEHSMKKLNLETAKCGIAHNIQEAFLVLNNVGFPCIIRPSFTMGGHGGGIAYNHEEFEKICERGLELSPSTELLIDESLIGWKEYEMEVVRDKNDNCIIVCSIENLDPMGIHTGDSITVAPAQTLTDKEYQVMRNASMSILREIGVETGGSNVQFAINPKNGRMIVIEMNPRVSRSSALASKATGFPIAKIAAKLAIGYTLDELANDITGTNTTASFEPSIDYIVTKIPRFNFEKFPGCDDRLTTQMKSVGEVMAIGRTFQESIQKAIRGLEVGASGFDSKISSRDSEYLIKIRRELKDAGSERIWYIGDAFRYGMSINDVFDLTSIDPWFLVQIKEIILLEKKIIKNGFIGLKYDFFYFLKRKGFSDQRIAILTNKNESEIRQLRYKLNLHPVYKRIDTCSAEFSTETAYMYSTWEDECESHPSKNNKKIIILGGGPNRIGQGIEFDYCCVHAAQALREDGFEAIMVNCNPETVSTDYDISDRLYFEPITLENVLEIVRIEKPKGVIIQYGGQTPLKLAHEFEKEGVPIIGTSPDSIDTAENRYRFQKTVNKLRLQQPLNATVLTLDEAYKKADIIGYPIMVRPSYVLGGRAMEIVYEPYGLENYFKTTLKKNNTTPILLDQYLDYATEVDVDAICDGETVLIGGIMEHIEQAGVHSGDSACSLPAYTLTSKVQNEIRRQVKKLAFELSVKGLMNIQFAIKNNKIYIIEVNPRAARTVPFVSKAIGLALAKISVRVMCGKTLLEQGFIKEIIPPYFSVKEAVLPFDKFQGVDPILGPEMRSTGEVMGIGKNFSEAFSKSMLGAHTNMKKSGRVLLSVRNNDKNNIINLAVKLKKLGFKIDATKGTSVALKKSGISSRLVNKVHEGRPHIQDRLKNGEYSYIVNTTSCYQGIKDSKLICRSALQYKVHYDTTVNGAFATVMALNENPIKNIETLQKIHKKIQLFYTKK

SEQ ID NO: 9772 - protein, 308 aa, Zea mays
NTVVATVSSARLFLSFPGFATEHKSMLANVIRKAFQETEGFLSLVIKEWSFKPQIASIGSCCLVGVICAGTLYVANLGDSRAVLGRLVKATGEVLATQLSAEHNACYEEVRQELQSSHPDDPRIVVLKHNVWRVKGLIQISRSIGDVYLKKPEYNREPLHSKFRLRETFQKPILSSEPQITEHRIQPNDQFVIFASDGLWEHLSNQEAVDLVQSSPRNGIARRLVKAAMQEAAKKREMRYSDLKKIDRGVRRHFHDDITVVVVFLDSDAMSKASWSKSPSVSLRGGGVTLPAKSLAPFSAPAQLNGTH

SEQ ID NO: 9773 - protein, 373 aa, Oryza sativa (indica cultivar-group)
MTDVELRVEALSLSDVSAIPPEYVRLEEERTDLGDALEVARAASDDADAARIPVVDISAFDGDGRRACVEAVRAAAEEWGVMHIAGHGLPGDVLDRLRAAGEAFFALPIAEKEAYANDPAAGRLQGYGSKLAANASGKREWEDYLFHLVHPDHLADHSLWPANPPEYVPVSRDFGGRVRTLASKLLAILSLGLGLPEETLERRLRRHDQHGVDDDLLLQLKINCYPRCPRPDLAVGVEAHTDVSALSFILHNGVPGLQAHHAGTWVTARSEQGTIVVHVGDALEILTNGRYTSVLHRSLVSCDAVRVSWVVFCEPPPESVLLQPLPELLANGAGKPLFAPRTFKQHVQRKLFKKLKDQQDNNAAAASNGIIPK

SEQ ID NO: 9774 - protein, 494 aa, Rhodobacter sphaeroides 2.4.1
MTDLFHALGIADAATGGSLSVLSPIDGAEIGRVRPTDPAAMPGLIARAQEAFRHWREVPAPRRGELVRLFGEELRAAKAELGALVTLEAGKITSEGLGEVQEMIDICDFAVGLSRQLYGLTIASERPGHRMMETWHPMGPCAVISAFNFPVAVWSWNAALALVCGNPVIWKPSEKTPLTALASMAIFGRALARFGDAPEGLAQLVMGGPEIGEALVLSPEVPIVSATGSTRMGRIVGPKVAARFGRPILELGGNNAMIVAPSADLDMAVRAIVFSAVGTAGQRCTSLRRLIVHHSVREELVGRLVKAYASLKIGDPRADGTLVGPLIDAASRDRMVAALDRARAKGGTVHGGKPVEGVPGGAYIQPALVEMPAQTGVVCEETFAPILYVMGYETLDEAIALQNAVPQGLSSCIFTLNLREAEAFVSAAGSDCGIANVNIGPSGAEIGGAFGGEKDTGGGRESGSDAWRGYMRRQTNTINWSAALPLAQGVRFDI

SEQ ID NO: 9775 - protein, 564 aa, Xanthomonas axonopodis pv. citri str. 306
MCSIFGIFGLQPGDDLQALRRQALECSQRQRHRGPDWSGVYVDTGAILVHERLAIVDPAGGSQPLLSEDGQLALAVNGEIYNHRELKAELLQPYAFQTGSDCEVINALYREDTPASYLNRLNGIFAFALWDKTEGRVIIARDPIGVVPLYWGHDREGRLRVASELKSLVDDCADAAQFPPGHWYDSATGALNRYYERAWRQYGAVEGVQVQLQELREAFERAVHRQLMTDVPYGVLLSGGLDSSLVAAVAARYARHRIEENDITEAWWPRLHSFAIGLKGSPDLAAAEVAAAALGTVHHGFEYTFDEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSSGATRMEKGVLREAFAGYLPESILWRQKEQFSDGVGYGWIDGLKAHAQSQVSDRELAAADRRYPVNPPQTKEAYFYRSLFEQFFPGQAAAETVPGGKSIACSSPTAIAWDASFAAMADPSGRAIAGVHAQALAS

SEQ ID NO: 9776 - protein, 352 aa, uncultured rumen bacterium
IGAANNLLAAMLDNHIQQGNSLGIDPKQITWKRAVDMNDRQLRNIVDGLGGKAQGVPREDGFDITVASEVMAVLCLSSDITDLKRRCGNIIVGYTYGGEPVTARDLKAEGAMAALLKDALKPNLVQTLEGTPAFVHGGPFANIAHGCNSITATRMALKIGDYVVTEAGFAADLGAEKFLDIKCRMAGLKPDAVVIVATVRALKYHGGVAKADLNEENLTALEAGLPNLLQHVSNIKDVYGLPCVVAINAFPTDTKAELDMVEAKCKELGVNVALSEVWAKGGEGGKALAEEVVRLCEEPNDFRFSYELDMSIEEKMEAICKKIYHADGVQLTPGARKQMAKLEEIGCSGMPI

SEQ ID NO: 9777 - protein, 353 aa, Glycine max
CHFGPQNGAFWFTTKAVAAAQEVVRCELPQSIQNNPHKARGISATVSHVRDEAMIPSVAKIGGYREEINRGNMNKNKLELCACTMVWNQARAMKEWVIYHAWLGVEKWYIYDNNSDDEIDDVVRELEVKGYNINRVAWPWIKSQEAGFSHCSLRAKEECKWVGFFDVDEFFYFNEMRRNALISIVGNLSNSIAEIRTGCLNFGPSGLRTHPRNGVSVGYTCRLRTPERHKSIIRPDLLHVSLLNVVHHFELKEGFRSLNMPQSVAVINHYKYQIWEIFKAKFFRRVATYVVDWKEDANIGSKDRAPGLGTEAIEPRDWRLRFCEVWDTRLRDFLLSSFADRETGLLPWERSSE

SEQ ID NO: 9778 - protein, 351 aa, uncultured rumen bacterium
ITTAHNLLAAVIDNHIQQGNALDLDVRRIAWKRVVDLNDRALRHVVIGMGGKAHGVPRETGFDITVASEMMAILCLATDLEDMKKRLGRIVVAYTRDGRAVRADELNVTGALTLLFKDAIKPNLVQTLEGTPALIHGGPFANIAHGCNSVMATKFALKFADIVVTEAGFGADLGAEKFLDIKCRFAGLKPSAVVIVATVRALKMHGGLPKTELAKVDMTALEKGLENLIKHIETVKAFGLPAVVAINAFPTDTKEELDFVEKKCNEFGAEVALSEVWAKGGEGGIALAEKVLAATEKPNNFNFTYEVEQSIPEKIEAIVKRVYGGDGVVFTGPAQKQLEEIEALGLDKMPV

SEQ ID NO: 9779 - protein, 351 aa, uncultured rumen bacterium
ITTAHNLLAAVLDNHIQQGNALNIDVRRVVWKRVLDLNDRALRHVVIGLGGKAHGVPRETGFDITVASEMMAILCLSSSLTDMKRRLGEIVVAYTTDGRAVRAKELNVTGALTLLFKDAIKPNLVQTLGGTPAFVHGGPFANIAHGCNSVMATKYALKLADVVVTEAGFGADLGAEKFLDIKCRFAGFSPDAVVIVATVRALKMHGGVPKSDLSRVDMGALEKGMENLLKHIETIHAFGLPAVVAVNAFPTDTAEELSFVEKKCAELGAEVAVSEVWAKGGEGGLALAKKVEAAMAKPKNFHTLYESDAPIAEKIETVARTVYGADGVTFTSAAKKQLDEIEALGLDKMPV

SEQ ID NO: 9780 - protein, 632 aa, Solanum tuberosum
MAMESALTSTRVSIPSLCSGISSSHHHHRSLSFLNFPKLSSFKYSFRTISPVPFVVSASSVSPSSPSTSVAQSQDLKIKSVPTKPIEGQKTGTSGLRKKVKVFMQDNYLANWIQALFNSLPLEDYKNGLLVLGGDGRYFNREAAQIIIKIAAGNGVGKILVGKDGILSTQAVSAVIRKREANGGFIMSASHNPGGPEYDWGIKFNYSSGQPAPESITDKIYGNTLSISEIKIADIPDVDLSQLGVTKYGNFSVEVVDPVADYLELMENVFDFSLIRSLVSRPDFRFVFDAMHAVTGAYAKPIFVDKLGASLESIANGVPLEDFGHGHPDPNLTYAEDLVNILYGENGPDFGAASDGDGDRNMILGRSFFVTPSDSVAIIAAQCQYAIHYFQSGPKGLARSMPTSGSLDRVAQKLNLPFFEVPTGWKFFGNLMDAGKLSICGEESFGTGSDHIREKDGIWAVLAWLSILAYRNKDKKSGEKLVSVADVVKDHWATYGRNFFSRYDYEECESEGANNMIEYLRDLISKSKAGDKYGSYSLDFADDFAYTDPVDGSVASKQGVRFVFSDGSRIIFRLSGTGSAGATVRIYIEQFEPDVSKHDMDAQIALKPLIDLALSVSKLKDFTGREKPTVIT

SEQ ID NO: 9781 - protein, 352 aa, uncultured rumen bacterium
IGAANNLLAAMLDNHIQQGNALNIDPRRITWRRAVDMNDRQLRNIIDGLGARTDGTPRQDGFDITVASEVMAVLCLASDIIDLKERLSRIVVGYTYDNEPVTAGQLKAQGAMAALLKDALKPNLVQTLEHTPAFIHGGPFANIAHGCNSVTATKLALKLGDYAVTEAGFGADLGAEKFLDIKCRMAGLRPDAVVIVTTVRALKHHGGVAKDKLGEVDLEALEKGLPNLLQHVENITTVFKLPCVVAINRFPTDSEEELRLIEDKCRELGVNVALSEVWAKGGEGGKALAEEVVRLCEQPNDFSFAYDLDLPIKEKLETIARRIYHADGIHLPGNVPKQIKQLEDLGFGKLPI

SEQ ID NO: 9782 - protein, 136 aa, Salmonella typhimurium LT2
MKRYILATVIASLVAAPAMALAAGNNILSVHILDQQTGKPAPGVEVVLEQKKDNGWTQLNTGHTDQDGRIKALWPEKAAAPGDYRVIFKTGQYFESKKLDTFFPEIPVEFHISKTNEHYHVPLLLSQYGYSTYRGS

SEQ ID NO: 9783 - protein, 184 aa, Brassica napus
MQRSEKKNSKVNMVGLRRRRLLGLCCGPNGYVTPLPFLTAEEMISGIPNPNGVAAYGPGPKEEKTPIEEGTRSQRQRTPSKYIMHFMSDSSAISPDDSGPISLKMEQDLCDSDQPLKRRKRHRRKQVKNQEPCLMRGVYYKNMKWQAAIKVEKRQIHLGTFSSQEEAARLYDRAAFMCGREPTL

SEQ ID NO: 9784 - protein, 691 aa, Lotus japonicus
IQSYHFSVYSTSPVSRMKPLLHPSSILTFWFTLFIISINIQTPLCADNDSKYYTNCYEAFSCDGSSVGNLKYPFWGGNRTEYCGQSQLELVCEDRAAKITINSITYRVVKWEDSTQKLTVARDDFWGGVCAVSDYQNSSFDNSPFQYDFSGDNNVTLLYNCGSIDPPSGFYRSSCDGGSRVVYYIVGVGPLSFASACTSVVVPVLASQVSALASTAGNIDEVLNEGFGLRWSGNYQECTGCLDTRGACGFDGKFRCFCEDGPHQSSCISDRAPAPDKRRGSTTRNIVIGVAASCVGGLVAIISIAIYIRRKFKSLSGQTMISRKRSTFVEHDVEAFMQSYGSLAPRRYSYSEVKRITNSFVHKLGQGGYGVVYKATLPDGRLVAVKVISESGGSGEDFINEVSSISRTSHVNIVSLLGFCYDKNRRVLIYEFMPNGSLDNFINGMGSPNAICCFDWNTLYKVAIGIARGLEYLHQGCNTRILHLDIKPQNILLDEDLCPKIADFGLAKICKRKESIVSMLGTRGTPGYIAPEVFSRAFGGVSHKSDVYSFGMLILEMVGGRKNYDSGGGSQSSEMFFPDWIYKDLEQGDVHTNFLVITEEEHEMARKMILVSLWCIQTRSSERPSMNKVVEMLEGTLESVPYPPKPILHSPEKLLLQNSDLTSGNTLETDSMTTEKDGSIELNVLSKNVPG

SEQ ID NO: 9785 - protein, 459 aa, Arabidopsis thaliana
MPGFDRISELPESLITQILLCLPTKDSVKTSVLSTRWKNLWLNVPGLDLTCSDFPFEDEEYEQVFINFIDRFLEFNPESRLQTFEVDYKRREIRGFKDRIGTAINRGIRLLDAVSSTMYWEEECIMYPYLEFMPLNLFTSKTLVTLKLRDSALNDPGLVSMPCLKFMILREVRWSGTMSLEKLVSGCPVLEELTLVRTLICDIDDDELAVTRVRSRSLKTFYVPLAYGVGCRSRVPDKVLEIDAPGLENMTLKEDHFDGIVVKNLTSLFMIELNIKFAVDYRRSFDPEDLSKRNEIGDFLTGISRARHMIISQKTVKALESYSKVGSIPKFNNLSHLKAVFPSPLLPFLPAFLESFPNLKNLILKIAFAKDDETEELNLINVPRCIVSTLECVEIKGLFEWEEEEMKIARYFLENAAVLKKLTMSFIDYPRYASNSDVYEDLDKLTKRSQQCRIIVDDE

SEQ ID NO: 9786 - protein, 422 aa, Coccidioides immitis RS
MSVILCTAGYDHTIRFWEALSGICSRTIQHPLSQVNRLCITPDKRYIAAAGRHSVNLYDIKSNIPDPVMTFNGHTNNVTGVAFHCEGKWMVTSSEDGTVKVWETRSGSLQRNYNHKSPVNDVVIHPNQGELISCDYSGTIRVWDLGENRCSHQLIPEEDVSVASVSVASDGSLLCAGNNKGNVYLWRMVQDHDLTKIVPIATFQAHKDYITRVLLSPDVKHLATCSADHTARIWNLDPEYPPAKAAAEARAAAGEEVQGPNNASSPIPQTPAANGKAHMYQPQLTNGVPETAASQHTTVDRPHEYGSSSDSRGEPVSHPTQRDFDYEGSTENEEPSPQSLALLERPPIDPTTNTLYLETTLAVHQRWVWDCAFSADSAYLVTVCSDHYARLWELASGQIIRQYSGHHRGAVCVALNDYSEPR

SEQ ID NO: 9787 - protein, 181 aa, Brassica napus
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 9788 - protein, 260 aa, Arabidopsis thaliana
SSVFVEQEKYLSELLAERHKLTPFLPVLPHAFRLLNQEILRVTTLLENATVLSQSGLDHPSPLASGGIFQNARADMNGWASQFPSERSVPSSPGPNWLNSPGSSSGLIAKRTIRVDIPVDNYPNFNFVGRLLGPRGNSLKRVEASTDCRVLIRGRGSIKDPIKEEMMRGKPGYEHLNEPLHILVEAELPIEIVNARLMQAREILDDLLTPMEETHDMYKKQQLRELALLNGTLREEGSPMSGSVSPYNSLGMKRAKTREG

SEQ ID NO: 9789 - protein, 324 aa, Neisseria meningitidis MC58
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 9790 - protein, 377 aa, Oryza sativa (japonica cultivar-group)
MAKASVVVPEQVGAAAAAQVGCPCPGTTLFPYPPPRAGIAVRRKCLQAAQQLELGAGLRGGWVESMRASSPTHAKAAAALAAGVDEEHAAWMARHPSALGEFEKVVAASKGKQIVMFLDYDGTLSPIVDDPDAAFMSETMRMAVRSVAKHFPTAIVSGRCRDKVFEFVKLAELYYAGSHGMDIKGPASRHAAAKSPPHNKGVLFQPASEFLPMIEQVHQRLEQATSSIPGAKVENNKFCVSVHFRCVDEKSWGALAETVRRVVREFPRLRLSQGRMVFEVRPTIKWDKGQGPRVPPRLARDVLPVYIGDDRTDEDAFKVLRRRGQGVGILVSKHPKETSASFSLQEPAELKKSSVHYPLPAQRSNRLNRILVNWDEQ

SEQ ID NO: 9791 - protein, 377 aa, Buchnera aphidicola str. APS (Acyrthosiphon pisum)
MAKKDYYQILGIPKSAEEREIKKAYKKLAMKYHPDRNQGDKTAEGKFKEIKEAYEILINEEKRSAYDQYGHAAFENGQSNSTYSTFTNSADFSDIFGDVFGDIFGGNRTQRAKKGADLCYNMEITLEEAVKGIKKEIQIPTLQKCKTCYGSGTRTGTKPRSCSTCHGKGQIHIRKGFFTVQQSCPTCHGKGTIITDPCNLCHGQGRVETYKILSVKIPPGLDTNDRIRLNNEGEAGANGAQSGDLYVQITVKKHPIFEREGNNLYCEVPINFTMAALGGEIEVPTLDGRVKLKIPYETQSGKLFRIRGRGVKSVQNRNQGDLLCRVVVETPVNLNEQQKNLLHELGNSFHGFRGEKNSPRSKRFFDGVKRFFDDLTR

SEQ ID NO: 9792 - protein, 600 aa, Buchnera aphidicola str. APS (Acyrthosiphon pisum)
MIDLMPKKNTFLLKKKYKEDSNNSVINNLFDFFGKEFCFHQITLTGFPIIWIDKTLLIEVGKFLYHLSQPYIMLYDLHGVDERIRLHREDLPKADFSVFYHLISIERNSDIMIKVPLLENDLILPTFTGLFPNANWYERETWDMFGIIFNNHPNLTRIIMPSTWKGHPLRKNYSARATEYEPFFLNEQKEDLEMEGLKFKPELWGMKRKNDNVEFMFLNLGPNHPSAHGAFRIVLQLDGENIVDCVPDIGYHHRGAEKMAERQSWHSYIPYTDRIEYLGGCVNELPYVLAVEKLANISVPEKAEVIRVMMSELFRINSHLLYISTFIQDVGCMTPVFFAFTDRQKIYDLIEAITGARMHPAWFRIGGVANDLPQGWNILLKEFLDWMPKRLKYYINTALKNSILIHRSKGIAEYNKKEALQWGVTGAGLRATGLNFDVRKWRPYSGYQNYTFEVPVGSGISDCYSRVMIKVEEIYQSLFILKQCLCNMPSGPFKSEDSLTTPPSKECVLQNIETMITHFLQVSWGPVIPENESFQMIEATKGINSYYLISDGGTMSYRTRIRTPSFPHLQQIPSVIRGSLISDLIVYLGSIDFVMSDVDR

SEQ ID NO: 9793 - protein, 407 aa, Terrabacter sp. YK3
MTAPHHVIVGGSAAGVAAALAMRRNGFEGRITLVEAASEEPYERPPLSKSFTDLDAPRRILPPSTYVEEDIDLLLGMPVAALDVDRKVVRLPDGEGLGADAVLVATGVNARRLGVPGEYLEHVLVLRGLADARALAARLDVGGPWVIVGGGFIGLEAAAVARGRGIDVTVVEAMPVPLAGVLGPALAAHVQRMHEREGVRILGGRTVTEFVGEREVEKVVLDDGSVLDAATVLVGCGVEPNDELARDAGVYCNGGIVADRHGRTSVPWIWAAGDVATFVSPFTGRRQRIEHWDVANRLGTVTGANMVGVPAVNTDAPYFWSDQYGHRLQMYGRHQPGDQFVVRPGVTTAQFVAFWVRDGRVTAAAAIDSPKELRATKPLIEGRVPVMASDLIDPAVSLRALGRVAHP

SEQ ID NO: 9794 - protein, 165 aa, Mesorhizobium septentrionale
MFADGVMFDGSSIAGWKAINESDMVLMPDPDTVHMDPFFAQSTMVILCDILDPVSGESYNRDPRGTAKKAEAYMKSEGIGDTIYVGPEAEFFVFDDVKYKADPYNTGFRLDSTELPSNDDTDYETGNLGHRPRIKGGYFPVPPIDSAQDMRSEMLTVLAEMGIRV

SEQ ID NO: 9795 - protein, 198 aa, Zea mays
MSGNPVGVDNTSRRKFDKEEYLERARQREKDEARKGKERGPPVQRQPLKHRDYEVDLDSRLGKTQVVTPIAPLNQQAGYYCSVCECVVKDSANYLDHINGKKHQRALGMSMRVERASLEQVQKRFEALKKRKDPSAFTEEDLDERIMKQQQEEEERKRQRKEKKKEKKREQATQHEPEDVDPDIAAMMGFGGFGSSKK

SEQ ID NO: 9796 - protein, 185 aa, Glycine max
MGASGNNFLQVVAKNFDVLALPLVTLVYPLYASIKAIETRSSTDDQQWLTYWVLYSLITLFELTFAKVLEVLAIWPYAKLILSCWLVLPNFNGAAHVYRHYVRPFYMNPQMPQMPQMPQIPGTSQMWYVPRKNIFSKQDDVLTAAERYMEEHGTEAFERLITKADREARARRNGNYMIFDDDYID

SEQ ID NO: 9797 - protein, 369 aa, Rubrobacter xylanophilus DSM 9941
MQIFEKLEEYRYEQVVFCHDKATGLKAIIVIHNTTLGPALGGCRMYPYESEEAAVVDCLRLARGMTYKAAVSGLNLGGGKSVIIGDPERDKSEALFRSFGRYIETLGGRYITAEDVGTSTEDMANIQVETSYVVGVDKTYGGSGDPSPFTALGVLQGMRACVEEVFGAPSLEGRTVAVQGLGHVGYHLCRLLDEEGANLIVADVRADRVEQAVEEFGAKPVPPEEIISASCDVFAPCALGAVVNDESLPRLRCQIIAGSANNVLLEPRHGEELARRGILYAPDYVINAGGLINVADELEGYNAQRATSRVMRIYDAVKGVIAISKRDGVPTHVAADTLALERINSIAGMVRLHTGHPYGHLQRRSRERL

SEQ ID NO: 9798 - protein, 352 aa, uncultured rumen bacterium
IGAANNLLAAMIDNHIYQGNALDIDPRRVVWRRCVDMNDRQLRNVVDGLGGKANGYTREDGFDITVASEVMAAFCLATGLDDLKERFSKIVVAYNRSGDPVTAGQTNAQGAMTALLKDALKPNLVQTLEGTPAFIHGGPFANIAHGCNSVMATKMAMHFGDYVVTEAGFGADLGAEKFIDIKCRLTGLRPDAVIIVATIKALKYNGGVPKADVGKENLEALEAGIPNLLKHVENVTKVFGLPAVVALNRFVNDTDAEIELVTKKCAELGVNVKMSEVWGKGGEGGIELAEEVIRLCEQPNEFKFAYDENLGIKEKIEAIATKVYGADGVDFAPKAAKEIEELEKFGYGNIPV

SEQ ID NO: 9799 - protein, 488 aa, Salmonella typhimurium LT2
MKKINHWINGKNVAGNDYFQTTNPATGDVLAEVASGGEAEVNQAVAAAKEAFPKWANLPMKERARLMRRLGDLIDQHVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQVGALISQQHWEKVSGYIRLGIEEGATLLAGGAEKPTDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 9800 - protein, 352 aa, uncultured rumen bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLVPDACVLVATVRALKMHGGVAKADLKEPNVEAVKKGLPNLGKHIENIFKFGVPVVVAINIFAQDTKEELQAVYDFCAGMGVNVALSDVFARGGEGGVELAKEVVALAESGMARFKPIYPLEMSLREKVATVVKEVYGGDRVEFQTKAAQALDQYEKEGYGNLPV

SEQ ID NO: 9801 - protein, 634 aa, Cleome spinosa
MKTTRLMVVVMIRRFSVCFFGFLWLLGSASALLSPQGVNFEVRALMDIKASLNDPHGVLESWDRDAVDPCSWTMVTCSSENFVISLGTPSQSLSGTLSPSIGNLTNLQIVLLQNNNISGRLPTELGRLTKLQTLDLSDNFFHGEIPSSLGRLRSLQYLRLNNNSLSGAFPLSLANMTQLAFLDLSYNNLSGPVPSFAAKTFSIVGNPLICPTGAEPDCNGTTLMPMSMNLNETGALLYNESHKRNKMAIVFGSSVSSVSFIILVFGLFLWWRQRRHQRTFFDVKDGHHEEVSLGNLRRFSFRELQISTHNFSSKNLLGKGGYGNVYKGILADGTVVAVKRLKDGNALGGEIQFQTEVEMISLAVHRNLLRLFGFCITPAEKLLVYPYMSNGSVASRLKGKPVLDWSTRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELITGQRALEFSKAANQKGAMLEWVKKIHQDKKLEVLVDKDLKGNYDGIELEEMVKVALLCTQYLPGHRPKMSEVVRMLEGDGLAERWEASQRTESTSKCSSRPNELSSSDRYSDLTDDSTLLVQAMELSGPR

SEQ ID NO: 9802 - protein, 103 aa, Anabaena sp.
MSVYVGNLSYDVTEDSLNAVFAEYGSVKRVQLPTDRETGRMRGFGFVEMGSDAEETAAIEALDGAEWMGRDLKVNKAKPKEDRGSFGGGNRGGYGGGGGPNRY

SEQ ID NO: 9803 - protein, 352 aa, uncultured rumen bacterium
ITTANNLLAAMVDNHIQQGNELGIDPRAVVWKRCLDINDRNLRNIVVGLGAKADGMVREDHFVITVASEIMAILCLADDMNDLKKRLGRIIVAYNFDGEPVTADDVGATGSMAALLKDALKPNMIQTLEHTPALVHGGPFANIAHGCNSVRATKMAMKLADYTITEAGFGADLGAEKFFDIKCNMAGLKPDCVVLVATVRALKYNGGVPKDELTTENVDALKKGICNLEKHIENLQKYNVPIVVTLNAFVSDTDREVEFVKNFCEERGCEFALSRVWELGGEGGIELAQAVIDSINNKPSNFKPLYDNSLTIEEKIETVAKEIYGAKDVAYSKAASRELARLKKLGFDNMPV

SEQ ID NO: 9804 - protein, 313 aa, Synechococcus sp. WH 7805
MWFPNRQAGGQTQNGKMISGTTGLIGLLGQPVRHSLSPVMQNAALEAMGLDWRYLALPCAESDLECVLTGLRAVNCRGLNVTIPHKQAVASYCTDLSALASRLQAVNTLIPTDNGGWHGHNTDVEGFLAPLQTAAEAWNNSTAIVLGCGGSARAVVAGLQQLPLKAIHIAGRRDAALAAFLNDLRQTVGEERVPLFGMPLERSRVRELLDQACLVVNTTPLGMEGHQNGSSMPLDREIWTDLTSSTTLYDLIYTPRPTPWLSLGAERGCRTIDGLEMLIQQGAASLRRWSGCSDVPVEVMREAALDSLASTRR

SEQ ID NO: 9805 - protein, 713 aa, Cytophaga hutchinsonii ATCC 33406
MSNNTQETAGFNFAPQVSAAAQADIVELSTKIKGFRDNTIDSEKFRSFRLTRGVYGQRQEGVQMIRIKLPYGKVTTDQIIRIADISDKYGSSNLHLTTRQDIQLHYVKLENAPLVWNELEEVGVTLREACGNAVRNITASYTAGVDPNEPFDVSPYAHSMFEYFLRNPICQDMGRKFKISFSTSEADTAFGFIHDLGFIPRVKTVNGKEVRGFKVLLAGGLGAQPFVAHNVHEFLEEDQLIPFSTAVIRVFDRFGERSKRHKARLKYLVNGIGVEAFMEHVAKERIAIKDKSVVIDRNRVDEIILPAVTSFTEATPVDAVKFERFVKANVFEQKQKGYFGVQLKQHLGDLKSDKARVFAAIVKKYASDDVRITVNQGWLLKFVKKEALPALFNELNEIGLAEPGFDSMADITACPGTDTCNLGISSSTGLSVEIEKMLLEEFPDTVFNKNIKIKISGCMNACGQHTIGNIGFHGMSIKNGTNVLPAMQVMLGGGLEPDGTGTIADKILKLPTRRCVEAVREILTDYDTNATEGEYFNDYYRRQVAAEKMYFYKLLKPLSDLETLTELDYIDLGHDEKYVTEVGVGECAGVMIDLVGTLILDTEEKLKWSKRLQQNATPADAIYAAYATYVCGAKAILTGEGVACNTQIAMINDFDKHLVSTNKFSIAGGSFASQVLCMSEHEPTKEFADKYIADTEQFVQQIKTYRAAALVTV

SEQ ID NO: 9806 - protein, 509 aa, Mesoplasma florum L1
MPKKFYVTTPIYYPSGNLHIGHAYTTTLADILKRYKDMQGYETFFLTGSDEHGQKIEEKATEAGLTPIDYLEDKVESFKTLWKALKIDYTKFIRTTDSYHEETVKKIFTLLLDKGFIYKGNYEGLYCISCEEFLNADQIDENNMCKISNTKLELVKEETYFLKTSLFQEFMENEVLASEFLIPAYRRNEMLNSFVKPELKDLSVTRTSFSWGIPINEDPKHVVYVWLDALTNYITALGYLQNDDSNFQKFWADENTEILQLAGKEIIRFHSIYWPIILKSLGLRQPTHLLGHGWILSKDTKMSKSLGNVIDPIEMINKYGADALRFYIGYELPTEKDGNFTDDLFIESFNAHLANNVGNLISRINQMITKYFDGFIENDNIVYDDNLTAKGIETINLYIQNMDQYKISDAIRNILDLGNACNKYIEETMPWNLAKEEKIDELKNVMATLQRNISIMVFLLKPILVENYEDMIEQIGLSGVELTFDKINNWDKIIFKKLGDKKIIFKRVN

SEQ ID NO: 9807 - protein, 299 aa, Brassica napus
TFFVKSFGVFDLDGLLKASAEVLGKGAFGSSYKASFEHGLVVAVKRLRDVVVPEKEFKEKLQVLGSISHPNIVTFGRVGGRVGEKLVVFEYMSRGSLSALLHGNKGSGRSPLSWETRAGIALGAARAISYLHSRDATTSHGNIKSCNILLSESYEAKVSDYCLAPMISPTSTPNRIDGYRAPEVTDARRISQKADVYSFGVLILELLTGKSPTHQQLNEEGVDLPRWVSSITEQQSPSDVFDPELTRYQAEGNENMIRLLKIGISCTAQYPDSRPSMAEVTRLIEEVSRSSGSHSPLSG

SEQ ID NO: 9808 - protein, 540 aa, Archaeoglobus fulgidus DSM 4304
MRYNLTIKKTLFFPLHAFPNKEIVYRDINRYTYRRFYERLQRVASSLENIGARGAKIAFIDWNTHQYLEGMFAIPMMGSILHCVNLRLAPEEIVYTMRYVEDDFVVIRDEFLPLAEKLAPHVPSVKGWIVTGDDVDKVETSLKPVYIWEDLVKEGSSYDFPELDEHETAVVYFTSGTTGLPKAVHFSHRQVVMQCIINGLALSANESPARMSSADTIMHIPPFFHGMGWTFPYLATMLGMKQVLPGRYEPQVMLDLIKNEGVTFAGGVPVFLKMLIEHPEAEKYKDALSKFKFVCDGEHPQRVLFERAKQLGIKMIEAFGMSEGVGFTFAVLKDHMLDWDWERQVEYLNKAGLPAPFVEVRIVDDEGKEVPRDFQTMGEILIRSPGLTEGYWKNPEKTAESWDEEGWFHTGDLGVWDEEGYILILDRAKDVIKSGGEWISSVRLEGYILEHPAVSEAAVVAARSEKWSERPIAVVVPKPGMSVTEKEIIDFLMKNFVETGKMAKWWLPDRVFIVDEMPRTTVGKINKRAIREKYKDLVLP

SEQ ID NO: 9809 - protein, 488 aa, Kluyveromyces lactis NRRL Y-1140
MYLNDTGIRRCGPPRPRPRSTHPLLAQLESSACATAIKDYEKELLAYFQELQECDLPNPKMIDNQPELDWYMRPYLLDFLIDLHGILRLSEPVLFLAIQIMDRYCSKRIVFQKHYQLVTTTSLWIAAKFEDKKSRTPTLNQLISACSHIYDSYMFIQMESHILETLRWNIRTCFTTFDAIQLCFKDTDIIWPTEDVSMLQIVSIFFAELSCYDKHYMAFSSSVKATSGIILASVLLGDNCFQKHISTLLLDFLDLKCESLGLTVCHHSVVSSCKEKDPFSIICAPLLRVDENTHVDIRRCCLLYLNDIFKPLTANKDLPTALMSKYDKICLQDYITAYTSQNIDKYLHLCKLTQALLNPIYDRTRLLEQINMVTDIMVGLELCQQGPIRDELPLKIYQSVLLPSSDELKEEILKNNELHGSSRSASSTEITSPWTPASVFSAKRSLSDASSIDNELDLVDVPRAKDARALRLPTPLRKCVSSDFAPNI

SEQ ID NO: 9810 - protein, 329 aa, Mesoplasma florum L1
MAVINNIKAVTEALDVAMDRDKNVIVFGEDVGLEGGVFRATQGLQQKYGIERSFNAPISEAMFAGVGLGMAMNGMKPVVELQFQGLGLPALQNVIANISRMRNRSRGKWTAPMVIRMPMGGGIRALEHHSEALEAIFAHIPGIKTVMPSTPYDTKGLLLAAIESPDPVIVLEPTKLYRAFKQEVPDGYYTVPIGEGYKIQEGNDLTIVTYGAQTVDCMKAVEMIKSTHPTASIELIDLRSIQPWDKKMVIESVKKTGRLLVVSEAVRSFGVPAEIIATVNENCFDSLKAPLARCTGYDVVIPYDRGEGFHQVNPQKVVEAIKKVLDYKF

SEQ ID NO: 9811 - protein, 422 aa, Mesoplasma florum L1
MFKVKFADIGEGLTEGKVAEVLVKLGQEIKEGDALFFVETDKVNSEIPAPVGGKIANILISQGQEIKVGDVVIEIDDGSSAAEVTPVAEIKTKNEPIEENASVVGSTPVSNDVIASRATTNAAAEISNSGVKATPLARKIAADKKIDLSTIKGTGPHGRILVSDLDSAPVAVPNTNSATKTVVKSVDVDAPLSWDSIPMNGIRKATVKAMVKSQSENAAFTGMKNINITPTYDMRAMLKDGCESKGIKLTYLAFIVKAAAKVLEEMPNINVRIDAENNAILQVHNINIGIAVDTEKGLMVPVIKGANHLTIFEIANKIGELAKKARDGKLAMTEMKDATFTVSNFGSVGLDYATPIINSPESAILGVGTMTKTPIFVKDEIKAGWIMPFSMTCDHRIIDGGDAGRFLMKIENYLSNPALLLM

SEQ ID NO: 9812 - protein, 602 aa, Mesoplasma florum L1
MFKVKFADIGEGLTEGKVAEVLVKLGQEIKEGDALFFVETDKVNSEIPAPVGGKIAKVLISEGQEIKVGDVVIEIDDGSATVEAAPAAEEENASVVGSTPVSNDLIPSRGPAPTQNVAAQPTPAPVATKHTDIEESFDVIVVGAGIGGYVSAIKTAQLGLKTLIIEKQYYGGVCLNVGCIPTKSLLRTAKVFEDIVHKAANLGIDMKTKDEPSINWNKALERKDGVVNKLTGGVKVLLTKNGVKQIIGEASALDKNTISVNGKKYHCDNLIIASGSVPNELPLPGFAEGRESGFLIDSTKILSLPKIPKTLTVIGGGVIGIEFGCLFAALGTKVTVIEGAPKILPMLDQDVTALMTKTLKEKYKIEIFTNAKVKEVKGKSVVFEIDGKEQTVKSDYCLESIGRKTVTKGFDGIGLELSERKSIIANDYGETNLEGVYAIGDVTSKIMLAHVASHAGIVTANRIALKANKPDAHDIKMDYSKIPSCIYSHPEIAMIGKTEQQLKEEGVEYKTFKFPFAAIGKALADDDTTGFVKIICEPKYKTLLGAHIIGNRATDMISEFTTLIECEGTITELARAIHPHPTMSEAIGEAAEALESGKSLNL

SEQ ID NO: 9813 - protein, 401 aa, Xanthomonas campestris pv. vesicatoria str. 85-10
MLSDPIIDVLTSGVAGLGVWGMLAVLLVFTQLTIFAVTLYLHRSQAHRGVDFHPAIAHFFRFWTWLTTSMITREWVAIHRKHHAKVETEEDPHSPQTKGIGQVFWRGVELYRQARAERADIEQYGKGAPSDWIERHLYTPHANAGPMALLVINSVLFGLPGIALWAIQMAWIPFWAAGVVNGLGHWWGYRNFESADTSTNLTPWALWIGGEELHNNHHAFPSSARFSMRRWELDIGWVAIRGLQALGLAKVLRVAPSLDIRPNIAVPDADTLKALLSHRFQAMTDYQRNVLKPALREEAAVTGAKLRELLPRRLRKGLVDDGRWLKPDARAQLQAWVAQRPRMRTLVEYRARLTAVLEARSHDASERLRQLQQWCHEAEASGNAALQAYAARLKGYALSGA

SEQ ID NO: 9814 - protein, 180 aa, Buchnera aphidicola str. APS (Acyrthosiphon pisum)
MTLKNIIIGFFTQIRSIFMIGANIFSKPETKLYPEEKVYLAPRYRGRIILTRNIDGQERCVACNLCAVVCPVDCISLQKSEKTDGRWYPKFFRINFSRCIFCGLCEEACPTAAIQLMPDFELSDFKRQDLVYEKKDLLISGPGKYPNYDFYNFSGVTLKGKKTGDLEIQARPIDVKDLLP

SEQ ID NO: 9815 - protein, 95 aa, Oryza sativa
  misc_feature (27)..(27): Xaa can be any naturally occurring amino acid
MGCDDKCGCAVPCPGGTGCSVCPRVWXRCASSARSGGGDHTTCSCGDHCGCNPCRCGRESQPTGRENRRAGCSCGDSCTCASCGSTTTTAPAATT

SEQ ID NO: 9816 - protein, 473 aa, Zea mays
TQPSPERGVFCSVIINQCTMASLIPPCLSVPTAPGRARLAAPGAPRRRRMAVVRAKIREIFMPALSSTMMEGKIVSWTAAEGDRVGKGDPVVVVESDKADMDVETFHYGIVAVVLVPAGGTAPVGAPIALLAESEEEVALARARAQALSQGQSQAPSPPHAAAALGPPPPAPVAPPATKGIATPYAKKLAKQHRVDIAGVVGTGPHGRVTAADVEAAAGIKHKRPPPPPPPASVDAAPLVPASAVLPPVPGGTVVPFTTMQAAVSKNMVESLRVPTFRVSYSMITDKLDALYEKVKSKGVTKTVLLVKAAAVALTQHPVVNASCRDGKSFSYNNDVNIGVAVALEGGLLTPVLEDADKMDIYLLARKWRVLLKKARMKQLQPNEYNSGTFTLSNLGMFGVDKFDAILPAGQGAIMAVGASRPTVVADKDGFFSIKSEMLVNVTADHRIIYGADLAAFLQTFAKIVEDPECLTL

SEQ ID NO: 9817 - protein, 801 aa, Vibrio parahaemolyticus RIMD 2210633
MKFSESWLREWVNPAVTTDELTHQITMAGLEVDDVLPVAGSFTGVKVGHVVECGQHPDADKLRVTKVDVGEEELLDIVCGAHNCRQGLKVAVATVGAVLPGDFKIKKAKLRGQPSHGMLCSFTELGIDVESDGIMELAEDAVIGTDFREFLGLDDVTVDVDLTANRADCFSIRGLAREVGVLNRADVTEPSVEAVAPSIEDKVSIEVKAPAACPRYLGRVVKNVNVQAETPLWMQEKLRRCGIRSIDPVVDITNYVLLEQGQPMHAFDLAKIEGGIVVRMAEQGEKLTLLDGSEAELNADTLVVADHNKALAIAGIFGGEESGVTTETKDVLLECAFFAPDHIRGRARSYGLHTDSSMRFERGVDYALQVSAMERATQLLVEICGGEVAPVVAVESEADLPKPNKVALRRTKLDNLLGHHIADADVVEILERLGLTVEASEEGWVAVAPTWRFDIAIEQDLIEEVGRIYGYDNIPNQNPAAALKMHNHVEADLPLKRVRDLLVDRGYHEAITYSFVEPEQQKLVVPGVEPLVLPNPISADMSAMRLGLIQGLLNTVVHNQKRQQPRVRLFEYGLRFIPCESAENGMRQEPMLAGVIAGTRGEEHWDIETNTVDFFDLKGDLEAVLELSANEKAYSFAALSPESKKANPALHPGQSAAIIVDGKEVGVIGTVHPELERKFGLNGRTIVFEIEWSAINSKVIPEAVALSKFPSNRRDIAVVVDEAVASGDIVNACLEQGGEFLKDAKLFDVYVGKGVEEGKKSLAIALTLQSLERTLEDADIAGAVDAIVAHVSEKFGAALRD

SEQ ID NO: 9818 - protein, 470 aa, Erwinia carotovora subsp. atroseptica SCRI1043
MEQHASGSEGQFKRTMKARHLVMLSLGGVIGTGLFFNTGYIISTTGAAGTLLAYLIGALVVYLVMLSLGELSVAMPETGAFHVYASRYLSPATGYTVAWLYWLTWTVALGSSLTAAGFCMQYWFPQVPVWTWCLLFCALIYLLNVVSSRFFAEGEFWFSIVKVVTILAFIVLGAGAMFGFIPMQDGSPAPFFQNITASGWLPHGGLPILMTMVAVNFAFSGTELIGIAAGETENPQKVVPMAIRTTVARLVIFFLGTVLVLAAIIPMEEAGIAKSPFVLVFEKIGIPYAADIFNFVILTAILSAANSGLYASGRMLWSLSNEGTLPRRFSRLTRRGIPLFAISVSMLGGLLALFSSVVAPDTVYVALSAISGFAVVAVWLSICASHYMFRRHHIRSGKSLSELQYRAPWFPITPILGFLLCLLACVGLVFDPSQRIALWCGIPFVALCYGAYYFTQSVKKRGLTGVEDIA

SEQ ID NO: 9819 - protein, 204 aa, Magnetospirillum magnetotacticum MS-1
MASVNGPLRVGIGGPVGSGKTALMEQLCRRFRETYEICAITNDIYTKEDARILTVAGALPEERILGVETGGCPHTAIREDASINLAAVAEMRRRFPRLDLVLIESGGDNLAATFSPELADITLYVIDVAGGEKIPRKGGPGITRSDLLIVNKTDLAPLVGADLSVMEADTRRMRGTRPYVFASLREGHGADTVARFIVEAGGLA

SEQ ID NO: 9820 - protein, 544 aa, Cryptococcus neoformans var. neoformans B-3501A
MATEEIHSLYDTILILDFGSQYSHLITRRCRELNVYCEMLPCTQKVSDLSWKPKGVILSGSPYSVYAPDAPHVDPEVFTLGVPILGICYGLQEIARVHGGSVDAHTHREYGYAKIEVVKTGKKEQDALFEGIEMEADGGLQVWMSHGDQLTSLPPNFVTIASTPTSPYTSVAHESKPIYGVQFHPEVSHSPKGKEVIAAFVKNICSVRDGWSMESFIPKEIARIRQICGEKGQVIGAVSGGVDSTVAAKLMHEAIGDRFHAIMVDNGVLRKDEAKKVHKMLTVDLGVNLTVVDASELFLARLKGVEDPERKRKIIGNTFIEVFEAEAAKLEAAAEKELAEKGGEAKGKIEWLLQGTLYPDVIESISFKGPSATIKTHHNVGGLLEDMKLKLIEPLRELFKDEVRALGRLLNIPEHLVGRHPFPGPGLAIRILGEVTREQIAILQHADDIYIEEVRAAGLYDQISQAFVALLPVKAVGVAGDARTYDQVVAVRAVSTEDFMTADWFVFPPQVLKRISSRITNEVKGVNRVVYDITSKPPGTVEWL

SEQ ID NO: 9821 - protein, 582 aa, Populus tremula
  misc_feature (567)..(567): Xaa can be any naturally occurring amino acid
MVLFNVSRVETTPFGDQKPGTSGLRKKVKVFKQPNYLQNFVQSTFNALTPQNVRGATLVVSGDGRYFSKDAIQIITKMAAGNGLRRVWVGQNGLLSTPAVSAVIRERVGVDGSKATGAFILTASHNPGGPNEDFGIKYNMENGGPAPEGITDKIYENTKTIKEYLTADLPDVDITTIGVTSFSGSEGQFDVEVFDSASDYIKLMKSIFDFESIRKLLSSPKFTFCYDALHGVAGAYAKRIFVEELGAQESSLLNCVPKEDFGGGHPDPNLTYAKELVARMGLGKSNSEVEPPEFGAAADGDADRNMVLGKRFFVTPSDSVAIIAANAVEAIPYFSAGLKGVARSMPTSAALDVVAKSLNLKFFEVPTGWKFFGNLMDAGLCSVCGEESFGTGSDHIREKDGIWAVLAWLSILAYKNRENLGGGKLVTVEDIVHNHWATYGRHYYTRYDYENVDAGAAKELMACLVKLQSSLTEVNEIVSGIQSDVSKVVHADEFEYKDPVDGSISKHQGIRYLFEDGSRLVFRLSGTGSEGATIRLYIEQYEKDPSKTGRDSQDALAPLVAVALGLXKMQEFTGRSAPTVIT

SEQ ID NO: 9822 - protein, 351 aa, uncultured rumen bacterium
IGAANNLIAAILDNHIKWDNKLGIDPRRVVWRRCIDMNDRQLRNVVDGLGGVVNGMPRDDGFDITVASEVMAAFCMASSLEDLKTRLGKMVVAYTFDRKPVTVHDLRVEGACAALLKDAIKPNLVQTLENNPAFVHGGPFANIAHGCNSVVATATAMKMADYVITEAGFGADLGAEKFFDIKCRATGMVPSAVVVVATVRALKYNGGVPKDELTTQNLQALEEGLPNLLQHVRNIREVYGLPCVVAINAFPTDTAAEISLVQDRCHSLGVNVVLSEVWAKGGEGGRALADEVERLCNEPSSFHFAYDLDLPVEEKIETIARRIYHADGVHIDPLSKQIEEIERLGFGNLPI

SEQ ID NO: 9823 - protein, 140 aa, Brassica napus
VESDSGDRKRRRRSKKRRTHKRRSVSESEEEEEDGRSKRRKERRGRKRDDDYSDESSDEDRRSVKRKSRKEKRRRRSRRNRSDDSDSSEDDASGRRQKRRNKVAASSDSDVSGDDEDSRVGRGSSKRYEKKSRKRHHRKD

SEQ ID NO: 9824 - protein, 352 aa, uncultured rumen bacterium
IGAANNLLAAMLDNHIHQGNSLNIDSRRIIWRRALDMNDRQLRNIVDGLGNRADGVPRQDGFDITVASEVMAVLCLASDISDLKERLARIVVAYTYENKPVTAGDLKAQGAMAALLKDALKPNLVQTLEGTPAFIHGGPFANIAHGCNSVTATRMAMKLGDYAVTEAGFGADLGAEKFLDIKCRMAGLKPSAVVIVATVRALKHHGGVAKADLAKEDLEALKKGLPNLLQHVENIRNVYKLPCVVAINAFPTDTKAELDLIEASCRELGVNVALSEVWAKGGEGGKALAEEVVRICEEKNDFSFAYDVNDPIEKKLEDICRRIYHADGVQLVGSAPKQLQQLKDNGFDSLPI

SEQ ID NO: 9825 - protein, 152 aa, Cleome spinosa
MAPALNLPGGDAENDELRRLLVANMDDAAARRRTREAFKDIQLSLDHILFKTPSDGIKTKESYEVNSRGVEIFSKSWLPEDSCPKAVVCFCHGYGDTCTFFFEGIARKLALSGYGVFAMDYPGFGLSEGLHGYISSFDLLVEDVIEHYSNVK

SEQ ID NO: 9826 - protein, 94 aa, Arabidopsis thaliana
  misc_feature (25)..(25): Xaa can be any naturally occurring amino acid
  misc_feature (60)..(60): Xaa can be any naturally occurring amino acid
  misc_feature (65)..(65): Xaa can be any naturally occurring amino acid
PLWLRHLLKYLPPQATMVAPFTGLXSSTSFPVTRKANNYITSITNNTGRLSCIKVWPPIXRRSFXTLSYLPDLSDLELPKEVDYLLLNKYIPCV

SEQ ID NO: 9827 - protein, 849 aa, Zea mays
MGTTAPVAGAVVVRVKQSMLLVLVIVTSVLVVGPTADRGAFASPPPEPVQCSSGGGTANCTVSSAYGVFPDRSTCRAAAAVFPASEDELVRAVAAAAAASGTKMKVATRYSHSIPPLACPGSGRGEGLVISTRRLDRVVSVDPAAGRVTVESGVTLRDLVEEAAKAGLALPYEPYWWGLTVGGMLGTGAHGSSLWGNGSAVHEYVVGMRIVTPAAAAEGYAKVRVLTAADPDLDAAKVSLGVLGVISQVTLALQPLFKRSVTFSERDDDDLAEQVGTFGYRHEFADIAWFPGHGRAVYRIDDRLPLSAPDDGAMDFIGFRATPTLAIQATRLAEDLFERADNGSGKCLTSRVTHATLSAAGYGLQWRSGGLFAGYPVVGPQHRMQASGGLPVRRAVLFVAEVRRLRDLEPRALCGVELYDGILIRYVKASTAHLGKPAPRGEPSGDMVDFDITYYRSRDSGRPRLFEDVLEEVEQMGIFKYGGLPHWGKNRNLAFVGAARKYSGLPRFLRVKDAYDPDGLFSSDWSNMMLGIGGRSPTTDAPGCALEGMCVCSRDEHCAPEQGYVCRPGKVYKEARVCTRFALPAVILKLRRPKWWTQAEITHFRPTNGGQDSSTTHLFFPHYQATQSPEPGGFPQRYPAPPLAAPAKARAQFINVGTAGPTAGATGTLLRRYPRLPEPSCSSLCSRKRRVYPSPPLRPPPPPPPARRPPLLWMLRVATGILDGRQPCGGRVVPLLLLARRHGYPPRPPHKNIARLLKAKRFRKPDISETIQELLGGKVGRGQLSGGLVVDVGANVGMASFVAAVMGFRVLAFDDSSPCSRICSGYSTGCTSTGCSTALWCITLRGCSF

SEQ ID NO: 9828 - protein, 351 aa, Cleome spinosa
MALRSLILGLLSFILLFHLLVSSTTTMALRVGVVLRKPLEPALPVFREAPAFRNGDQCGTGESDQIHIAMTLDTNYLRGTMAAVLSLLQHSTCPENLSFHFLSLPHFETELFTSIKSTFPYLSFKIYQFDPNLVRSRISKSIRQALDQPLNYARIYLSDILPSNVDRIIYLDSDLVVVDDIEKLWHVEMEEKVVAAPEYCHANFTNYFTDTFWSDPELAKVLEGRHPCYFNTGVMVVDVEKWRKGGYTQRVEEWMAVQKQKRIYHLGSLPPFLLIFAGDIKAVNHRWNQHGLGGDNFEGKCRTLHPGPISLLHWSGKGKPWLRLDSRKPCIVDHLWAPYDLYRSSRHSLEE

SEQ ID NO: 9829 - protein, 486 aa, Cycloclasticus oligotrophus
MQHINHFINGEFVSAVDGKSFEKRSPVDRRLIAQVSEGGKVDVDRAVHAARAALNGEWGAFTMEQRVEILYGVADEITRRFDDFVEAEMADTGQPKSIMTHAFIPRGAANFKIFADVIKNVPNESFQTTTPDGLGALNYAIRVPKGVVGVVSPWNAPFLLMTWKVGPALACGNTVVVKPSEETPLTTTLLGEVMNKVGVPKGVFNVVHGFGPDSAGEYLTHHPKVDAITFTGETTTGAAIMKAASEGMRDVSFELGGKNAGIVFADSDFDKAVDGIYKSSFLNSGQVCLGTERVYVERPIFDKFVEALKKKVEKVRHGRPDDENCNFGPMISHEHQAKVLSYYAKAVEEGATVVTGGGVPSIPEELKEGAWVEPTIWTGLAEDATVMKEEIFGPCCHIAPFDDEQQVINWANDTEYGLSTTVWTRDLSRAHRVAAKINVGITWINSWFLRDLRTAFGGSKQSGIGREGGVHSLEFYTETRNVCVKL

SEQ ID NO: 9830 - protein, 195 aa, Oryza sativa (japonica cultivar-group)
MASLMIVAAIFLLSLTSASVVHGRSSRRRFVRSYDEPCMEMRLYLHDILYDYSNSTTNSTSAAATKPTALSTAVSSPGYFFGRVVVFNDPMTEGRALPPSLEETAVRAQGLYLLDKKDDFSAWFAFSIVFNSTARRGTLNLMGADPNAATRDISVVGGTGDFLMSRGVATLRTDAIEGFKYFRVQMDIKLYECYV

SEQ ID NO: 9831 - protein, 158 aa, Cucumis sativus
VSEEDEESTYVEPSRRGRYSVVFDPLDGSSNIDCGVSIGTIFGIYLLKDSHEPNLEDVLQPGKNMVAAGYCLYGSSCTLVLSTGTGVNGFTLDPSLGEFILTHPDLKIPSKGKIYSVNEGNAKNWDGPTAKYVEKCKFPTDGSPPKSLRYVGSMVADV

SEQ ID NO: 9832 - protein, 340 aa, Arabidopsis thaliana
MEEKKPEEKKEGEDKKVDAEKKGEDSDKKPQEGESNKDSKEDSAPAAPEAPAPPPPPQEVVLKVYMHCEGCARKVRRCLKGFEGVEDVMTDCKTGKVVVKGEKADPLKVLARVQRKTHRQVQLLSPIPPPPPPPEKKAEEDKPIVEEKKVEPPVVVTVVLKVHMHCEACATEIKKRIMRMKGVESAESDLKSSQVTVKGVFEPQKLVEYVYKRTGKHAAIMKIDPPPPPPPEEAAAAAEGEKKEEEKGEGESKGEEGKDDKAKTDEEKKEGDGGKGEGEAADNGGGEEEGKVVEVRKIENPYYYYYYQPPRVAIPPMEMPPHAYPPQLFSDENPNACTVM

SEQ ID NO: 9833 - protein, 198 aa, Coccidioides immitis RS
MTSRLVLVIGDLFIPDRAPDLPAKFKKLLTPGKIGQILCLGNLTDRETFDFLRQIAPDLQLVKGDFDVDSPNLPLSKVITHGSLRIGFTHGHTIVPSGDADALLIAARQMDVDVLLWGGTHRFDAFEAEGRFFVNPGSATGAFTMDGGGEDVVPSFCLMDVQGDVLVLYVYQLRTDDQGTETVSVEKMSYRKPSVQAA

SEQ ID NO: 9834 - protein, 289 aa, Nocardioides sp. JS614
MLYPEAQRAVAAAADETPVWAEGYDVEDARARAREAAATEPREEVAEVRDVDADGVPCRLYRPAGAAPGVVLHVHGGGFVFNDIDVHDPGARRLANRSGLSVLSVDYRRPPEHRFPAAPDDVSTASAWAERELDGPLFAHGDSAGGNLALVAALRHPDRFAALVLIYPFLDPTAAFESYRTAADGFDRREAEWYWQQYAATPADLADPSLAPLLSERLGTLPPTLVVTAEHDPLRDEGEELARRLAEAGVEVTATRYLGQVHGFWRHPSVFTASEPLIRQAAGFLRQHG

SEQ ID NO: 9835 - protein, 441 aa, Rubrobacter xylanophilus DSM 9941
MARPITMPQLGESVTEGTIARWLKAEGDEVEKDEPIAEVDTDKVSAELPSPLAGRIERLLVPEGATVEVGTEIALVATGEEPGPDGPAREDARSEGPTEEFPAAGTRAQPVAAGPGESRAAGRGEGDGRGARVPSAEELRLRRSSPVVRRLAAEHGVEISSIRGTGVGGRVTKKDIEAYIREREARPREEAPPRPAPPPPRERVEVHEGDEVVEVTSVRRAIAERMSRSKREAPHAWTLVEADVSGLVGLREARKEEFRRREGVNLTYLPFVVRAVVESLKEHPVLNSVWDGDRIVLRKRINIGIAVDLEEGALIVPVIKDADDYGIVGLARRIDEVVRRARQRRLSPDDVSGGTFTVNNPGALGSVVSTPIINHPQAAILSAEAIVKRPVVLEDDAIAVRSMMNLEVSFDHRILDGGAALRFLNAVKRRLESYTPESEIG

SEQ ID NO: 9836 - protein, 400 aa, Staphylococcus aureus subsp. aureus COL
MRIVQPVIEQLKAQSHPVCHYIYDLVGLEHHLQHITSSLPSNCQMYYAMKANSERKILDTISQYVEGFEVASQGEIAKGLAFKPANHIIFGGPGKTDEELRYAVSEGVQRIHVESMHELQRLNAILEDEDKTQHILLRVNLAGPFPNATLHMAGRPTQFGISEDEVDDVIEAALAMPKIHLDGFHFHSISNNLDSNLHVDVVKLYFKKAKAWSEKHRFPLKHINLGGGIGVNYADLTNQFEWDNFVERFKTLIVEQEMEDVTLNFECGRFIVAHIGYYVTEVLDIKKVHGAWYAILRGGTQQFRLPVSWQHNHPFDIYRYKDNPYSFEKVSISRQDTTLVGQLCTPKDVFAREVQIDAISTGDVIVFKYAGAYGWSISHHDFLSHPHPEFIYLTQTKEDE

SEQ ID NO: 9837 - protein, 328 aa, Rubrobacter xylanophilus DSM 9941
MAVRTLLQAIHDALAEEMRSDERVMVLGEDVGRAGGVFRITEGLQEEFGPYRVLDTPLAESLIVGSAIGLSVNGMRPVAEIQFADFIPPAFDQIVSEAARFHYRSKGAWSVPLTIRVPYGAVHGGALYHSQSNEAYFCQVPGLKVVAPTFPADAKGMLKSAIRDPNPVLFYEHKRTYRLLKQEVPEEEYTLPLGRAKVHRRGEDITVCSYGLMLQYVLEAAERLSGEHGVQTEVVEPLTLYPLDRETILESARKTGKFLVVVEANITGSVAAEIAATVAQGAFEWLDAPVMRLGTPDVPAAAFARPLMDRLIPDRTRVEEAMLELARY

SEQ ID NO: 9838 - protein, 384 aa, Arabidopsis thaliana
  misc_feature (298)..(298): Xaa can be any naturally occurring amino acid
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEVIISLNLCHILLLYITLKDSFIINEYYYIINMIMXIWTNDKYWSAEHRVVVNTTRERYSIPFFLLPSHDVEVKPLEELVSPENPPKYKGYKWGKFYVSRNRSDFRKLEIENIQIDDFKVKT

SEQ ID NO: 9839 - protein, 498 aa, Oryza sativa (indica cultivar-group)
METKLKLSDSKKVRCMIISILGFPDKNLTESLLSRRVKDIMGISSESPNGSQQIVQKETRDETTPLLPVKVEEEGFHEFNGASFSGAVFNLSTTIVGAGIMALPASIKMLGIIPGILMIIVVALLTEASIDMLVRCSHQGKITSYGWLMGEAYGQWGRIALQASVVINNIGVMIVYMIIIGDVLSGTSSTGVHHRGILEGWFGAHLWNSRAIVLLATTLFVFAPLVSFKRLDSLRYTSALSVALAVVFVVITAGIAIIKLFNGTVAMPKLFPELDGLSSIWKLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITISLLTVIYLAAIFIPSIWDAFQFTGATAAVLIGFIFPAMVILRDPYGIASKCDKILAVTMIVLAVLSNSVALYSDAMNIFRKEEEA

SEQ ID NO: 9840 - protein, 275 aa, Cryptococcus neoformans var. neoformans B-3501A
MALVTITGFPCSGKSTRAQQLKQYFAKRLKEPEYDGPALEVVVVDDESSHVPRSTYDSSAQEKPGRASLFSNVNRSLGTDTITIVDSANYIKGFRYQMYCAAREAHTRVATIHVVAPPDMCRKWHEKRGECSYKQATFDNLIMRYEEPSSMVRWDSPLFTVPWDEDPPFEDIWNAIIKGDKKPPTSARSKPPPNTLQTLTATTSLINSSLLSHLTSLPNSTTFPIPSPPAPSSSSLVLHLPAKKITLSLAAAGNWTEGDVATGYVRFLEQTWETG

SEQ ID NO: 9841 - protein, 315 aa, Arabidopsis thaliana
MGRKRKHSETVTAAPVKDSAPERPQRTLLGWKDKKEDAENSKPAYASVFRNKEKVLVTCSRRINFRYRHLMLNMVSLLPHCKKDSKVEAKSSRGATLNELIELKGSSSCLFFECRKHKDLYMWMVKSPGGPSVKFLVNAVHTMEELKVTGNHLKGSRPLLTFSSNFENDAHWKLLKEMLTQIFGIPEGHRKSKPYHDHVFVFSIVDDHIWFRNYQISVPHNESDKIARGDLDKMTLIEVGPRFCLNPIKIFGGSFGGTTLYENPFYVSPNQIRALEKRNKAGKFAKKIKAKTRRKMHELSNPLEPDEFTDMWNDE

SEQ ID NO: 9842 - protein, 352 aa, uncultured rumen bacterium
IGAANNLLAAMLDNHIQQGNVLGIDPRRITWKRAVDMNDRQLRNIVDGLGARTDGTPRQDGFDITVASEVMAVLCLASSITDLKERLARIVVGYTYDNKPVTAGDLKAQGAMAALLKDALKPNLVQTLEHTPAFIHGGPFADIAHGCNSVTATRMALKLGDYAITEAGFGADLGAEKFLDIECRMAGLKPNAVVIVATVRALKHNGGVAKADLAKENLEALEKGMPNLLQHVDNITNVYHLPRVVAINRFPSDTEAELKLIEDKCHELGVNVALSEVWAKGGEGGKALAEEVVRLCELPNDFEYSYDLNLSIMEKLNTIATRIYHADGVDLVGSAARQLKQLEELGYGDLPI

SEQ ID NO: 9843 - protein, 395 aa, Rhizobium leguminosarum bv. viciae 3841
MISEAERETILFSISKRSEVESFHAMDVLAEATKRRAAGHPVISMAVGQPSHAAPLGALEAARAALAEGRIGYTDALGTARLKSALAWHYKDRHGLEIDPKRIAITTGSSAGFNLAFLSLFDAGDAVAIARPGYPAYRNILGALGLKVLEVPVTAETHFTLTPQSLEAAQKESGITLKGVLLASPANPTGTVTDREGLKALSDYCAAHSIAFISDEIYHGLTFAGEEASALELTDEAIVINSFSKYYCMTGWRIGWMVLPERLVRPIERVAQSLYISPPELSQIAATAALSAGAELDRYKASYAANRDLLMRRLPQIGLSIASPMDGAFYAYLDVTRFTNDSMGFAKRMLAEIDVAATPGLDFDPLEGNRTLRLSYAGSEAEIAEAVERIAAWLK

SEQ ID NO: 9844 - protein, 356 aa, uncultured rumen bacterium
VGAANNLLAAMIDNHIFQGNELNIDPRKVTWRRCVDMNDRQLRNVVDGLGGRTDGMPREDGYDITVASEVMAVLCLASDISDLKQRLSRMIVGYTYGKPSEQKPVTAGDLHAEGALTALLKDALKPNLVQTLEHTPAIVHGGPFANIAHGCNSVTATRMALKLSDYTVTEAGFGADLGAEKFLDIKCRMAGLKPDAVVVVATVRALKYNGGVPRSDLGEENLEALEKGLPNLLKHVSNIKDVFGLPCVVAVNAFPTDTEAELTLLEKKCRELGVHVAVSEVWAKGGEGGLALAEEVLRLTEEPDHFTFSYELDDTIENKLNIIVRRIYGGKAAVLTAAACKQADELTKLGFGGLPI

SEQ ID NO: 9845 - protein, 409 aa, Rhizobium leguminosarum bv. viciae 3841
MGNEMEEFHKVRRLPPYVFEQVNRLKASARAGGADIIDLGMGNPDLPTPQSIVDKLCEVVQDPRTHRYSSSKGIPGLRRAQAAYYARRFGVKLNPDTQVVATLGSKEGFANMAQAITAPGDVILCPNPTYPIHAFGFLMAGGVIRSMSVEPDASFFEPLERAVRHSIPKPLALILNYPSNPTAFVATLDFYKDVIAFAKKHDIIVLSDLAYSEIYFDGAPPPSVLEVPGAMDVTVEFTSMSKTFSMPGWRMGFAVGNERLIAALTRVKSYLDYGAFTPIQVAATHALNGDGSDIAEVRNVYKRRRDVMVESFGKAGFDVPPPAATMFAWAKIPEKFRDLGSLEFSKLLVEKADVAVAPGIGFGEMGDDYVRLALVENEHRIRQAARNIKKFMSTADETMHNVISLNAHR

SEQ ID NO: 9846 - protein, 475 aa, Bordetella parapertussis 12822
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLERFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 9847 - protein, 474 aa, Pyrococcus horikoshii OT3
MPFLPFSYYPFSLEVILMEYPKIVVKPPGPRAKELIEREKKVLSTGIGVKLFPLVPKRGFGPFIEDVDGNVFIDFLAGAAAASTGYAHPKLVKAVKEQVELIQHSMIGYTHSERAIRVAEKLVEISPIENSKVIFGLSGSDAVDMAIKVSKFSTRRPWILAFIGAYHGQTLGATSVASFQVSQKRGYSPLMPNVFWIPYPNPFRNIWGINGYEEPDELINRVLDYLEYYVFSHVVPPDEVAALFAEPIQGDAGIVVPPENFFKELKKLLEEYGILLVMDEVQTGIGRTGKWFASEWFNVKPDMIIFGKGVASGMGLSGVIGRKEIMDITSGSALLTPAANPVISAAAEATLEIIEEENLLKNALEVGEFIMGRLKEIKERFEIIGDVRGKGLMIGVEIVKENGRPDPEMTGKICWRAFELGLILPSYGMFGNVIRITPPLVLTKEVAEKALEIIERAIKDTLTGKVERKVVTWH

SEQ ID NO: 9848 - protein, 290 aa, Methylobacillus flagellatus KT
MLQGSLVAIVTPMHDDGSLDIQALRSLIDYHIEQKSDGIVVVGTTGESPTVDFDEHALLIKTAVEHSAGRIPVIAGTGANSTSEAIALTRKAKALGADACLLVTPYYNKPTQEGLYQHFKAIAAAVDIPQILYNVPGRTGCDLHNETVLRLAAIENIIGIKDATGNIERGTDLILRAPEGFAVYSGDDASSLALLLLGGRGVISVTANAAPRLMHEMCAAALTGDLKTARSTNAKLFALHQKLFIEANPIPVKWVLQQMGLIQGGIRLPLVPLSSQFHDTLRSAMKQAAI

SEQ ID NO: 9849 - protein, 365 aa, Oryza sativa (indica cultivar-group)
MAASLQAAATLMQPAKLGGRASSAALPSRPSSHVARAFGVDTGAAGRITCSLQSDIREVANKCADAAKLTGFALATSALLVSGASAEGVPRRLTFDEIQSKTYMEVKGTGTANQCPTVEGGVDSFAFKAGKYNMKKFCLEPTSFTVKAEGVAKNAPPEFQKTKLMTRLTYTLDEIEGPLEVSSDGTIKFEEKDGIDYAAVTVQLPGGERVPFLFTIKNLVATGKPESFGGPFLVPSYRGSSFLDPKGRGGSTGYDNAVALPAGGRGDEEELAKENVKNASSSTGNITLSVTKSKPETGEVIGVFESVQPSDTDLGAKVPKDVKIQGVWLWTSISRGKRPIVPIMLLPIDDIEIDSFEAEDVFCIN

SEQ ID NO: 9850 - protein, 205 aa, Oryza sativa (japonica cultivar-group)
MATWSNASSLIVAAVILLGLSSASVAHGRRGRRSFVSSYDEPCMEMRLYLHDIIYDYSNSTSNSTSAAATKPTPLSTAVSNPGYFFGEMVVFNDPMTEGRALPPSPAMEEETAVRAQGVYLYDKKEAPNAWFAFSVVFNSTGRRGTLNLMGADLMSEKTRDLSVVGGTGDFFMSRGVATLSTDEASADLSYFRVKVDIKLYECYV

SEQ ID NO: 9851 - protein, 500 aa, Arabidopsis thaliana
  misc_feature (321)..(321): Xaa can be any naturally occurring amino acid
  misc_feature (336)..(336): Xaa can be any naturally occurring amino acid
MALALDLDVDYFNTPEMLGNPIADMVLFHYEGKSDPSKGIYACGAHSDFGMMSLLATDGVMGLQICKDKDVKPQKWEYTPSIKGAYIVNLGDLLERWSNGYFKSTLHRVLGNGQDRYSISSDQMFNVHLPTLQSSTCTPKTDLGSSGILEQAIVLILKESTQRIREMENKTQEEASTINVSSLACIDLANSNLHRSAASLKQAWLFFFLFLNVNDYGLAFISYACLDCGFFYVTNHGISEELKDEAFEQSKKFFALPLDEKMKVLKNEKHQGYSPVLSQISDNQIHGDYKESFFIGIEGSNDTPFCRANIWPNPDVLSGWXGDHGEISSRSIEGLXAIARVLALALNVDGDYFDTPEMLGNPLTFMRLLHYEGMSDPSKGIYGCGPHSDFGMMTLLGTDSVMGLQICKDRDVKPRKWEYILSIKGAYIVNIGDLLERWSNGIFKSTLHRVLGNGQDRYSKGPSPSHYKCFGFLVGLLVKSLLMVLAHQALYTFLMGTYWI

SEQ ID NO: 9852 - protein, 498 aa, Ustilago maydis 521
MTMTPSLFRAVRPAAHFYRSSATSSSSRLLSTTARRSLATEAQDTTPSAKAAPTSPATSAFTVEELHDKSAHEILREGGSRKDRSLRHFTVNFGPQHPAAHGVLRLILELNGEEILRTDLAICKANIADSIQSCLFWPSGVCILQPHVGLLHRGTEKLIEYKTYTQALPYFDRLDYVSMMTNELCYSRAVEKLLNIEVPERAKWIRTMFGEITRILNHCMAVLSHVMDVGGLTPFLWAFEEREKLMEFYERVSGARLHAAYVRPGGVAYDLPPGLLDDIHKWATQFGSRVDEIEEVVTGNRIWKGRTIGIGKVTAQEALDYGFSGVMLRGSGIPWDIRKVAPYDAYDQVEFDVPVGKNGDCYDRYLCRVEEFRQSLRIIEQCLNKMPAGQIKVDDHKLVPPPRATMKESMESLIHHFKLFSEGYAVPPGETYSAIEAPKGEMGVYLVSDGTNRPYRCKIRAPGFAHLAGADFMARHHYIPDMVAIIGTLDLVFGEVDR

SEQ ID NO: 9853 - protein, 277 aa, Sphaceloma manihoticola
MAAGFPGYALEKTLEDKTRAVKIRRAMIARTPATTKHSRLLESSNLPYQHFDYDRVFGACCENVIGYMPLPVGVAGPLTIDGESYFLPMATTEGVLVASTSRGCKAINAGGGAVTVLTADGMTRGPCVGFETLARAAAAAKLWLDSEEGQKVMKDAFNSTSRFARLQQLKTSLAGTYVYIRFKTTTGEAMGMNMISKGVEKALDVMAKESGFEDMAIISVSGNFCTDKKPAAINWIDGRGKSVVAEAIIPGDVVRSVLKSDVNALVELNVSKNLIGS

SEQ ID NO: 9854 - protein, 887 aa, Ustilago maydis 521
MPSDRWQHRRNAEGERESASTSRTTNDDNRFSESSRSAHRSRYSPTSDRYDNSQLDFPNKQRRIDHSDTRRFGASARVYNNDRPGPSSPHRTESIRDTTKPPALTIRGVASTQVTSSSKMSRGDDDRPRRVRSRSLARSPDLFDRLAHPARPQDDTNGSSRYHTDSSRRSRLDNERAGTSDSSRRGPTKLAPRGRYDESGRRIDDASDTRDRNQASGVPTSPHRHDAGARRERERSSSPTDTDRPHYRAADVDQDSRLRDNRSSRNDRSRISRRSPSPTSAEAYRSRWNSSSDRYDRGDRRRSPPPQSDDRYAPEDSNRRERRWGLRAQVGDRDDDAATSRRRRTPSPSARSDVSNRSRRRDRDVEPLQLPARDRDEEQPSERGPRYRPARWRMDNYDSTDDSPRVRERDTSNGGQRQRSPDAHRARILPRSGRLDQGTAERGHILTRKSGVGATFDGKQPPTGPRQDFEPSQRSVRGGGWQTVRPGSRRKWDAPARDGEPAAGTRNGHESGAVDAEVDSTKSTRAALSVATIEPLRAEPGEAYESIHQVGEGTYGQVFKARAERTGALVALKKIRMDSEKDGFPVTAMREIRLLQALCHDNVVRLHEIMLSRTSVYMVFEYMEHDLNGILAHPQVSFSQAHLKSLAHQLFSGLDYLHRKAVLHRDLKGSNILLNNQGRLKLADFGLARFYAKRRAGDYTNRVVTLWYRPPELLFGATQYGSEVDMWGAGCIFVELFVKKPVFQSETELGQVHAITDILGPVTKKNWPEVDTLAWYEMVKPATEKEEDQERDYVKRAFARYLPASALEVASGLLTYNPRKRWSAKQAMSAVYFEEEPQAELPAGLLSSLQGEWHEYESRRAKKKSSASRGTDNAAVLITAGSTVQNQ

SEQ ID NO: 9855 - protein, 155 aa, Zea mays
  misc_feature (11)..(11): Xaa can be any naturally occurring amino acid
  misc_feature (53)..(53): Xaa can be any naturally occurring amino acid
  misc_feature (63)..(63): Xaa can be any naturally occurring amino acid
  misc_feature (66)..(66): Xaa can be any naturally occurring amino acid
RGVVMAARSLXRLVQNGEQNIRRAGPDALGVLCISNPKVKDVDTLSTVRHDAXHDVDKGAIIXIGXIGAGTHNARIAGMLSNLSRYYYKEAAHLMSGKNAQGLGHLREGLTTISSYHPDRLVLCPMALVGLVTRLHASLDMKHTMLGKYHYILYI

SEQ ID NO: 9856 - protein, 321 aa, Medicago truncatula
MVGVISLITGMAGPSGFGSASTAEQVTQGIDASNLTAIITGGASGIGLETTRVLALRKVHVIIAARNIESAEEAKQQITQENKSARVDIMKLDLCSTKSVRSFVDNFIALDLPLNILINNAGIMFCPFKISEEGIEMQFATNHLGHFLLTNLLLDKMKQTAKTTGIEGRIINLSSIAHRYTYFRKGIKFEKINDKKGYSSKKAYGQSKLANILHANELSRRLQEEGVNITVNSVHPGVIMTPLMRYSSYTMHLLKIFSFYIWKNGAATTCYVALHPSVKGVTGKYFVDCNEFKPSAYAKNKLLAKKLWDFSNKLINSISKA

SEQ ID NO: 9857 - protein, 416 aa, Triticum aestivum
MMEGGKFPGIIGAVSGQDGGVNFCDMAYYQKLGEGSTMSIDSLNSMQTSMHGGSIMSVDNSSVGSTDSRTGMLNHPSHRGPVAVVSYSVGNSIFRPGRVSHALSDDALAQALMDTRFPTETLKDYEEWTIDLGKLHMGLPFAQGAFGKLYRGTYNGMDVAIKLLERPEADPAQAQLLEQQFVQEVMMLAELRHPNIVKFVGACRKPIVWCIVTGYAKGGSVRNFLNRRQNRSVPLKLAVKQALDVARGMAYVHGLGFIHRDLKSDNLLISGDKSIKIADFGVARIEVKTEGMTPETGTYRWMAPEMIQHRPYNQKVDVYSFGIVLWELISGTLPFPNMTAVQAAFAVVNKGVRPAIPHDCLPALGEIMTRCWDANPDVRPPFTDVVRMLERVEMEVLNNVRKARFRCCISQPMTLD

SEQ ID NO: 9858 - protein, 348 aa, Arabidopsis thaliana
  misc_feature (140)..(140): Xaa can be any naturally occurring amino acid
MIDNNCLYKEELNRNSYSGLAKEASESILLPSESGFDGSRSPVCSSPDPNLNYRPVIGILSHPGDGASGRLTNDTSSTYIAASYVKFAEAGGARVIPLIYNEPEEVLFQKLELVNGVIFTGGWAKKYDYFEIVKKIFTKXLERNDAGEHFPVYGICLGFELMSIIISQNRDILERFDAEDNASSLQFVDNVNNDGTLFQRFPPELLKKLSTDCLVMQKHKYGITPANFQANPALSSFFEILTTCIDENSKTYVSTVKAKRYPITGFQWHPEKNAFEWGSSAIPHSEDAIQVTQHAASYLVSEARKSLNRPESQKVLSNLIYNYKPTYCGYAGRGYDEVYIFTQPRSRF

SEQ ID NO: 9859 - protein, 446 aa, Rubrobacter xylanophilus DSM 9941
MDLQEAKNFLEKNNVRYVLAQFVNIHGVSKTKAVPVKHFENVVTEGAGFAAFAVGNLGLGPETPDYMAVGDLSTLTLVPWMPGYARIVCEGHMRGEPWHYDPRVILKKQTQRLKERGWTFYTGLEPEFFLLARDEENGLLRTADPTDVLEKPCYDYKGLARQRNFLETITEILGEVGIDVYQIDHEDANGQFEINFFHKDCVFSADDMIFFRMAAVEVARRSGMVCSFMPKPFADRTGNSMHIHHSIADEEDNNLFEDKNDPQGMGLSKLAYQFLGGIMAHAPALTVFNAPSVNSYKRLAVGSSRSGATWAPAHVSYGPDNRSALVRVPAGRLELRLTDSGANPYLATAALIAAGLDGIDRNLDPGEPCRDNLYALSSGDLQRRNIRQLPSTLNAACDALEADSVICEALGADFVEEFLETKRQEWDRYNRHVSEWEIDRYLEFWS

SEQ ID NO: 9860 - protein, 428 aa, Chlamydophila pneumoniae TW-183
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFAYEDSEE

SEQ ID NO: 9861 - protein, 518 aa, Zea mays
MIHMPEYGPRKTPILLLLYSPSAKKASQPHPLTPPPLTQCSTPRTKQLTPMASYDKAFESYKKALTTAASVAASMMLVRSVVNELVPPELRDLVFSGFGYLRSRTSSDHTIIVEKKNDGFANNYVYCAVKTYLATRMNTDIQQRLRVSSMDEDDKMMVSMDEGDEMLDVYQGTEFKWCLVCKDNSNDSLNSSQNESHFFELTFNKKHKDKALRSYLPFILATAKAIKAQERTLMIHMTEYGNWSPIELHHPSTFDTLAMDKKLKQSIIDDLDRFMKRKDYYRKIGKAWKRGYLLYGPPGTGKSSLIAAMANHLRFDIYDLELTAVTSNSDLRRLLVNMDNRSILVIEDIDCTIELKQRQEAEGHDESDSTEQNKGEGKVTLSGLLNFVDGLWSTSGEERIIVFTTNYKERLDPALLRPGRMDMHIHMGYCTPESFQILANNYHSIEYHDTYPEIEKLIKEVTVTPAEVAEVLMRNDDTDVVLHDLVDFLKSKIKDANEIKTEHKEADNQLDEKKNDKK

SEQ ID NO: 9862 - protein, 352 aa, uncultured rumen bacterium
IGAANNLLAAMIDNHIQQGNSLNINPKRITWRRAVDMNDRQLRNIVDGLGNRTDGTPRQDGFDITVASEVMAILCLASDINDLKKRLGNIVIGYTYENKPVTARELKAQGAMAVLLKDAIKPNLVQTLEGTPALVHGGPFANIAHGCNSLIATRMAMKLGDYAITEAGFGADLGAEKFLDIKCRIGNLKPDAVVVVATIRALKHHGGAKKEDLNKEDLECLAKGMPNLLRHVENITKVYKLPCVVAINAFPTDTAKELQYVEDECKKLGANVALSEVWAKGGEGGIRLAEEVIRLCETENDFSYSYTDDMSIYDKLCAVAKKVYHADGVDLIGNAPKQLKQLEELGYSRLPV

SEQ ID NO: 9863 - protein, 76 aa, Oryza sativa
  misc_feature (61)..(61): Xaa can be any naturally occurring amino acid
MHPLPTVHWVSTIGYGQGLFTKRGFKGLFSTQGSSAKFSIVCLLRRLRGKDDIVNAGIAGXCTSLALSFPGLGFNE

SEQ ID NO: 9864 - protein, 352 aa, uncultured rumen bacterium
ITSANNLLAAIIDNHIQQGNELGINTRQIIWKRAVDMNDRALRNIVVGLGAKADGVPREDHFVITVASEIMAILCLADDMDDLKKRLSRIIVAYTRDGEPVTAGQLNAVGAMAALLKDAIKPNLVQTLEHNPVIIHGGPFANIAHGCNSVRATKTALGLSDITVTEAGFGADLGAEKFLDIKCRMAGLKPDAVVLVATIRALKYNGGVDKKNLGEENLEALKKGIVNLEKHIENIQKYGVPVVVTLNSFLTDTQAETEFVRQFCEERDCRFALSEVWAKGGEGGEALAKEVINTLENKPSNFAPIYSDDLSLVDKITTVAKEIYGADGVQFSGPAARQLAKIEEMGFGKLPV

SEQ ID NO: 9865 - protein, 424 aa, Bdellovibrio bacteriovorus HD100
MEHKIEPLYDGPLFRNAIQTLDEAAKIINCDPNILERLKRPRRCITVSVPVRMDDHSVKVFTGYRVQYSPTLGPYKGGIRYHQNVDLSEVVGLAALMTFKNSVLGLPLGGAKGGITVDPTKLSRTEKQNLTRRYASEIGPFVGPTKDIPAPDVGTDPQTMAWFMDTYSQEQGGFAQPGVVTGKPVEIGGSLGRNHATGLGVVYVAEKAFEVCNMSMKGASIAIQGFGNVGSFAAKFAHERGARIVAVSDVSGGIFNGDGLDINEVNEYIKAHKFLKGYPKAQPISNEELLEVKCDALFPCALENQIDTHNAEKIQAKIIVEGANGPITNAATKILHKRGVFIAPDVIANGGGVIVSYFEWVQDTMSYFWDEDEVNGRLKGIITKAFDKGYSLAKEKNIDMRSAAMAVSVQRLERAMLLRGLYPR

SEQ ID NO: 9866 - protein, 399 aa, Zea mays
  misc_feature (381)..(381): Xaa can be any naturally occurring amino acid
MDFSTGGSVSGGGGGASDGPAQAERWLEIAEKLLAARDLVGCKRFAERSMEANPLLAGVDELLAVADVLLASQFMGPSGQPDPLAILQLPPGVSPDQAAVSRAFRRLALLLGPSNPHPGAEMALRLVNDAYAFLSDPSRRPPPPADPATGTPYSSQYPAAAAPASDTPEFWTACPFCCYVHQYPRSLIGRALKCPNAGCRRGFVASELPTPPTVVPGTEMYHCAWGFFPLGFPNAADLGANWKPFYKMFPWNTAPSGQGGGGRSHGNHGGRQAQNDSARGGSSRGRIKKTTARKKVGVGLRRRSLGGGVESGIDSSMLGQEGWAGDEDGGHGMTEHVRGININEAAQATDGTGRLNVSGAGGVEDMGNFHIAVDASDDILXGNCTTLPFLRVDNLGRMI

SEQ ID NO: 9867 - protein, 381 aa, Triticum aestivum
  misc_feature (290)..(290): Xaa can be any naturally occurring amino acid
  misc_feature (306)..(306): Xaa can be any naturally occurring amino acid
LHRTSLYKKAGSVPVRNSRDTVDPPVRVATALYLSLKTRYNEEIHLKVEMFLKTYGTSKPTRYTFSEVKKMARRFKEKVGQGGFGTVYKGELPNGVPVAVKMLEKSTGGGGEFINEVATIGRIHHANIVQLLGFCSEGTRRALIYEFMPNDSLERYIFSNDSNIYRQLLVPRKMLDLSLGIARGMEYLHQGCNQRILHFDIKPHNILLDYNFNPKISDFGLAKLCARDQSIVTLTAARGTMGYIAPELYSGNFGGISYKSDVYSFGMLGVEMVSGRENSDPSVGSQSEVXLPEWIYEKMNPGQNLXLSWESGPGRKKKVQTLALGGTWVFPGEPKKMTLNDKSGNIFSWRVGNLKIPPHPGPYLKKKKKKKKKKPQGKKRK

SEQ ID NO: 9868 - protein, 434 aa, Erwinia carotovora subsp. atroseptica SCRI1043
MSPEDITFDQRHIWHPYTSMTKPLPCYPVIAASGVELQLDDGRRLIDGMSSWWAAIHGYNHPAINQAVQSQLSQMSHVMFGGITHPAAVALCRQLVNITPDALECVFLADSGSVAVEVAMKMALQYCQARGETRQRFLTLRHGYHGDTFGAMSVCDPQNSMHSLYQGYLPTHLFVDAPPCAAINESGFTDEWQETNIAPLQAMLSAHAHEVAAVILEPIVQGAGGMRFYHPTYLRRVRELCDQWGILLIADEIATGFGRTGKLFACEHAGISPDIMCLGKALTGGYMTLSATLTTRTVAETISNGAAGCFMHGPTFMGNPLACAAANASLSLLADNRWQQQVQNIERQLREALQPCADSPLVANVRVLGAIGVVETHRPVNMARLQRFFVERGVWIRPFGRLIYLMPPFIIQPDELRKLTDAVCAAIHNAQLFE

SEQ ID NO: 9869 - protein, 565 aa, Erwinia carotovora subsp. atroseptica SCRI1043
MELEYESKRPLYIPYAGPILLEFPLLNKGSAFTEEERADFNLAGLLPEAVETIEEQAERAWRQYQEFKHDIEKHVYLRNIQDTNETLFYRLLDGHLNEMMPIIYTPTVGEACEHFSDIYRRARGLFISYPNRANIDDMLQNATKQNVKVIVVTDGERILGLGDQGIGGMGIPIGKLALYTACGGISPAYTLPVVLDVGTNNPQRLNDPLYMGWRHPRITDDEYYAFVDEFIQAVKRRWPNVLLQFEDFAQKNATPLLNRYRDEICSFNDDIQGTAAVAIGSLIAASRAAGTQLRDQTVAFLGAGSAGCGIAEQIIAQMKSEGLSEEEARARVFMVDRFGLLTDKLPNLLDFQSKLVQKSELLADWDCNSDAISLLEVVRNAKPTIMIGVSGQPGLFTEEIIREMYKHCARPIVMPLSNPTSRVEARPEDIIRWTEGSALVATGSPFSPVHYQDKVFPIAQCNNSYIFPGIGLGVLASGANRITDGMLMAASRALADCSPLANNGEGALLPDLSDIQQVSKRIALDVGKAAQLQGVAVVTSADALQKAIDHNFWQPQYRSYKRTSF

SEQ ID NO: 9870 - protein, 180 aa, Zea mays
MSVGTLPESATNRPRAPAPPEAREEEVAIRNKQSIYPSNPQTLGYLGAAAMAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDIKKKEDEITRLQEKYGIGSKTPGPGSSD

SEQ ID NO: 9871 - protein, 352 aa, uncultured rumen bacterium
ITSANNLLAALIDNHIQQGNELGIDTRQIIWKRAEDMNDRALRNIVVGLGAKADGVPREDHFVITVASEIMAILCLASDMDDLKARLSRIIVAYTRDGEPVTAKDLNAVGSMAALLKDAIKPNLVQTLEHTPVIVHGGPFANIAHGCNSVRATKTALGISDYTVTEAGFGADLGAEKFLDIKCRIAGLKPDAVVLVATIRALKYNGGVAKKDLGEENLEALKKGIVNLEKHIENIQKYGVPVVVTLNAFLTDTDAEMAYVKEFCEERGCKFALSEVWAKGGEGGEALAKEVISTIENKPSNYAPIYSDDLSLTEKITKVATEIYGADGVNFLPAAAKQLAKIEEMGFGKLPV

SEQ ID NO: 9872 - protein, 351 aa, uncultured rumen bacterium
ITTAHNLLAAVLDNHIQQGNALNIDVRRVVWKRVLDLNDRALRHVVIGLGGKAHGVPRETGFDITVASEMVAILCLSSSLTDMKRRLGEIVVAYTTDGRAVRAKELNVTGALTLLFKDAIKPNLVQTLGGTPAFVHGGPFANIAHGCNSVMATKYALKLADVVVTEAGFGADLGAEKFLDIKCRFAGFSPDAVVIVATVRALKVHGGVPKSDLSRVDMGALEKGMENLLKHIETIHAFGLPAVVAVNAFPTDTAEELSFVEKKCAELGAEVAVSEVWAKGGEGGLALAKKVEAAMAKPKNFHTLYESDAPIAEKIETVARTVYGADGVTFTSAAKKQLDEIEALGLDKMPV

SEQ ID NO: 9873 - protein, 423 aa, Legionella pneumophila str. Paris
MTQKTAKLSIDGQETIDLPIYTPTLGNDVIDITQLGSHGVFTFDQGFLSTASCESKITYIDGDKGILLYRGYPIEQLAEKKDFLDVSYLLLNGELPNKEEKKAFVSLINNHTMVHQQMYQFLNGFRRDAHPMAIMVGIVGALSAFYHESMDLNNAQDRFISAIRLVAKMPTLAAMSYKYSIGMPYMYPKNKMSYAENFLHMMFGVPSEDTTPDPVLVRAMDTIFILHADHEQNASTSTVRLAGSTGANPFACISAGIGALWGPAHGGANEACLNMLKEIGDVSRIDHYIKRAKDKNDPFRLMGFGHRVYKSYDPRAKVMRKTCYDVLEAVGAKEAPLFKLAMELERIALEDEYFIEKKLYPNVDFYSGLTLSAIGIPTNMFTVIFALARTVGWMSHWMEMVATKSRIGRPRQLYTGEKIRDVK

SEQ ID NO: 9874 - protein, 399 aa, Bdellovibrio bacteriovorus HD100
MEANAGSTLAPVNYSDDNVAKPLENQPVNFYSLTLEDLKAYIKSKGKEQFRAQQIFKWVYEQRVTDPEQMTNLSKEFRQDLPSMLSFDLPPVLQHLKSVDGTQKFLFDMKDGMSVEAVVIPSEDRLTLCISSEVGCNMACKFCFTGKQKLKRRLRTEDIVGQFMQVHDRLAEGQRITNIVFMGMGEPLDNPEAVFKTIDVIHSPWGINLSRKKITVSTSGIVPEMWRVADAKVRLAVSLNGPNDEIRSQVMPINKRWDTKALLEACKEHYRVSKDKITFEYVLLKGITDQLEHARQLVKLVKDVPCKINIIPFNEHPGSGYERPDDDTIQAFHTELMNLGAHVLLRRSMGRDIFAACGQLTTVKERPQTMDISNSRLAGLPKYKRELLAAQEAEQNNQH

SEQ ID NO: 9875 - protein, 339 aa, Arabidopsis thaliana
MVTELEELVEFLSSPSPPVKKAAVEIVSGLTGSEEGLQSLSKYSEVLLPSLSQLLNESKEVSEPAAQALVNLSQKCELAKKMIQMGLIKVAMDMLYKPESCITRLLVMLLVNLAQLDDGVSSLLQIDDEKMHGLHIMKLVRSFCRSSGETADDQFEHVGSILVNISKTEDGRKLLLEPKRRLLKQIIRQFDSTNQLRKKGVAGTIRNCCFEAKNQLQNILLISEFLWPALLLPVAGSKTYSEQDVAKMPPELGSALSIEREPVTDPDIRVQTLEAIYLIILEEAGRRAFWSVNGPRILQLGYEYEEDPKAMRAYEQVGSLLVEEAGGPEESLEPTKAES

SEQ ID NO: 9876 - protein, 345 aa, Oryza sativa (japonica cultivar-group)
MAATNKKIVLRNHVTGFPKESDMELVAATGAAPSRVPEGTDGAVLVKNLYLSCDPYMRGRMSSHDGSYVDAFVVGEAITGYGVGKVVDSSHPGFKAGDLVWGMTGWEEYSLIKDPSRALFAIRHPDLPLSYYTGLLGMAGFTAYVGFHEICAPREGERVYVSAASGAVGQLVGQFAKLMGCYVVGSAGSDDKVRLLREKFGFDDAFNYKKESDLSAALKRCFPEGIDIYFENVGGAMLDAVLLNMRVRGRVAACGMISQYNLEHPDPVHNLTAIVTKRLRIEGFIVSDHYARYREYEEKAARYVKEGKIAYVEDVAEGLENAPAALIGLFSGRNVGKQVVVVARE

SEQ ID NO: 9877 - protein, 326 aa, Cytophaga hutchinsonii ATCC 33406
MREIQFREALREAMNEEMRRDPNVLLLGEEVAEYNGAYKVSQGMLDEFGAKRIIDTPISELGFAGIGVGAAMNGLRPIIEFMTFNFSLVAIDQIINGAAKIMSMSGGQYTAPIVFRGPTGNAGQLSSQHSQNFENWFANTPGLKVVVPANPYDAKGLLKSAIRDNDPVIFMESEVMYGDKGPVPEGEYLLPIGVADVKREGTDVTLVSYGKILKVALQAAEDLAKEGVSAEVIDLRTVRPIDFEAIVHSVKKTNRLVIVEETWPLASISSEISYHVQRYAFDHLDSPILRVTSRDLPLPYAPTLIQEILPNVKRTIDAVKTVMYQK

SEQ ID NO: 9878 - protein, 429 aa, Bordetella parapertussis 12822
MTAVSVQPDLAGSPHFRYQNGVLHAEDVPLDSLAAQLGTPLYVYSRAALRSAWETYRDAIGERPVLVCFGMKANSNLAVLKEFARLGAGFDIVSGGELARVLAVGGDPAKVVFSGVGKQAWEMRAALEADVKCFNVESEAELERLSDVAVSMGRRARVSLRVNPDVDAQTHPYISTGLKENKFGIAIESAPAAYRLAARLPGVEVVGVDCHIGSQLTDISPYFDALEKLLDLIEQLAENGIAIKHLDLGGGLGIRYTDEIPPSPKALLDRVFERINARGLGHLHIVLEPGRSLVGNAGVLLTTVQYLKHAEARNFAIVDAAMNDLLRPALYEAYHGVQPVTPRADKRIEYDVVGPVCESADWLARGRALAIQAGDVLAVESAGAYSMVMASNYNTRVRAAEVMVDGNRHYIVRQRETLESLYQGESTLP

SEQ ID NO: 9879 - protein, 220 aa, Bacillus cereus E33L
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIIDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 9880 - protein, 468 aa, Leptospira interrogans serovar Lai str. 56601
MISRMISKRKEDRMKSNARVCVVGAGPSGIAAGKNCVEYGLDVVIFEKNDKVGGNWVFNAKTGHSSVYENTHIISSKVWSEYEDFPMPEDYPEYPNHKQLQAYFESYAKHFGVYKKIRFHHTIQKITKTPNEEWKVEYTNASKKKKVEFFDVLMVANGHHWDPKYPEYEGKFTGKFLHSHDFKGVTNEWKGKDILVIGAGNSACDVAVESARVANSVKLSMRSPQWFFPKFLFGMPSDVFAAKTPNWIPSIIKQFALSKLIYILQGSYKNYGLPENKNLALSHHPTLNSDLLDFIRHGRINPRPAIKKLHGKEVEFIDGTKERFDIICACTGFWTTFPFFDKSFIDFQHVEKIPLFRKMIHNDFQNLYFIGLFQPVGCIWPMADYQAKLACLEILGKYKRPKNLKAAIQYEIDHPHFTFERGQRHAVEVDYHSFRKELRLELLKAGVDIGKPPGGNKSLYKNFPKAAS

SEQ ID NO: 9881 - protein, 150 aa, Brassica napus
MVGKVKRVQVFHLLCLCSVIFFFVFSANVSSEAVPPEDKTATVWLSRIKRSGNDYWSKFKETLGRGHSRFFPPNIDFRGKDDAAEMGAGEKMKEAVTRSFEHSKDTVEEAARSAAEVACDAAEAVKEKMKRSVSDGETKQHQQTEGTNEL

SEQ ID NO: 9882 - protein, 531 aa, Aspergillus parasiticus
MAVLHSGVVCLDGWFYLRLLHRYVNFPVGYLPCFVLTFTSGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLVVGALSSIVPMYQSESAPRQVRGAMVSAFQLFVASVFSSLISSTSVPNPSTVPLPGVSLWDMCAWPLILGVGTLFLPESPRYAYRNGRVEEAREVMCKLYGVGPNHRCIAQEMKDMKDKLDEEKAAGQAWHFEVFTGPRMFYRVAGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIGGFATTWGPIVWAICGEMYPARYRAVCIGLATAANWSLNFLISFFNPIHLQRYRLCYGYVFAGCCFAAVLVVFFFVNETQGRTLEEVDTMYVLHVKPWKSASWTPRRVSSVISTDPPLPPSRRVGLSTASPPPRSASKWYHV

SEQ ID NO: 9883 - protein, 85 aa, Glycine max
MADTSGGDAVRPVVICDNKCGCTVPCTGGSTCRCTSVGMTTGGGNHVTCSCGEHCGCNPCSCPKTAASGTGCRCGTDCSCASCRT

SEQ ID NO: 9884 - protein, 319 aa, Ralstonia eutropha JMP134
MSEHRSRRPAVPVQSRYSHPEFPNVMTQITGSIVAIVTPMHEDGSLDYPALRALVDWHVAEGTDAIVIVGTTGESPTVSVDEHCELIRMAVEQAGKRIPIIAGTGGNSTKEAIELTAFAKKVGADASLQVVPYYNKPTQEGMYRHFRTIAEAVELPVLLYNVPGRTVADMTNDTILRLAQVPGIVGVKEATGNIDRAAQLIKDAPEGFAIYSGDDPTAVALILLGGKGNISVTANVAPRKMHEMCVAALKGDVVTARRLHMELIELNKAMFVEANPIPVKWALQQMGKMEGGIRLPLTPLLESNHETVRKALAAAGLLR

SEQ ID NO: 9885 - protein, 384 aa, Haloferax mediterranei
MSEDFYDVLGVSRDASKDQIKNAYRKKAAKYHPDVSDEEDAEEKFKKVQKAKEVLTDDEKRQMYDQLGHERFQQAQKRGAGGGGGGRGQGNPFGGGGNPFGGMGGGGFEDIFNNLFNGGGGQRRSRPQQGRDVAQRITIDLEDAYHGVERDVTIRRREVCPECDGEGHPADADVNTCSECNGSGQQTTVQQTPFGRVQQTTTCRACGGEGKTYSEDCSECRGSGRVRRTRDVTITIPAGFRDGQRLRYRGEGEPGENGGPNGDLFVEVNVRDHEEFDRDGDDLQYTHPISFPQAVFGATVEVPTLDGEAELKVPAGTQSGSTFTVSGAGMPHLDGRGNGDLHVEIHVVTPEDLNSEQREALKQFAEAGGEEVKESLFQKLKNSL

SEQ ID NO: 9886 - protein, 400 aa, Oryza sativa (japonica cultivar-group)
MAAASSLHAAPRVGSSSSFSSSSSAGRRSASAARSVRVAAAAGSCAARRAGGRMVARAAVASKAESPASAASSKSDGHEVLLFEALREALIEEMKEDPTVCVFGEDVGHYGGSYKVTKGLAEMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYVLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAAPLEDATVVQPAQIVAAVEQICQ

SEQ ID NO: 9887 - protein, 99 aa, Oryza sativa
GKGGKGFGKGGAKRHRKVLRDNIQGIPKPAIRRLARRGGVKRISGLFYEETPGVLKIFLENVIRDAVTYTEHAPRKTVPPMDVVYALKNQGRPLYGFGG

SEQ ID NO: 9888 - protein, 463 aa, Oceanospirillum sp. MED92
MTFQANEFDAKEVVNNDRDYVWHHLAQHENFKTNDPMVIVKGEGMRVWDAKGNEYLDAVSGAVWTVNVGYGRTEIAEAVKDQLVTMNYFAQTAGNVPAAEYAEKLLEKMPCMSRVYYSNSGSEANEKAFKMVRQIAELKYGGKKSKILYRERDYHGTTITCLSATGQFERRNQYGPFTPGFVEVPHCCEYRAQEGADLENYGVWAANQIEKVILEEGADTVGAICLEPITAGGGVIEPPQGYWERVQEICQQYDVLLHIDEVVCGLGRTGKWFGYQHYGIQPDIVTMAKGVASGYAAISCTVTTEAVFELLNDAEAGRMGYFRDISTFGGCTAGPAAALANMAIIERENLLDNVNEQGEYLRGRLNQLMEKHSLIGSVRGKGLFAGFELVKDRQTKEPVDESVSLAIAAHCMTNGVIIGRTNRSFKTLNNCICLSPALIARREDIDRIVDALDDALESVTSDS

SEQ ID NO: 9889 - protein, 413 aa, Rickettsia sp. BJ-90
IAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPRQLYTG

SEQ ID NO: 9890 - protein, 435 aa, Cryptococcus neoformans var. neoformans JEC21
MGSPSSSARLTLLPSNYLSSQNPSSEITLQSLIDVSDRMANEAKEALPYNFDECSYSKGYLRQSVWSCLDCGEKGVCYGCSISCHSEHRLIELWTKRSFRCDCPTVSMQAEQPSGSKRRKCVLNRPETQPQLPNEKNRYSKNFQGKFCRCGRDYDPETEEEAMLCCLGCEDWFHETCLNLRQLGDKTSNLTQPVAKDSQLPTLVTAPDDASSVLIAEEVEEEEEDEQVLIPSDTYDSLICGECVLSNPFLTSQAGKEGFMIIEPRESSWVVIGRNMRHEDEIKIGLGEKRGLEENEEASKRVKLDDGSEARGGDAFTDSEKRKGKGDVFLAHGVRNRLKSQLDMNTISSLPFPLEDEEIYEPPQDVEQEETIEEATSRVVSSLPRIQAIEALHGYQRLKEQLNDMLRSHVQSGKTVSKEDIEELFEKLKATRERR

SEQ ID NO: 9891 - protein, 259 aa, Legionella pneumophila str. Paris
MMTLITGATRGIGLALAYEFASHGHDLILIGRDSEQLEHISKQLNTQYQVNVEYKVHDLSKPGSAFKLYTDLKEQGIEVNCLVNNAGIGYMGSFVEMGMNKLDDLMNINMISLSELTLCFLHDFVARNEGSILQVSSTAAFQPGPFMAAYYASKAYVATLSHAIAYELKDTKVSMSILCPGATKTNFFHASGMENSMLERGYIGMMNPEKVAKIAYKGLKKGKLYIIPGLRNKILAYAAAISPKAIALRIASYLHHKIL

SEQ ID NO: 9892 - protein, 602 aa, Cytophaga hutchinsonii ATCC 33406
MQSIRNIAIIAHVDHGKTTLVDKIIHASKIFRENQVFEDLILDNNDQERERGITILAKNVSIRYKEHKINIIDTPGHADFGGEVERVLKMADGVVLLVDAFEGAMPQTRFVLSKALGLGLKPILIVNKVDKENCRPDEVHEEVFDLMFNLGANEHQLDFVTLYGSGRGGWMSTDWKKKTEDIIPLLDAIVDHIPPAPVHEGIPQMQITSLDYSTFTGRIAIGRVFRGELKEGGQYSLTKMDGSIKKVKIKELHSFEGLGRVRVESVLAGDICAVVGIEDFEIGDTITDLEKPEALPRIAVDEPTMSMLFTINNSPFFGKEGKFVTSRHLRDRLMKELEKNLALRIQPGESEDKFLVFGRGILHLSVLIETMRREGYELQVGQPQVLYKEIDGKRCEPVEVLVVDVPQETSGKVIELATQRKGELLIMEPKGDLQHLEFKIPSRGIIGLRTNVLTATFGEAIMTHRFDGYEPYKGAIPERVSGSIISMDSGDVTAYALDKLQDRGKFFIEPGDVIYQGMVIGEHNRQNDITVNVQREKKLTNMRASGTDDNAKIAPKINFSLEEMMEYIQKDEYIEVTPKSLRMRKILLDENERLRNTKKEAV

SEQ ID NO: 9893 - protein, 464 aa, Nocardioides sp. JS614
MTHFNVLVLGAGPGGYVAAIRAAQLGQTVAVIEEKYWGGVCLNVGCIPSKALLRNAEIAHIITKEKDTFGISGEATMDFGATHKRSRGVAEASAKGVHYLMKKNKITELDGWGTIKSPREVEVDKDGQKQTYTCDNLIIATGARVRMLPGMSVSQNVVTYEEQILTDQLPKSIIIGGSGAIGVEFAYVLTNFGVDVTIVEFLDRMVPTEDADVSKELLKQYKKLGVKVLLSTKVDQVEDTGSGVRVTVSPAAGGDAQVLEADKMLAAFGFAPRIEGYGLENAGVEVSDRGAIEVDARGRTSVENVYAIGDVTGKLMLAHTAEAMGVVAAETIAGAETHEIDFDMIPRATFCQPQIASFGYSEAQAKEKGYDVKVATFPFSANGKARGMAEGVGFVKIVADATYNEIVGAHMIGPEVTELLPALTLAQQWDLTADEVARNVFAHPTLSEAMKEAVEGIAGHMINL

SEQ ID NO: 9894 - protein, 369 aa, Capsicum annuum
MRSMNLVDLWAQQACLVFNQTLSYKSFNGFMKIPLKNSKINPKLNKKRPFSPLTVSAIATTKEDERIEAAQTEEPFNFKIYVTEKAISVNKALDEAIIVKEPHVIHEAMRYSLLAGGKRVRPMLCLAACELVGGNQENAMAAACAVEMIHTMSLIHDDLPCMDNDDLRRGKPTNHKIYGEDVAVLAGDSLLAFAFEHIVNSTAGVTPSRIVGAVAELAKSIGTEGLVAGQVADIKCTGNASVSLETLEFIHVHKTAALLESSVVLGAILGGGTNVEVEKLRRFARCIGLLFQVVDDILDVTKSSEELGKTAGKDLVVDKTTYPKLLGLEKAKEFAAELNREAKQQLEGFDSRKAAPLIALADYIAYRDN

SEQ ID NO: 9895 - protein, 303 aa, Archaeoglobus fulgidus DSM 4304
MDVEKFVENAIKEIRERVKDGKAIIALSGGVDSSVCTVLAHKALGDRLIPVFVDTGLMREGEPEKIKEIFGNMGLVFIDAKEEFFKALKGVTDPEEKRKVIGELFVRIFERVAEEHNAEYLIQGTIYPDIIESQGGIKSHHNVGGFPTSYKFKDVIEPLRELYKDEVREVARYLGLPKEISERMPFPGPGLAVRIVGEVTPEKVEIVRKANKIVEEELADYDKWQCFAALIGKATGVKGDVRVWGYIIAVRAVESRDGMTADPIKIDYDRLRRIALRITGEIDKVSRVVYDITPKPPATIEYE

SEQ ID NO: 9896 - protein, 818 aa, Oryza sativa
MEAPPVKSGWRVMAPAHAGGREDRLSDLPEGVLHRVMSFLDSRQAVRTCVLSRRWRDVWRTVPRVHADFCDFTLNWTSDDDEVDEAAVAEDEVVFNRFVNRLLELRDPNASIRSFFLRFCRSDGGDDGSAEGNRWISYALQKNVRILEVSVLSYALELDHSVFSSRYLRTMDFSNVVMNQGFFKQLEMGCPELEELFLDECFIVDDEISSQTLKVLTLDATHFCCGFKTSISSPSITSLALHYPMSGKPVLNDMEALVSTSMLLCHVKDDDFAANDLRDYLWSLYNVEILDFSYHGKKGHRQFIGSDCLRAYIAFSSLSVLLLLGGHVALLLLSRCLRLPLDAVSFALLLPNTAAALALVALVAIAAFWFTLLPEWITGRYSSPWRWSSTSPLVLAERGDPSAARRHGVAGFHARHLFDERRLSGCSAAMEEPPGKKGPAMDPAQDSGRDWLSGLPEGVLHRIMSFLDSRQAVRTCVLSRRWRDLWRSIPRVHADIYDFTPDGTIDGEGEEDVEEAEVVVVFNRFVNRLLERRDPTASIETFFFRCCIPDEDDDGSADANRWISYGLQKNAWFLEVVVQLNSLELDRSVFNSIYLRRIAFGNVFMDQGFFKQLQIGCPALERLYLDDCIVADDEISSNTLKVLTFDTTEFCYEHRISISIPTVTTLALRNTICGKPVLKDVASLVSASVVLYCVESGNFDAYDLRHYLWSFSHVKDLIFSYQGRKDNCKTSEVFIGELEEKSFTCEHLTSVEMKCWEDDPLVINVVDFFVGSGMSSSQIHIEYEDDDEDQFHIESDDMFGFEFEYEDEDEDEDEDEDE

SEQ ID NO: 9897 - protein, 884 aa, Saccharomyces cerevisiae
MDPNSNSSSETLRQEKQGFLDKALQRVKGIALRRNNSNKDHTTDDTTGSIRTPTSLQRQNSDRQSNMTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 9898 - protein, 552 aa, Oryza sativa (japonica cultivar-group)
MTGGLEVAMVAGGGNGGAAVLVGITVLLFVVVVVVVVLVRWWSGGEGGAAPSPPALPVLGHLHLLKKPLHRSLAAVAAGVGAPVVSLRLGARRALVVSTHAAAEECFTACDAALAGRPRTLAGEILGYDHTIVLWTPHGDHWRALRRFLAVELLSAPRLAALAADRHAEAASLVDAILRDAAGGAKVTLRPRLFELVLNVMLRAATTRRRHASVDARKLQEIIEETFSVNGTPSVGDFFPALRWVDRLRGKVGSLKKLQARRDAMVTGLIDDHRQWRSGSAGDGDQDKEKKGVIDALLALQETDPDHYTDNVVKGIILFSITVPLLHFYSIVINMYNGFDHGVQSLLFAGTDTSALTIEWAMAQLVTHPETMKKARAEIDANVGTARLVEEADMANLPYIQCVIKETLRLRTAGPVIPAHEAMEDTTVGGFRVARGTKVLVNAWAIHRDGDVWDAPEEFRPERFVDSDAGGAVTAPMMPFGLGRRRCPGEGLAVRVVGVSVAALVQCFDWEVGDDDVVDMTEGGGLTMPMATPLAAVCRPREFVKTILSTSM

SEQ ID NO: 9899 - protein, 456 aa, Oceanospirillum sp. MED92
MSNTYSLVNPFDNSPLGEYEYTPWATLENQLAMLKEGQLSQRKTAAFQRAGVLNKLAALLKEHSEEMATLITQETGKTILDSRVEMMRAYNAAIASAEEARQIQGESLDSDAYAPAGGKIGVVCWKPLGTILCITPFNFPINIAIHKIGPAYAAGNTILFKPGPQNTASAQLLVKLCYEAGMPENTLQLCMPEFSDLDRLNAHPDVNAINFTGGTAAANAISAAAGYKKLLLELGGNDPLIVMDDGDLEAATTAAINHRFATAGQRCTAAKRLFIHANVYEAFRDLLVEKSSKLVVGDPMKDDTFVGPVINQGAADQIRTLIEQAIEDGASVALGNQYEGAFVYPTILENVSPTSEIMVEEAFGPVMPLYKFESVEEIIPIINNTAYGLQAGVFSQNLATIKELYEQLDVGTLAANDGPGFRTEHFPFGGVKESGIGREGIKYAIREMSYTKTLVI

SEQ ID NO: 9900 - protein, 125 aa, Triticum aestivum
QQATNVRATYHYYRPAQNNWDLGAPAVSAYCATWDASKPLSWRSKYGWTAFCGPAGAHGQAACGKCLRVTNPATGAQITARIVDQCADGGLDLDWDTVFTKIDTNGIGYQQGHLNVNYQFVDCRD

SEQ ID NO: 9901 - protein, 407 aa, Jatropha curcas
MASSICINEILTDDELRSILSKLESDKDKEIFGLVCKRWLRLPSTERKKLAARAGPHMLQKMAQRFSRLIELDLSQSISRSFYPGVTDSDLAVIAHGFKGLRILSLQYCKGITDSGMRSIGCGLSSLQSLDVSFCRKLTDKGLLAVAEGCKDLQSLHLAGCRLITDGLLRALSNNCHKLQDLGLQGCTSITDDGLTYLVSGCQQIQFLDINKCSNIGDVGISNLSKACSSCLKTLKMLDCYKVGDESISSLAKYCNNLETLIIGGCRDISDNSIKLLASACKNSLKTLRMDWCLNVSDSSLSCILTECRNLEALDIGCCEEITDAAFQGLATIKTELGLKILKVSNCPKITVTGIGMLLEKCNGLEYLDVRSCPHVTKSGCDEAGLQFPKCCKVNYTGSLNEPDVLV

SEQ ID NO: 9902 - protein, 471 aa, Anaplasma marginale str. St. Maries
MGVCDYDVAVIGAGPGGYKCALKAAKLGLKVASIDNNSLLGGTCLRVGCIPSKALLDYSYKYHAAKDIFKDFGVTASNVKFDLRKMFEVRDREINALGSGIGSLFSSAGVERLCGAATVTRAMGDGFEIVVRREGAPTDDELSAKNVVLATGSLPASLPGIDIDEVRILSSDGALGMDVPGKLLVIGGGAIGLEMSSVWSRLGAEVTVVEYADCIAPGFDSEVSKALLSHLKKQGINFMLSHKVVSVSEKKGGKLVVSCEALSSGAVSAVEVDKVLVAVGRRPNVGKTVAVDGLVLDDRGFVSVDSRYETSIKGIFAIGDVIGGAMLAHKAEMEGHAVAELVAGHDSNVDYGVIPAVVYTHPAVASVGRSEDYVKSVGYDYKVGKSNFAANGRARVTGEGEGFVKVVACKRTDTILGVHIVGTYADTMINEAVVALGYRASSKDICHICHSHPDVNEVFRDACEVACSRKG

SEQ ID NO: 9903 - protein, 350 aa, Novosphingobium aromaticivorans DSM 12444
MALILGIESSCDETAAAVIDSNGASLEARIVAQRIASQDEAHRPYGGVVPEIAARAHAEVLSPMIAAVLADAGIGLDDLDAIAATAGPGLIGGVMVGLVTGKALAMAADKPLIAVNHLEGHALSPRLAEPSLQYPYLLLLVSGGHCQILEVAGVGQFRRLATTIDDALGEAFDKTAKILGLGYPGGPAVERMAREGNPKAVPLPRPLVGSGEPHFSFAGLKSAVMRAKDAGVHGDADIAASFQQAAIDCVIDRTRIALETASPGMTALVVAGGVAANAALRGALEGLAESHGLSLVAPPPKLCTDNAAMIGWAGAERLALGYVDPLDVAARPRWPLDENAAPVRGAGVKA

SEQ ID NO: 9904 - protein, 1611 aa, Cryptococcus neoformans var. neoformans JEC21
MSSSSADVLKISILGNESIHVGFHLLPYIFKTITTTLPSSTYVLITDTNLSAIYLNDFKASFEEAASEADNKARFLVYEVAPGEGAKSRKVKGEIEDWMLDNKCTRDTVILAFGGGVIGDLTGFVAATFMRGVKFVQIPTTLLAMVDSSVGGKTAIDTPHGKNLIGAFWQPSYIFVDLAFLTTLPTREVSNGMAEVIKTAAIWKDDDFALLESRSAEISLAASSRPTGVPTAGRFVSDRSHAQSLLLQVVSGSIYVKAHIVTIDERETGLRNLVNFGHTIGHAIEAVLTPAMLHGECVSVGIVLEAEVARQLGILSQVAVGRLTRCLQAYGLPVSLSDRRITALPASSQLSVDRLLDIMKIDKKNSGPAKKIVLLSRIGKTYEEKASVVADDVISKVLCEAVTVKAATPTKSPITMATPGSKSISNRALVLAALGKGTCRVRNLLHSDDTAVMMNALVELKGAVFSWEDGGDTIVVEGGGGILSTPAKGKELYLGNAGTASRFLTTVCAMVSGSASSERSTVITGNARMKQRPIGPLVDALTANGAKVKYLESTGCLPLDIDTDGFRGGHIQLAASVSSQYVSSILLCAPYAAEQVTLELTGGQVISQPYIDMTIAMMKQFGATVERQKDEQGNLLDIYVIPKCTYVNPPEYSVESDASSATYPLAIAAITGTTCTISNIGSSSLQGDARFAKEILEPMGCIVEQTLTSTKVTGPPVGTLRALGNVDMEPMTDAFLTASVLAAVAVKPCLPERKVEGLPETASRIYGIANQRVKECNRIQAMRDQLAKFGIETDEFDDGIIIFGKPEASLFRGASIHCYDDHRVAMAFAVLSCIIDETIIEEKRCVEKTWPNFWDDLQNKIGVAVEGVELETHNQASTSAKPVSPIDQSQSDRPIFLIGMRGAGKTYVGRMAADILSGQFTDADDVFAQESHQTVSEFVAANGWDEFRKKETEILSKFVEEHRGNHVIALGGGIVETETARETLKAHVAKGGHVVHVTRALEDIEAYLDSIGNTAVRPNWGETFADVFKRREPWYQACSSHEFYNVLEAVGGQTHEEHTKAMRAECGRFFKFITGRESNRPRLSVGNPTSFLSLTFPDVTPALIHLDELTEGADAVEFRVDLLSTTGQAPTRPALPPISFVAKQLASLRLATTLPIVFSVRSKDQGGMVPSDNAEAYGALVRLGLRCACEYVDLEVCWPEQLLDSIVQLKRETHIIASWHDWTGDMAWDGEEMKAKHVLCEKYGDVAKIVGTAKSGLDNAKLAIFVGEVQSHPGAKPLLAINMGAAGQLSRILNPILTPVTHDALPSRAAPGQLTAREILQARALTGSLPAKKFVLFGSPIAHSVSPLLHNAGFATLGLPHTYRLHESEKVDQGVLEVIRSPDFGGASVTIPLKLDIIPHLDSVSEDAKIIGAVNTVIPRGGKLHGENTDWQAIHQAAAQNLDADALSYGSSTALVIGAGGTCRAAIYAMHKLRFKTIYLFNRTPENAAKVKASFPESYNIAVVTSLSSLPEAPVVVVSTVPGNSLTLDTFSQGIYLPSEVLSRPKGVAIDLAYKPHMTALLHAAEKKEGWKVVPGVEILCLQGFKQFEEWTGKRAPQKKMRKAVLDKYFA

SEQ ID NO: 9905 - protein, 461 aa, Chlamydophila pneumoniae TW-183
MTQEFDCVVIGAGPSGYVAAITAAQSKLRTALIEEDQAGGTCLNRGCIPSKALIAGANVVSHITHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 9906 - protein, 404 aa, Solibacter usitatus Ellin6076
MRLSAVFAVLGPGFITANVDNDPGGILTYSQAGAKFGYTLLWTLIPTTIALIVVQEMAARMGAVTGKGLSDLIREEFGLRITFFTMVVLGLADLGNIAAEFAGIASGMGIFGLSKYLTVPIGAAVVWFVIVRGSYKPVERIFIILSLIYFTYPISAILAHPDWTTAIRQTFIPEWNSSPDYIVMIVGLIGTTVTPWMQFYLQASIVEKGITEKHYSITRWDVIIGCIVTDVIAFFIVVACAATLFKAGHHELNDASEAAQALVPFAGRFAGLLFAVGLVNASMLSAAILPLATAYNVCEGLGFESGIDRRFGEAPIFYGLYTFLIVVGAGCVLIPGLPLLKLILFSQVANGVLIPFVLIFMLILINKRGLMGDWRNGMWANLIAGATSVIMICLTAVMVWNAVH

SEQ ID NO: 9907 - protein, 394 aa, Zea mays
MLVTLMNLLRACWRPSSNRHARTGSDVTGRQDGLLWYKDAGQHVNGEFSMAVVQANNLLEDQCQIESGPLSFLDSGPYGTFVGVYDGHGGPETACYINDHLFQNLKRFASEQNTMSADVLKKAYEATEDGFFSVVTKQWPVKPQIAAVGSCCLVGVICGGMLYVANVGDSRVVLGRHVKATGEVLAVQLSAEHNVSIESVRKELQSMHPEDRHIVVLKHNVWRVKGLIQVCRSIGDAYLKKQEFNREPLYVKFRLREPFHKPILSSEPSINVQPLQPHDQFLIFASDGLWEHLTNQEAVDIVHSSPRSGCARRLIRAALQVAAKKREMRYSDLKKIDRGVRRHFHDDITVIVVFLDSSLVSKASTHRGPTLSLRGGGASAGLRSNTLAPTSMWL

SEQ ID NO: 9908 - protein, 344 aa, Bacillus cereus E33L
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAEQLAKKGLEVEVIDPRSLSPLDEDTILSSVEKTNRLIVIDEANPRCSIATDIAAIVADKGFDLLDAPIKRITAPHTPVPFSPPLEKLYLPTPEKVIETVSEMIGDQSLLHV

SEQ ID NO: 9909 - protein, 668 aa, Geobacter metallireducens GS-15
MSAPVLTSEDARLGADTLRMLAVDAVEAANSGHPGLPMGAADYAFLLWHSHLRFAPTDPEWAGRDRFVLSAGHGSMLLYSLLHLFGFDLPLDELKRFRQWGSRTPGHPEFGHTPGVEVTTGPLGQGFAMGVGMALAARMASARFADERFDPCGHQVYAIVSDGDLMEGISQEAASLAGHLKLGNIVYIYDDNRITIEGSTDLAFSDDTAGRFTALGWQVQKVDGHDIGQVGEALWRAKVERDRPSLIIARTHIAQGSPGKHDTAAAHGSPLGAEEAAATRRNLGWPDELFHVPERVREICDKRREELVAAYAAWEDEFRRWRRRNPDKARLWDGMWQKAIPKDLETRLLAAVEGSTGATRALSGKVIQAAAAAMPALAGGSADLEPSTNTWIAESPSVLAGSYRGRNLHFGIREHAMAAVMNGMARYGCFIPYGATFLVFSDYCRPSIRLAALMKQQAIYVFTHDSIFLGEDGPTHQPVEQLSSLRLIPNLRVIRPADGPETALAWNAALRRADGPTALILTRQKVPAIMREEPLDAKTFAKGGYAVRQDGATPDVVIMASGSEVGLALAAADILAGEGVTARVVSVPSLETFLAQPEAYRRRLLPGRVPRVAVEAGHGGLWWRLLGPGGLFIGMEGFGASAPEKVLAEQFGFTPPQVAQRVRELVGR

SEQ ID NO: 9910 - protein, 484 aa, Nocardioides sp. JS614
MPSLFEYAPAPESRAVVDIKPSYGLFVNGAFVDGHGASFKTISPATEEVLAEISEADESDVDAAVKAARTAYDKVWSRMPGRERAKYLYRIARIIQERSRELAVLESLDNGKPIKESRDVDVPIAAAHFFYYAGWADKLEYAGHGRDPQPLGVAAQVIPWNFPLLMLSWKIAPALACGNTVVLKPAETTPLSALLFAEICQQADLPPGVVNIVTGAGGTGQALVGHPGVDKVAFTGSTEVGKAIARSVAGTSKRVTLELGGKAANIVFDDAPIDQAVEGIVDGIFFNQGHVCCAGSRLLVQESIAEDLLERLKARMSTLRMGDPLDKNTDIGAINSGEQLKRIRELSEVGDAEGAERWEVACDLPTKGFWFPPTIFTGVSQAHRIAREEIFGPVLSVLTFRTPAEALEKANNTPYGLSAGVWTDKGSLILKMAASLRAGVVWANTFNKFDPTSPFGGYKESGYGREGGRHGLEAYLRSPHEGAR

SEQ ID NO: 9911 - protein, 332 aa, Bacillus cereus E33L
MLKTTESKGNGITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGDGPTIIECMTYRNYGHFEGEAQTYKTSEEKEEHLNEKDAIVNFRKHLIHEALLTESELVDMEKAVDDAVQKSIEFSENSPYPEDEELLKDVYVSYK

SEQ ID NO: 9912 - protein, 398 aa, Bacillus cereus E33L
MAVEVVMPKLGMAMKEGIITSWNIKAGDHVSKGELIASINSEKIETEIEAPADGTVLDIAVSEDEGVPPGTVICYIGKPNEKVEVHESTKVEEELVASEVSQNVQHPEPLGKEVTNKQRIKISPVAKKIAKTENLDIKSLLGTGPGGRITKVDVLKALEERVAIPEVLEESKVIPVTGMRKAIANRMHASLQNSAQLTLTMKVDVTDLVALHKEIAKVVQKRYNNKLTITDFVSRAVVLALGEHKEMNSAYMDDTIHQFEHVHLGMAIALEKGLVVPAIRFANNLSLVELSKQIKNVAQKARAGSLSSDDMQGTTFTISNLGSFGIEYFTPVLNTPEAGILGVGAIEHVPVYKGKKLKKGSMLPLSLTFDHRVLDGAPAAAFLRTIKRYLEEPVTILL

SEQ ID NO: 9913 - protein, 459 aa, Bacillus cereus E33L
MSKLVVIGGGPAGYVAAITAAQNGKNVTLIDEADLGGTCLNVGCMPTKSLLESAEVHDIVRKSNHYGVTLNNGSISIDWKQMQVRKSQIVTQLVQGIQYLMKKNKIKVIQGKAKFETDHRVRVTYGDKEIVVDGEQFIIATGSEPTELPFAPFDGKWILNSTHAMSLKNIPKSLLIVGGGVIGCEFASIYSRLGTKVTIVEMAPQLLPGEDEDIAHILRRELENDGVKIFTGATLKGLNSYKKQALFEYEGSIQEVNTEFVLVSVGRKPRVQQLNLEKAGIQYSNKGISVNEHMQTNVSHIYAAGDVIGGIQLAHVAFYEGTTAALHASGEDVKVNYHAVPRCIYTAPEIASVGLTEKDAREQYGDIQIGEFPFTANGKALIIGEQMGKVKVIVEPKYQEIVGISIIGPRATELIGQGTVMIHTEVTADIMRDYIAAHPTLSEAIHEALLQAVGHAVHA

SEQ ID NO: 9914 - protein, 179 aa, Triticum aestivum
  misc_feature (88)..(88): Xaa can be any naturally occurring amino acid
MGKSPAKWIKSVLLGKKSTKSNSTKPKDLPAKAANSNGYTAGKEPESSDNSPLISEPVLVSSHNVSEISNLPNGRAIENMVRVGSDTXISPEKLREELAAVKAQAAFRGYLARRAFRALKGIIRLQALIRGHLVRRQAVSTLHATWLYGEVQALVRGRNVRISSAAMQLAVKFGQHKYG

SEQ ID NO: 9915 - protein, 551 aa, Archaeoglobus fulgidus DSM 4304
MRFVRGFPSTMMDEYQLNITNILRHAATNFPEREVVSRNLDGSLFRYSYGEAYERVSRLANVLEELGVDVGDRVGVLSWNTHRFFELFFAIPGIGAVLLEMNLRLHPREIAYVANHSGAKVIFVDESLLPIAEAIAPSIGVEKYVVMTDGETPETKLPEVYSYEELLRKASKDYDFPMVDETSAYAACYTSGTTGNPKGVYYSHRSMVLHSLIAAIGMGLRPEDAYMQLVPMFHANGWGVFFAATLAGSKLVFPGRYAVDNLAPVVELMQSEKVTATAGAPAIFLPMLNYLQKVEPKPKFNIRAWSGATEPPLAVMKGLKEFGIEIIHAYGATETSPLVCYNYVKPELREKLNEEELWELKRKQGIPVFGVEVMLVDEEGNRLPHDGKTIGELCIRGHWITGSYYKDARTFESFIDDGLLKWWKSGDAATIDEWGYIKIVDRFKDLIKSGGEWISSVDLENHLMAHPKVFEACVVGIPHPKWEERPLAFVVPKPEFKDSITKEELYEHLKQRFAKWQLPDDIIITDEIPKTSVGKFSKRTLREQYKDYYTK

SEQ ID NO: 9916 - protein, 500 aa, Triticum aestivum
MEVASLYRRVLPSPPAVEFASAEGKRLFAEALQGGTMEGFFNLISYFQTQSEPAFCGLASLSVVLNALAIDPGRPWKGPWRWFDESMLDCCEPLHKVKAEGITFGKVVCLAHCAGARVQSFRADQTTIHDFRAHLTRCASSQDCHLISSYHRSPFKQTGTGHFSPIGGYHAEKDMALILDVARFKYPPHWVPLTLLWDAMNTTDEATGLLRGFMLVSRRSSAPSLLYTVSCGHGSWKSMAKYCVEDVPNLLKDESLDNVTTLLSRLVESLPANAGDLIKCVIEVRRKEEGESSLSKEEKERLFLKEKVLQQIRDTDLFRVVHELQYPKGLCGSCSSSSDEDSLAEIAATVCCQGAAFLSGNLVSRDGFCCRETCIKCIEANGDGLKTVISGTVVSKGNEQAVDLLLPTSSSKTSLCNSNLKSKIVKYPSSTDVLTVLLLVLQPNTWLGIKDENVKAEFQSLVSTDNLPDLLKQEILHLRRQLHYLAGCKGQEACQEPPSP

SEQ ID NO: 9917 - protein, 525 aa, Anaplasma marginale str. St. Maries
MRRWCADDSYLLWRVRYCRIGPVFLLAQIKCMSGSAVVLCILDGWGNGNGDECDAIHAARKPFWESVVSGCPRSSLSASGEDVGLPAAQVGNSEVGHISLGAGRVVLQDLQRINAEIGEIHSNPYLLQFAEAIKNGRGVCHIMGLLSDGGVHGLQDHITQLARVLAELRIKVLIHAFLDGRDVSPRSAKKHVTALNDAVHSYDISIATISGRYYAMDRDHRLDRTEKAYEAIALARGPRYRDAMTAIESSYSEGISDEFLVPSVIGDYQGFSPKDGILLTNFRSDRIVQILSMILHRSQEVSNILGMVRYSEKIQVPSLFPPRNICNTLGEVVSKCGLKQLRIAETEKYAHVTFFFSGGKEEPFPGEDRVIIPSPQVSTYDLQPEMSAFPMTEVLVERIESRQYSLIVVNYANADMVGHTGNLEAVKKAISVIDACLQMVFNAAKKAGATMLITADHGNAEKMFDMRGTPFTAHTSNTVPLVLCNCDKRFGLVDGRLCDVAPTILELMEIAKPDEMTGSSLLTPE

SEQ ID NO: 9918 - protein, 199 aa, Magnaporthe grisea 70-15
MAAPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNVPIILVGTKLDLREDPSTLESLRSKRMEPVSYDQALICAKEIRAHKYLECSALTQRNLKSVFDEAIRAVLNPRPQPAKVKKSKCTIL

SEQ ID NO: 9919 - protein, 409 aa, Oryza sativa
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 9920 - protein, 439 aa, Cytophaga hutchinsonii ATCC 33406
MQQILILGVGRSTYYLLKYLHDVLIPAGIRVKAIDLQQALIDNRQQEFPAIHFMQSEINPQSIATCIRDTDLVVSMLPPAFHLMVAELCIQQNKHFFTASYVSPEIKALHEEAKKRDLLFLMECGLDPGIDHMSALSLIDTLKSGGAAITSFESFTGGLVHPSYTNPPWNYKVSWNPRNVVLAGQGNPAQYLKDGTIQSVPYNKLFMQPSSWKLSGEQIYEGYPNRDSLNYRSLYALEQAGTFVRGTLRYPGYCFGWNCLIQLGLTDDTNMLPEDPARTGRSFLKNMLSVDDAVLEKELPGRCANNADALKYIQALGLFNETPIYTGAGTAAQILQTIIEQKWKMLPADKDRIVMIHRIKYNADGKKHVIQSSLVVDGEDAERTAMAKTVGLPLAIAIDLFLHNRISLRGVVIPVTKELYGPILQKLTAFGVVFNERNE

SEQ ID NO: 9921 - protein, 152 aa, Brassica napus
  misc_feature (112)..(112): Xaa can be any naturally occurring amino acid
  misc_feature (138)..(139): Xaa can be any naturally occurring amino acid
  misc_feature (143)..(143): Xaa can be any naturally occurring amino acid
  misc_feature (146)..(146): Xaa can be any naturally occurring amino acid
  misc_feature (149)..(149): Xaa can be any naturally occurring amino acid
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREYGXTPGYYDGRYWKMGKLSLVRDAPTPAXXVKEXPEXKTXYPN

SEQ ID NO: 9922 - protein, 199 aa, Cytophaga hutchinsonii ATCC 33406
MKMNAKFISSYDDYQKCPEITKPEYAFIGRSNVGKSSLINSLTGVKNLAMTSSKPGKTQLINLFTIEETWILADLPGYGFAKASQSSRIKWGRMVHDYLKNRTNLTTVFLLVDSRHEPMKSDLEQITWLASNGIPFSLIFTKIDKQSLTQTNKILASWTKVLSENWEELPKMFLTSSESGKGTEELLTYIDEINKQIAN

SEQ ID NO: 9923 - protein, 173 aa, Solibacter usitatus Ellin6076
MPDLKSLIREVPDFPKPGILFYDITTLLKDPSGFHGVIDGLKDHYRDIKVDTVLGIEARGFIFAPALAYALGAGFVPVRKPKKLPAECVRITYDLEYGTDTLEMHKDAIGNGHRVLIVDDLLATGGTASAAARMVQDAGGIVVGLGFVIELTFLAGRQRLNGHDVFSLLQYDK

SEQ ID NO: 9924 - protein, 302 aa, Corynebacterium glutamicum
MSGHHHHHHGSEQLYFQGAMNDSILLGLIGQGLDLSRTPAMHEAEGLAQGRATVYRRIDTLGSRASGQDLKTLLDAALYLGFNGLNITHPYKQAVLPLLDEVSEQATQLGAVNTVVIDATGHTTGHNTDVSGFGRGMEEGLPNAKLDSVVQVGAGGVGNAVAYALVTHGVQKLQVADLDTSRAQALADVINNAVGREAVVGVDARGIEDVIAAADGVVNATPMGMPAHPGTAFDVSCLTKDHWVGDVVYMPIETELLKAARALGCETLDGTRMAIHQAVDAFRLFTGLEPDVSRMRETFLSL

SEQ ID NO: 9925 - protein, 327 aa, Legionella pneumophila str. Paris
MKNNNKSVITVDLNDPVKSLEYLEEAFQIGTFILKNSPVNFKRLAKVLSDLDTFYNLDFKTKIEISGQISGGGATRGYFPLGVESGLVDVFEKKESYSFGWPDNEIPDSDTPNLSLVAPNIYPDHGYINQDDVGGLIKDFANTAKELSKLIEIILFNGKTALPIDESSDFQSLLRSFRYYKKTELDPPNTGANSLHTDWNLITLVYADADGYQYRDNEGNFQNIIPETDDCLIVNFGDFLSAWTGGKIVSPWHQVVEAKKKDVRNSLVFFYYPAASSSAVKNPIYNQGEPLSLFVDQSDPLNRLWDFSKIETMNEMYAEKWKQVSRK

SEQ ID NO: 9926 - protein, 338 aa, Xylella fastidiosa 9a5c
MSVALSIDLSKKKTILCFGEALIDMLAQPPVKKGMPRAFLQCAGGAPANVAVAVARLGGAVQFVGMLGRDMFGDFLFDSFAEAGVVTDGIVRTSAAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTARGQVPTFRVQVQDSNAAGDAFVGGMLYTFAQQFDDAAALIDFCHDPESIASMLRFAAAVGALAVTRHGAFTAMPMLSEVLSLIQEQS

SEQ ID NO: 9927 - protein, 134 aa, Zea mays
MRKHRIVSLVAALLILLALAVSSNRNAQEDSMADNTGTLVGGIQDVPENENDLHLQELARFAVDEHNKKANALLGFEKLVKAKTQVVAGTMYYLTIEVKDGEVKKLYEAKVWEKPWEKFKELQEFKPVEEGASA

SEQ ID NO: 9928 - protein, 473 aa, Bdellovibrio bacteriovorus HD100
MQNFDVVVIGAGPGGYVAAIRSAQLGFKTAVIEREFLGGVCLNVGCIPSKAMITATHLLHKAQHNFKEMGLNIKGGIDVDMKQLVKWKQSVSDKMSGGVNQLLKGYGVTIIKGDAEFKSSKEISVKSSAGTESVQAKYFVVATGSRPIEIPGFKFDEKDICSSTGALAFDTIPKRVAVIGGGYIGLEISSYLRKLGTEVTVIEAQSALLAGVVDPDCAQIVTRKLTKAGVNVLYGAKAKGQKKVKDGYEVTVEINGKDEVVKCDKILVTVGRRPNGDQANLKAAGIQVDERGFVKVDAQRRTNVSNIFAIGDIAGQPMLAHKASHEGVLVAEVIAGHNRVYDAKTVPAVVFTDPEIAAAGMTEAEAKAKGHTDLLISKFPFAANGRAVSMMETDGFVKMIADKKTHVLLGVHIVGPEASNLISEAVLAIEMGARIEDLALSIHPHPTLGETMMEAAEATLGHAIHIIQKPLKA

SEQ ID NO: 9929 - protein, 543 aa, Bdellovibrio bacteriovorus HD100
MNNERNSRNMATDVKLPELGEGVTEGELVKWLVKPGDAVKADQAIAEVLTDKATVEVPSPVAGVVKDLKFKSGDVVKVGATMITLDGAGAAKPAAAQPAAAAPAPAASTPAPAAGGGKAQDVKLPELGEGVTEGELVKWLVKPGDSVKADQAIAEVLTDKATVEVPTPVAGVVKELKFKSGDVVKVGSTMIILEGAGGAAAPKAAPAAAAAPAPAAAPATKAAAPVATASSDIFPPVADSKVLATPATRRLAREMGVDINSLTGTGLAGRVTREDVMSSGGGAAPAAAKAAPAAASMTIPKPAYQGPAGAAEERVPMIGIRKKIAENMQRSKHVIPHFTIMDEAKVDAMVALRESLKEHAEKNGTKITYLPIIMKALIATIREFPMFNASIDDAAGEIVYKKYFNLGFAADTPNGLVVPVIKNADQKSILEISKEILDLSKRARDGKLKPDEMKGATITVTNIGSIGGTYATPVINHPEVAILGMYKIDEKVVLKNGQVSAIKVMNYTMTADHRLIDGAVAARFLAAFIGRIENPGKLLVELI

SEQ ID NO: 9930 - protein, 160 aa, Triticum aestivum
LEHKHGSEERREAVPRGPLFLRRIGSVPCSGGGGHVCRTRPLALLLRLRDGPRRPHRLPVVIIEYTLQGVLCASFLLTLNWFPFLVMAPVTYYHVKLYMNRKHLIDVTEIFRQLHGEKKYRMIKLAFYFALFIISIYRLVMTAVLLFIDEDANLVETRTI

SEQ ID NO: 9931 - protein, 288 aa, Candida albicans SC5314
MPLIIFTGYPCSGKTKWAKLLQKELEIKIQTAKENSEPGQNYTVTYHSDETLGINHETYQDSNKEKLARGSQISAVKRDISRTNIVILDALSYIKGFRYQLFCEAKGNVTPHCIVHVIAPIEKCIQWNDTKESGNKWDPVLMKQLQMRYEEPNSDTRWDSPLFTILSEDPQEKIPIEDIWNALVLKKAAPPNAATLVKPTSGNSFLQELDKKTQEVVTKILQQQQITPGDVVIDKNLVVAIPTGTASTAQLQRIRRSYIGLNRMRSIDVDRIVPLFVEYLNRSLNSED

SEQ ID NO: 9932 - protein, 174 aa, Oryza sativa (indica cultivar-group)
MLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 9933 - protein, 438 aa, Yarrowia lipolytica CLIB122
MPVEKLHARYVYDSRGNPTVEVDLTTQHGLFRAIVPSGASTGVHEALELRDKDASKWGGKGVLKAVQNVNEIIAPAVIDAKLDVKDQAAFDKFLLELDGTENKSKLGANAILGVSIAAARAGAGEKGVPLYEHIASLASSPQPYVLPVPFLNVLNGGSHAGGRLAIQEFMIAPTEFESFSESLRAGTEVYHELKKLAKKEYGASAGNVGDEGGVAPDIQTAEEALNLITEAIDAAGYTGKIKIAIDAASSEFYNEEANKYDLDFKNPDSDKSLWKTGEELAAYYSELIKKYPIVSFEDPFAEDDWAAWSHFVSTTDIQIVGDDLTVTNPVRIKRAIEEKSANALLLKVNQIGTITESIQAANDSYDAKWGVMVSHRSGETEDVTIADLAVGLRAGQIKTGAPSRSERLAKYNQLLRIEEELGDKAIFAGPKFHLSRAI

SEQ ID NO: 9934 - protein, 386 aa, Saccharomyces cerevisiae
MSAATVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 9935 - protein, 399 aa, Geobacter metallireducens GS-15
MKSADWIAKGDKYIMKTYGRYPLVPVRGEGCRVWDADGKEYLDFLAGVAVNNLGHCHPKVVAALQKQAAEMIHCSNYYNIPTQIELAELLCSNSFADKAFFCNSGAEANEAAIKLARKYAREKTGDVERYEIITAIASFHGRTMATISATGQEKVQKFFDPLLHGFTYVPFDDADALEAAVTPKTCAVMLEPIQGEGGVVIPSADYFRKVREICDRHGLLLIFDEVQVGIGRTGKLFAHEHFDVTPDIMTLAKALAGGAPIGSMLAKDEVAASFSPGTHGSTFGGNPLVTAAGVAAVRAVLEEGLLNRAEEMGEYLVGELERLKEKYAFITDVRGIGLMIGMELSAPAGEIVLKGLERGVLLNVAQDKVLRFVPPLIVTKQEVNEMIAVLDGILEEIKQ

SEQ ID NO: 9936 - protein, 251 aa, Arabidopsis thaliana
  misc_feature (209)..(209): Xaa can be any naturally occurring amino acid
  misc_feature (223)..(223): Xaa can be any naturally occurring amino acid
ISSIFSLSIETEIWFDQKVLLCGFKKMLLLTKLNAKKGGFLVNNEVKIVVEVEVLQVIGNVDVSEESIEVNQPIKRIKLNDDGASVKESIDVNGFQVLPSQAESLKHIFEKHPEMALKFRAKNQHMRTSSINLLLNIIETLCQSLQDLSIDDLGQAEQALTYLENSGFKVDWLKRKLEEVKEKKMEEQNCKSRMQELEEELKVFKQKCXDIEAQLEKEKQKCXDIEALLEKEKAKAVAAARAPPLTLDDVV

SEQ ID NO: 9937 - protein, 242 aa, Oryza sativa
  misc_feature (108)..(108): Xaa can be any naturally occurring amino acid
  misc_feature (124)..(124): Xaa can be any naturally occurring amino acid
MAATRVWLSALLLAFLLAAAPVVQVARAQSMEEAATAEVVDGADLGIVSDDTQVSSDGPLSPAPGVETVCVFPKNAGKIVLAGEETELLVGLQNEGLTNNRSPNGQYXVNFFNASVPVSVQATXFPYTFAVSKFLQPGAYDLVGYIVYEIDQNPYQNVFYNGTVEVVEAGGLLSVESVFLITLGVALLGLFGLWAYGQVQQLSKKTKKAPKVELGTGTTDANMDEWLEGTAFAQGSKSKKKK

SEQ ID NO: 9938 - protein, 397 aa, Legionella pneumophila str. Paris
MSQFPRIKRLPPYVFNTINQLKMEARARGEDIIDFGMGNPDQPTPPHIVNKLIEVAQRPDTHRYSMSKGIPRLRRAMATWYLRHYDVHLDSETQILATIGSKEGLAHLALAISGPGDTVLVPDPAYPIHTYGFIIAGANVKQIPLIDEVQFLAAVEDAINRTWPKPKALVLNFPANPSTHCVEYEFFEKVVDLAKRNNIWIIHDLAYADIVFDGYKAPSILQVPGAIDIAIETYSMSKSYNMPGWRVGFACGNEELVAALTRIKSYLDYGTFTPIQVAAITALEGPDDCVLEIRNLYEKRRNLLCDGLNDIGWEVSKPKGTMFVWAPIPLNYRAMGSLEFSKYLLKEAQVAVSPGIGFGQQGDGYVRFGLIENKDRIRQALRNLKALFKRDGLLKAI

SEQ ID NO: 9939 - protein, 561 aa, marine gamma proteobacterium HTCC2080
MPSDIDIAQAATPQPIADIAKGLSIPEEALEPYGRTKGKINLNWLLEQPIRPSARMILVTAISPTPSGEGKTTTTVGLGDALRHIGKDAMICLREPSLGPVFGMKGGAAGGGYAQVIPMEDINLHFNGDLHAIGVANNLLSALLDNHIHHGNALGIDVRRVTWKRVLDMNDRALRDITVAMGGVGNGYPRQDGFDIVVASEIMAIFCLATDLADLKARIGRIVVGYTRDKTPVRASDLKAEGALTAVLKDALAPNLVQTLEGTPAFVHGGPFANIAHGCNSVIATTGALRLAEYVVTEAGFGADLGAEKFIDIKCRSANLRPSVAVLVATIRALKFHGGVAKESLNDENLEALSEGMVNLERHVKNIRDNYGVTPIVSINQFVSDSDAELALLVERVEAMGVRVAIASHWANGGAGAAELARMVAEVCDADKKAANAGHETYVYPDSASLIEKIEAVATKVYGASEVTISGKVRNRLKELEAEGYGGMPVCIAKTPYSFSTDPQLKGAPSGHVMDIREIRLSVGAGFVVVVCGDVMTMPGLPKVPASENIDVVNGQVTGLF

SEQ ID NO: 9940 - protein, 428 aa, Oryza sativa (japonica cultivar-group)
MDHDPKERLLLPPRAAAAAAANGPHRRAAPAAGGGGGGVAIDVHGLKRRGGGRRSWVRVDAATGASEAVEVAKPALMRRLDLPARDLRLLDPLFVYPSAILGRERAVVCNLERIRCIITADEALILRDPDVAGGGAETEEAVRRYVAELQRRLVDRADDLPFEFIALEVALEAACSFLDAQAVELEADAYPLLDELTTKISTLNLERVRRLKSKLVALTRRVQKVRDEIEQLMDDDGDMAEMYLTEKKRRMEASLLEEQAFQGMGNSGFGSSFSAPVSPVSSPPASRRLEKELSFARSRHDSFKSADSSQYSIEELEMLLEAYFVVIDYTLSKLTSLKEYIDDTEDFINIQLDNVRNQLIQFELLLTTATFVVAIFGVVSGVFGMNFEVDLFNVPHAFEWTLVITGVCGLVIFCCFIWYFKKRRFFPL

SEQ ID NO: 9941 - protein, 931 aa, marine gamma proteobacterium HTCC2080
MNKPIEIAIEDLDLGTPAALSESTVTVHIDGKAVDVPAGTSIMRAASLAGTQIPKLCATDSLDAHGSCRLCLVEVEGRKGTPASCTTPCQEGMSVKTQTPRLDKLRKGVMELYISDHPLDCLTCSANGDCELQDMAGVVGLRSVRYEEGSNHLDAGKDNSNPYFSFDASKCIVCSRCVRACSEVQGTFALTIAARGFESKVSPSEENAFLDSECVSCGACVQACPTATLQEKQVIDLGVPTRKVKTTCAYCGVGCSFVAELRGDELVRMVPDKQGGANAGHSCVKGRFAWGYATHSDRITRPMVRETTDSEWREVEWPEAIAFAADRFKAIQQKHGIDALGGITSSRCTNEEVYVVQKMVRASLQTNNVDTCARVCHSPTGYGLKQTFGTSAGTQDFASVQQADVIMVIGANPTDAHPVFGSRMKRRLREGAKLIVIDPRSIDLVKSPHIKATSHLQLQPGTNVAVVNALAHVIATEGWIDEAFVQERCDVASFNAWRRFISLPENSPENLAEISGVAAETIREAAATYAKAGNSAIYYGLGVTEHSQGSTMVMAMANLAMATGNIGRDGVGINPLRGQNNVQGACDMGSFPHEFSGYRHVSDETAREQFTALWGVDLREEPGMRIPNMLDAAISGNFRGMYIQGEDIAQSDPNSQHVAAALSAMDCVVVQDLFLNETSKFAHVFLPGTSFLEKDGTFTNAERRINRVRPVVPPASGLAEWEVTCALSEAMGYTMDYANASEIMDEIAALTPTFAGVSFDLLDERGSIQWPCNEQAPEGTPIMHAQRFVRGEGQFVTTPYVPTDERSTRKFPLLLTTGRILSQYNVGAQTRRTDNTVWHAEDILEIHEADAELRGVADGDWIEVASRAGSTRMRAHISDDIPAGVVYTTFHHPVSGTNVITTDNSDWATNCPEYKVTAVEIRPSSAIAVGM

SEQ ID NO: 9942 - protein, 563 aa, Bacillus thuringiensis serovar konkukian str. 97-27
MKVEKPWLKSYPEEIPSTISYDIQPLHKYVEQMASRYPEKKALHFLGKDITFSVFHDKVKRFANYLQKLGVEKGDRVAIMLPNCPQAIIGYYGTLLAGGIVVQTNPLYTERELEYQLHDSGAKVILCLDLVFPRVTNVQSATKIEHVIVTRIADFLPFPKNLLYPFVQKKQSNLVVKVSESETIHLWNSVEKEVNTGVEVPCDPENDLALLQYTGGTTGFPKGVMLTHKNLVSNTLMGVQWLYNCKEGEEVVLGVLPFFHVYGMTAVMNLSIMQGYKMVLIPKFDMKMVFEAIKKHKVTLFPGAPTIYIALLNSPLLKQYDISSIRACISGSAPLPVEVQEKFETVTGGKLVEGYGLTESSPVTHSNFLWEKRVPGSIGVPWPDTEAMIMSLETGEALPPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIEEEKRKNEDEQTG

SEQ ID NO: 9943 - protein, 497 aa, Magnaporthe grisea 70-15
MNIQLSAPNGKKWIQPTGLFINNEFVKSSNGQKLTTVNAATEEDITSVYSATEEDIDKAVKAARAAFKHPSWRNLSGTERGEMMHKLADLVVKNAETLATIEALDGGKPYSVALGEDVVEFEKTIRYYAGFADKNFGQTIDVGPNKFAYTIKEPIGVCGQIIPWNYPLCMAAWKLGPALACGNTVVLKLAEQTPLSMLYVATLIKEAGFPAGVVNVINGLGGEAGAAIVQHPDIDKVAFTGSTATGKQIMKACAGTMKNITLETGGKSPLLVFDDADLDLAAEWSHIGIMSNQGQICTATSRILVHESVYDKFVGRFKDTVEKVSIVGDPFDEKTFQGPQVTKAQYEKVLGYIKLAQEEGATIATGGKPAPQNGKGFYVAPTVFTNVKTSMRVYKEEIFGPCVSIISFKDEEEAVELANDTTYGLGAAVFTRNLTRAHRVAREIQSGMVWINSSNDSDCRVPFGGVKQSGIGRELGEAGLASYCNIKSVHVNMAAHL

SEQ ID NO: 9944 - protein, 214 aa, Oryza sativa (japonica cultivar-group)
LSLDNSARAPDGYLVHGVSDDRRRHHLPAQPHLGERRRPWPEQQEEVRQELRRAVHGDEAVPPRHPLRLQQQHLQLHGGGGHQADGAGQRRAVDRRHLLRRGGGVQRPVTEGRALPPSLEETAVRAQGLYLYNSKEAFNAWLAFSIVFNSTGRRGTLNLMGADIIAEKTRDISVVGGTGDFFMSRGVATLRTDAFEGFTYFRLQMDIKLYECYV

SEQ ID NO: 9945 - protein, 290 aa, Geobacter metallireducens GS-15
MFKGSIVAIVTPFNNGQVDFEKLRELVEFQISNGTDAIVPCGTTGEASTLDYDEHMDVVKTVIEQVNKRVPVIAGTGSNSTAEAIELSQKAKEVGADGVLLVTPYYNKPTQEGLVRHYTAIADAVAIPQILYNVPGRTGVNMLPETVARLAPHKNIVAIKEATGSLQQASEILALCGDKIDVLCGDDFITFPMMACGAKGVISVLANIMPKTVAELTDAFYAGDMEKARQLHLQTLKIGNAMFIESNPIPVKTALGLMGKCSDEVRLPLCPMGAANKEKLAAIMKEYELI

SEQ ID NO: 9946 - protein, 515 aa, Saccharomyces cerevisiae
MFQRKTLQRRNLKGLNLNLHPDVGNNGQLQEKTETHQGQSRIEGHVMSNINAIQNNSNLFLRRGIKKKLTLDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 9947 - protein, 451 aa, Nocardioides sp. JS614
MVDQATLEVPAQLRSDRGLPLVGRLFDYTRDPIGFFRHQWETYGPVSPFDSALDHAVVLLGPDACEQVLRNKDKAFANEPAWGKIVGPFFKRGLMLLDFDEHHAHRRIMQEAFTRDRLETYATRMHPAIAEGTASWDTERRFRSYPALKQLTLGIAADIFMGGAGDTSRAEMDRVNRAFIACVQAAAGIVRADVPFTRWGRAYRGRKVLEEFLRHYLPAKRATRTEDIFSVLCHIETEDGQRFSDEDVVNHMIFLMMAAHDTSTITTSTILQLLGQHPLWQERCRAEALALGPEPTLAELEGLQALDWVMKEALRLHAPVPILVRRTVKDTVVQGHLIPADTDVMVGVQFSHVMEDYWTDPMVFDPERFSPERREDRSHRYAWEPFGGGVHKCIGLYFAGIEVKAILHRLLRNHRWSVDPGYAAPYDNHSLPFAKDGQPIDLVRTDPRGES

SEQ ID NO: 9948 - protein, 103 aa, Zea mays
  misc_feature (53)..(53): Xaa can be any naturally occurring amino acid
MSGRGKGGKGLGKGGAKRHRKVLRDNTHGITKPAIPRLSRTGGVKRISRLIYXETRGVLKIFLENMIRDTVTYTEHARRKSTTTIYVVYSLNSQGRTLYLLFG

SEQ ID NO: 9949 - protein, 427 aa, Saccharomyces cerevisiae
MHHNSQSLSSGHIRSPEDENVAPIGNLKHRTGSLSHISSAHPRVALSDVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 9950 - protein, 302 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIE

SEQ ID NO: 9951 - protein, 305 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMK

SEQ ID NO: 9952 - protein, 268 aa, Zea mays
  misc_feature (252)..(252): Xaa can be any naturally occurring amino acid
  misc_feature (259)..(259): Xaa can be any naturally occurring amino acid
MAIPLVLVLLPLGLLFLLSGLVVNTVQAVLFLTIRPFSKRLYRQINVFLAELLWLQLIWLVDWWAGIKVQVYADPATWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRXKRHSMSXMPNSDEDVS

SEQ ID NO: 9953 - protein, 147 aa, Zea mays
MPHGTLEVVLVSAKGLEDSDFLNSMDPYVLLTCRTQDQKSNVASGQGTTPEWNETFIFNVSEGTTELKAKIFDTDVGTEDDPLGEATIPLEAVFLEGDIPPAAYNVVKDEEFKGEIWIALSFKPSENRSRGFEEESYGGWKNSEASY

SEQ ID NO: 9954 - protein, 286 aa, Cryptococcus neoformans var. neoformans JEC21
MSFDLQQALAQLQSAYDASSEQVSTQLAKLKLELAQSGLYFAPPSADPQDLIAARSILEIGAFQSLRQGDLKSYARYNFALQPFYDNLRDIIPASPNRPVTLGLHLLGLLSENLLTEFHTLLETLKPEELNDSFVRLPVDLERWLMEGSYNKVYRARDRVPRPEFEFLLERLMGTVRGQIASTIESSYPSLPLQHAATLLFFKSGETSSLTDFAFARGWSLSPNTQTFSFPRSSKPDIALAAAESSSDVSSATIDKLKGTGVVRGVPMETMVGPALRLAQQLEAIV

SEQ ID NO: 9955 - protein, 422 aa, Bdellovibrio bacteriovorus HD100
MSEIISVISREILDSRGNPTVEVEVTTADGNMGRAAVPSGASTGAHEACELRDGDKNRFLGKGVYKAVDNVREKIAPEIVGLQATEQVYIDKILRDIDGTENKSNLGANAILGVSLAVAKAAAKDCRLPLYRYVGGSQASRLPVPLMNVLNGGAHANNGLDIQEFMIVPTVNNSYAESLRAGTEIFHTLKKILAKKGLSTAVGDEGGFAPKLGSNQEALDLLMNAIVDAGYDPGQNVFLALDVAATEMFKEGKYEWQGGHISPTELLGIYKSWAEKYPLVSIEDGFAEDDWDSWVQSTAQMGSTMQLIGDDLFVTNPKRLRMGLEKKAGNALLVKVNQIGTLTETYEAVNLAQRNKFRTIMSHRSGETEDVTIADLAVGLNCHQIKTGSLCRGERTAKYNQLLRIEEDLGGMGLYWDKAAFR

SEQ ID NO: 9956 - protein, 412 aa, Rhodococcus sp. RHA1
MTLNTIVTIGAGQTAAVAARTLRRRGFDGRILLVGDESHAPYQRPPLSKEFLAGQEDRESLMLLPDAWRDKQNVELLTDTTVTRIDVSSGSVQLSDGRSIAADAVLVATGGRPRTMPVNGPAPERVHYLRTIDDAERLAAHLRPGVGLVLIGGGFVGLEIAATATALGAEVTVLEADQVPLARILGPEMGEVCTRLQRENGVTVRGGVRVDTVTTRPDGVLIALDGGEVISADVVVVGIGIVPNVEVAQASGLAVDGGILVDAQGRTSIPHVYAAGDVAARFSDAAGRHVRVEHFDNASKQGAATANLMLGRVGVVDPAHWFWSDQFGKNIQFTGTARYTDLVFRGSADGGEFTAFYLDSGVVRGAFTLDRGDEISAARELIGRSIAPARLADEDVDLFDLMDDDEELVTVS

SEQ ID NO: 9957 - protein, 473 aa, marine gamma proteobacterium HTCC2080
MYINGQWLEEGPTFEVYNPATGVSIGSVIDVSNEQVLDAVAAAEAAFPAWSKTTAYERSAILTRCHTLMMERQRTLAELMTSEQGKPLKAAMNEVKYAADFLLWFAEEAKRIYGETIPSARSDQRFLVHKQAVGVVAAITPWNYPISMLTRKLGPALAAGCTAVLKPAEATPLCAVAVFEILHEAGLPAGVANLVTVSDPKPVGEIFCTHRAIRKLTFTGSTAVGKSLAQAAAPQLKRVSMELGGHAPFIVFDDADPVHAAKGVSLVKFLNTGQACISPNRIFVQRKILDSFLDTLQGRIEKLHAGDGMEPSTTIGPLINHAAIEKIDRQVQDAVAQGASLHSGGRRLTEDGLEKGCFYSPTLLSNVSSDMLIYREETFGPVAAVIAFDDDDDVIAMANDTDYGLAAYVYTQNLSRALRTFEELNFGIIGINDINPTSAAAPFGGMKESGLGREGAREGLEEYLETKLGGLSI

SEQ ID NO: 9958 - protein, 527 aa, Streptomyces coelicolor A3(2)
MAQTAREPARDGLPKGFRSAELGWPELHRIPHPPYRLPLLGDVVGASRRTPMQDSLRYARRLGPIFRRRAFGKEFVFVWGAALAADLADEARFAKHVGLGVANLRPVAGDGLFTAYNHEPNWQLAHDVLAPGFSREAMAGYHVMMLDVAARLTGHWDLAEASGRAVDVPGDMTKLTLETIARTGFGHDFGSFERSRLHPFVTAMVGTLGYAQRLNTVPAPLAPWLLRDASRRNAADIAHLNRTVDDLVRERRANGGTGGGTGSGSGSGDLLDRMLETAHPRTGERLSPQNVRRQVITFLVAGHETTSGALSFALHYLAQHPDVAARARAEVDRVWGDTEAPGYEQVAKLRYVRRVLDESLRLWPTAPGFAREAREDTVLGGTHPMRRGAWALVLTGMLHRDPEVWGADAERFDPDRFDAKAVRSRAPHTFKPFGTGARACIGRQFALHEATLVLGLLLRRYELRPEPGYRLRVTERLTLMPEGLRLHLVRRTAAAPAPGRRTAAPGAADDAGDTVSAPGCPVHRAGD

SEQ ID NO: 9959 - protein, 439 aa, Geobacter metallireducens GS-15
MTMTSFGPTGLDATLIPKIAGEWGTPIYLHDQQYIENSCDQLLAMPNAYGLHVRYAIKANSDRTVLRIVTGKGLDLDCSSLDEAARAHAAGIPYSRMMLTTQEVPTGEERTELEAMIKVGLKYNVCSTLQYQLIADFAAQNKIDLSMRVHPGAAGGGESATRDTGSEYSCFGVHLRDVPTVKALADEKGLRFTQVHVHIGSGGAPEKWQENIDRELGFIKTYFPDAVTVSFGGGLKVARMPGEKQADIATLGAYAKQRIEEFKAATGRELMMEIEPGTFVVANSGHIVTRIIDKKFTNEMNFLIVDGGMELLTRPLLYGSEHPIAIVRQDGTLLSSEYDQTPTAGLKPFGIVGRCCESGDSVRLDKEGNIVPVMIVEPEIGDYVVIGGTGAYSESMSPENYNSHRKPGAVMRTKTGELVLIRKKQVREQLTQNELDVTL

SEQ ID NO: 9960 - protein, 850 aa, Bacillus cereus E33L
MTKRLINKSVLLLTIIVMLSSVYSFQNVKAVSNSKTTEVIIHYKEQSGNTKDWNLWIWGENSNGKSYEFTGEDEFGKYAKINIDGDYNRLGFIIRTSEWEKDGGDRWIENIKDGRAEVWILSGDEKVYNSKPSSDLSIQKATIDSFHEITVTTNVPFHIKEKKIEMEGIKIKSISPYDINSGDITNKVKIITDQKIDLKQTYKVKIENLADTNTEIGKVIRTEEFDKLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKRWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERKMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKENMEDRIKKGITAGIDYDTNSSTYLDPEQVLTYVEAHDNHTLWDKLELTNPGDSEEARKQMHKLSSSILLTSQGIPFLHAGQEFMRTKYGDHNSYKSPDSINQMDWLRRAAFNNEVDYMKGLIELRKKYPAFRMTSAEQIKTHVSFIDAPKNTVAYTIEGNKNEYFTVAHNANRESVEISLPSKGPWKVLVDGKQAGSKPLYVVHDNKIKVPALSSLVLKTEKPIK

SEQ ID NO: 9961 - protein, 349 aa, Glycine max
MFTCIACTKTDDKDEEGGSRESGTPSTKEAVKSLTTQIKDMALKFSGAYKQCKPCTGSSSYKKGHRPYPDFDTISEGVPYPYIGGASSSSTPAWDFTTSHYPGGRSDPRFAGAYGGDRTPRGRDSSSVCDVVLEDEDEPKEWMAQVEPGVHITFVSLPNGGNDLKRIRFSREMFNKWQAQRWWGENYDRIMELYNVQRFNKQALNTPPRSEDEQRDSSYSRLTSARESPMASNKDWTPRSHYKFSGSRGYYPSEPLDHGGGSGQYHAGPSMEPARDTTASRDEPSISNASEMETEWVEQDEPGVYITIRQLADGTRELRRVRFSRERFGEVNAKTWWEENRERIQAQYL

SEQ ID NO: 9962 - protein, 661 aa, Anaplasma marginale str. St. Maries
MMGRESYQIMAKAVRLLSVDAIQNAASGHPGMPLGMADVATVLFSKFLRFSVNHPSWFDRDRLVLSNGHGSMLMYSIMHLVGYIGIDDIKRFRQLHSITPGHPEYGCTTGVEVTTGPLGQGLGCAVGLAIAERMFSQKFGDDLINHHTYAIVGDGCLMEGISHEAASLAGHLGLDHLIVLFDDNGISIDGSTSLATSDDVRARFSAYGLDVFEVDGHDFGEIEQAIGAARESRGKPSIICCKTVIGKFMPPKAGTSAAHSWPFSPEDAQEFRNAIGWEGEKFEIPEEAKALWRKVRARAELECELWMKKFAGCAKAEVLNAILSDGVPNSVIDELDTLKNTLCETRPAEATRKSFGRVLEFLAMRVNKLVGGSSDLTSSNNTKVPCMGVVSSKNFDASYVHYGVREHAMAACMNGMALHGGIIPYGGTFLVFSDYCRPAIRLSALMRVQVIYVMTHDSIGVGEDGPTHQPVEHLASLRSIPNLYVFRPADAVEVLECWEMALKLTKSPSLFALSRQSVGFSRACYSHNNLASRGAYIIREHEGDFRVTIFSTGSEVGVALGAREILQDQGIGTRVVSMPCWRIFDEQDEEYIASLLGNGSLKVAVEAACSLGWHKYIGEKGVFMGLDRFGASGKCEDLYRHFGITKENVAGTILAKLRSGV

SEQ ID NO: 9963 - protein, 200 aa, Bdellovibrio bacteriovorus HD100
MGGALIVLAMPKTIQFIKSAVLEKDFPVHKKAEVAIAGRSNAGKSSFINALTKNKIAKVSSTPGKTRLLNFFELDQSYVMVDMPGYGFAARSGDEMREWHRMIETYLMNREQLRGLLLVMDIRRSWTEDEELLKEFSERRGFPLAVVLTKADKMSRSQMLQAVAKVKKASGLSAVFGVSALKKEGQDAVEDYIYENWIKE

SEQ ID NO: 9964 - protein, 113 aa, Prochlorococcus marinus str. MIT 9301
MTETTIFQKIINEEIPCDKLYEDEFCIAFNDIQAQAPVHFLVIPKKPIISLLECIEQDANLLGHLLFVGSKIAKSKNLTNWRTVINTGAESGQTVFHLHIHFLSGRKMNWPPG

SEQ ID NO: 9965 - protein, 261 aa, marine gamma proteobacterium HTCC2080
MMKVFKTTYGPWALVAGASEGLGAAFAESLASRGINLILVARREPQLLAFAEVLRDRYGVTVETHALDLAVPGAAESFIRGLHHDVGLLICNAAYSAVGLFQEVPLTQLQQILSVNTAAPLALTRELIPRLIKRGRGGVVLMSSLSGGQGSANIATYAATKAFNTVLAEGLWQELGSQGIDVIASCAGAIRTPAYQSAQKGAEAPGILSAHTVAEETLGALGKTPTVIPGRLNKVVGFLMRRLLPRATAIRLMSKSTKELQ

SEQ ID NO: 9966 - protein, 326 aa, Bdellovibrio bacteriovorus HD100
MSKVIQQGLKVLEVEAQAILALKERLGDSFEQVVKMITACDGKIVLTGMGKSGQIARKLASTFSSTGTPAVFLHPAESSHGDLGLVENNDVVIALSYGGESPEFAGILRFVSRKGIPLIAITGKPESSLAKAAQVTLNVHVSEEACPLGLAPTASSTATLAMGDAVAMAVMAEKGFSSEDFAEFHPGGSLGYRLLTRVRDVMHGGDALPTVTLDTPIRQVFSIMTHKDVRGAAGIVDEKGDLVGVITDGDIRRRLEKSNDPLTGLAKDLMTTNPRTIDANELAEKALFVMEQFQIQMVFVLDKESSNPRKPVGILHIQDLLRAKVR

SEQ ID NO: 9967 - protein, 162 aa, Zea mays
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARRLPLFRCYSYCKTTCVSHEKQRTNRQVSLYSDLTWCRAEAQQLS

SEQ ID NO: 9968 - protein, 455 aa, Parvularcula bermudensis HTCC2503
MPRSFPVPPHRFTRSSTLTPAPSDEPGLPARRAALDILLAIRRGQALDMAMAESEAFEDLEGADRGFARTLIMAVLRRQNTLDEAYGTFLDRPLKSTQGTVITLLRLAAAQILLLGVPPHAATATTVDLAKERRDSAGFAKLLNALCRRMVEKGPSLIEDYPPRTDVPGWLWRRLERHYGAKTARRLAAAFVQEPALDLTPKDPKERERLATALEAHPLGPVSLRRTAGGRIEDLPGYTEGDWWIQDLAAALPISLLGDLTGQRVYDLCAAPGGKTAQLAAAGAHVTAVDISAKRLRRLEDNLARLGLRADTFVGDVLGFSPDEPADLVVLDAPCTATGTVRRHPDLLWSKKEEDVAELSALQDQMLHHAARLVRPGGRLMFITCSLLAEEGEDRSRAFLSRHSQFTAEPLSDDEKERLGPLNAAKDGHLRTRPDLIADAGGMDGFYAARFTRQD

SEQ ID NO: 9969 - protein, 783 aa, Magnaporthe grisea 70-15
MVSQAAAPVVETVDEKHKGQNVSDVVSGADSTSDKSREPHQVKKDEDDDDGASLPSMEVLHAAGVGLDEDDPNQPCLTIRMWVIGIAFCIVGSGVNALNTMRIPSTTLSQSAIQFLAYPIGKAWEYALPDWGVTVFGSRISLNPGPFNAKENILIYILANLSFLSRLSVDVLIEQRIFYGLEAGWGFELLMTASTLILGFALSGIFRKLVVEPPSLMWPGVLGNTALNHTLHSKDKMISESRWKMSRYTFFMIAFCASFAWYWLPDFLFPALSYFTFICWAAPNNVVVNQVFGMKSGMGLMPITFDWAQIAYINNPLLVPPWAIINVFASLVIWVWILAPILYYTNTWNLAYLPFQDNSVFDNMGKSYNVTRVIDKQAGFTFNATKYEQYSQIYMPATYAINTFGLCFATITSLFVWIALEKRDNVWSAINSSWLARRFMPSKYQPPQPSPQPQYRVAPTWWYVAAGVVALVFGILSCELYPVQLRWYGVIFSFVISFIFFLPLAWVYATTNIKIQIEIICRVIAGYAYEGKVLANIWFFNLGYISGIKGLAFAQDLKLGLYCNVPPIKLFIVQVVGIVFATLSQVGVLNWALGSIPGICTPKAENGFTCPFSRTHFNTSMIWGAVGPRRFFGPGALYTPLLWFLLVGAALPVLVWALRHPRALGRYKAARWLKHVHVPVFLGGLNYIPPATGANYSSWAVVGLTFGILMRRRASEWWSRYNFVLAAALDCSVAIAGVVIFFAIFYTGVGTKFSWWGTDVYQNTCDWTGCSYLNLPKGQKFGP

SEQ ID NO: 9970 - protein, 414 aa, Glycine max
NSATKSQITHTHTQIHTLVVWCVPFLYPFAFCVQLTHTHTKMTACQDWPEPVIRVQALAASGLATIPERFIKPKSQRPTNSNNYAPKTNFSQIGHHKNNTTNSNIPVIDMKHIYSGDEGKRAETLRLVSEACQEWGFFQVVNHGVSHELMKGAREVWREFFHQPLDVKEVYANTPLTYEGYGSRLGVKKGAILDWSDYFFLHYMPCSLRDQAKWPALPTSLRSIISEYGEQIVKLGGRILEIMSINLGLREDFLLNAFGGENDLGACLRVNFYPKCPQPDLTLGLSSHSDPGGMTILLPDENVSGLQVRRGEDWVTVKPVPNAFIINMGDQIQVLSNATYKSIEHRVIVNSDKDRVSLAFFYNPRSDIPIQPAKELVTKDRPALYPPMTFDEYRLYIRTRGPSGKAQVESLTSK

SEQ ID NO: 9971 - protein, 335 aa, marine gamma proteobacterium HTCC2080
MTMRLVASCLALVFACSQTFAKEMPTDFQAVVDRAHAQFKDVKDGANADYIPILATVPSDMFGVVIVTRDGQVFSAGEMDYEFSIQSVSKPFTASLVMDQQGPAAVREKIGVEPTGLPFNSKMALELYAARSVNPLVNAGAIAAVSLVEADSEEDRWNQIHANLNAYAGRELPVLEEVYTSEYEESWSNRGIANLLYNYGRLYSDPEETLRVYTRQCSTGINTLDLGMMGATLANQGVNPVSGKRVLDAAHIPELLAIMATAGFYDESGEWMYSAGLPAKTGVGGGIVAVVPGKFAIATFSPPLNEAGNSVRGMQAIRYIAGELGVGLFGANKGE

SEQ ID NO: 9972 - protein, 763 aa, Saccharomyces cerevisiae
MNDSQNCLRQREENSHLNPGNDFGHHQGAECTINHNNMPHRNAYTESTNDTEAKSIVMCDDPNAYQISYTNNEPAGDGAIETTSILLSQPLPLRSNVMSVLVGIFVAVGGFLFGYDTGLINSITDMPYVKTYIAPNHSYFTTSQIAILVSFLSLGTFFGALIAPYISDSYGRKPTIMFSTAVIFSIGNSLQVASGGLVLLIVGRVISGIGIGIISAVVPLYQAEAAQKNLRGAIISSYQWAITIGLLVSSAVSQGTHSKNGPSSYRIPIGLQYVWSSILAVGMIFLPESPRYYVLKDELNKAAKSLSFLRGLPIEDPRLLEELVEIKATYDYEASFGPSTLLDCFKTSENRPKQILRIFTGIAIQAFQQASGINFIFYYGVNFFNNTGVDNSYLVSFISYAVNVAFSIPGMYLVDRIGRRPVLLAGGVIMAIANLVIAIVGVSEGKTVVASKIMIAFICLFIAAFSATWGGVVWVVSAELYPLGVRSKCTAICAAANWLVNFTCALITPYIVDVGSHTSSMGPKIFFIWGGLNVVAVIVVYFAVYETRGLTLEEIDELFRKAPNSVISSKWNKKIRKRCLAFPISQQIEMKTNIKNAGKLDNNNSPIVQDDSHNIIDVDGFLENQIQSNDHMIAADKGSGSLVNIIDTAPLTSTEFKPVEHPPVNYVDLGNGLGLNTYNRGPPSIISDSTDEFYEENDSSYYNNNTERNGANSVNTYMAQLINSSSTTSNDTSFSPSHNSNARTSSNWTSDLASKHSQYTSPQ

SEQ ID NO: 9973 - protein, 399 aa, Erythrobacter sp. NAP1
MDEQFYRMKRLPPYVIAEVNAMRHAARQAGQDIIDLGMGNPDQPPPQHVIDKLCEVAMKPDAHGYSQSKGIPGLRRAQANYYGRRFGVDLDPENEVVVTMGSKEGLGSLANAITAPGDVVLAPNPSYPIHTFGFIIAGATIRSIPTTPDEEYWRSLESAMNFTVPRPSVLVVSYPSNPTAETVDLAFYERLVAWAKENQVWVLSDLAYSELYYDGVPTPSIMQVDGAKDIAVEFTSMSKTYSMAGWRMGFAVGNKQLIAALTRVKSYLDYGAFTPIQAAACAALNGPQDIVESNRDLYRKRRDVMVEAFGRAGWDIPSPAASMFAWAPLPPALKEMGSLEFSKQLLTEAQVAVAPGVGYGEKGEGYVRIAMVENEQRLRQAARNIKRYLASAGVNTSAA

SEQ ID NO: 9974 - protein, 473 aa, Bacillus licheniformis ATCC 14580
MNEQGNQKSFLRTIILVSTFGGLLFGYDTGVINGALPYMSEGDQLNLTAFTEGLVASSLLLGAALGAVFGGRLSDYIGRRKNIIFLAVLFFFSTLGCTLAPDVTVMVISRFLLGVAVGGASVTVPTYLAEMSPSEKRGRMVTQNELMIVSGQLLAFTFNAILGTTMGDSSHVWRYMLAIAAVPAVFLFFGMLRMPESPRWLVSKGKNEAALGVLKRIRKEKRAHSEVAEIEAAVMKESEMKKANYKDLAVPWVRRIVFLGIGIAVVQQITGVNSIMYYGTEILKNAGFETKAALIGNIANGVISVLATFVGIWLLGKVGRRPMLLTGLIGTTSALLLIGIFSNVLQGSAALPYVVLTLTVTFLAFQQGAISPVTWLMLSEIFPLRVRGLGMGVTVFCLWIANFFVGFSFPILLESIGLSSTFYIFVGLGLLSIAFVKKFLPETKGLTLEQLEHNFRNYKSETAQSGASAKISG

SEQ ID NO: 9975 - protein, 202 aa, Saccharomyces cerevisiae
MAEESTDFSQFEEERNNDQYKVSAKKTVDEYKNLDAEDESLAKWKESLGLSSDVLPLEFPGDKRKVVVQKIQLLVNTEPNPITFDLTNEKTIKELASKRYKIKENSIYKLKIVFKVQHEIITGLRYVQYIKKAGIAVDKIDDHLGSYAPNTKTKPFYEVELPESEAPSGFLARGNYSAVSKFIDDDKTNHLTLNWGVEIVKK

SEQ ID NO: 9976 - protein, 466 aa, Yarrowia lipolytica CLIB122
MLRSAAARAVRAVRPRLSARYMATTALPQDPIPSGALGQKVPHVDESHQDLLFRTSHMVEDLETYDEDSPINTSDANTRIRAFTINFGPQHPAAHGVLRLILELSGEEIIRSDPHVGLLHRGTEKLIEYKTYMQALPYFDRLDYVSMMTNEQVFSLAVEKLLNVEVPLRGKYIRTMFGEITRVLNHLMSVCSHAMDVGALTPFLWGFEEREKLMEFYERVSGARLHAAYVRPGGVSQDLPAGLLDDIYMWATQFGDRLDEIEELLTDNRIWKLRTVNIGTVTAQDALNLGLSGPMLRGSGIPFDIRKNAPYDAYDKVDFDVPVGMNGDCYDRYLIRMAEFRQSLRIIEQCCNDMPAGAVKVEDFKINSPPRNLMKEDMEALIHHFLLYTKGYSVPPGETYTAIEAPKGEMGVYVVSDGSERPYKCKIRAPGFAHLGAFDHIARGHFLPDAVAIIGTMDLVFGEVDR

SEQ ID NO: 9977 - protein, 886 aa, Haemophilus influenzae R2866
MSEILKNDVDPIETQDWLQSLDSLIREEGVERAQYIVEQVIGQARTSGVSLPTGVTTDYVNTIPVAEQPAYPGDHAIERRIRSAVRWNAIAMVLRSQKKDLDLGGHISTFQSAATMYEVCYNHFFKAATEKNGGDLIFFQGHAAPGMYARAFLEGRLTEEQMDNFRQEAFTDGLSSYPHPKLMPEFWQFSTVSMGLGPVNAIYQARFLKYLDNRGLKDTKDQKVYAFLGDGEMDEIESKGALTFAAREKLDNLIFTISCNLQRLDGPVNGNGKIVQELEGLFTGAGWEVIKVLWGSDWDKLFAKDTSGKLTQLMMEVVDGDYLTFKSKDGAYIREHFFGRYPETAALVADMTDDEIWALRRGAHDSEKLYAAYAKAQNATKPVVILAHQVKGYKIPEAESKNTAHQSKKMSYESLKGFRDFFELPLTDEQVEKLEYIKFAEGTPEYEYLHGHRKALNGYVPARRTKFDVEYKVPALEEFKALLEEQPRGISTTMAFTRALNILLKDKNIGKTIVPMIADEARTFGMEGLFRQVGIYNPHGQNYVPSDRDLVAYYREAKDGQVLQEGINELGATASWLAAANSYSVNNQPMIPFFIYYSMFGFQRVGDMMWAAGDQLARGFMVGGTSGRTTLNGEGLQHEDGHSHIQAGVIPNCVTYDPSFAFEVAVIMQDGINRMYGEKQEDVFYYMTTLNEVMDQPAMPAGAEEGIRKGLYKFETVEGKKGKGHVQLLGSGAIMRHVREAAQILANDYGVTSDVFSAPSFNELAREGHDAARWNLLHPTETQRVPYVAQVLADLPTVASTDYVKAYADQIRAFVPSKHYHVLGTDGFGRSDSRANLREHFEVDARYVVVAALSQLAKEGTVSNQVVADAIAKFGLNVDRINPLYA

SEQ ID NO: 9978 - protein, 474 aa, Haemophilus influenzae R2866
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRVLGGAIVGSNGGELLGEIGLAIEMGCDAEDIALTIHAHPTLHESVGLAAEVFEGSITDLPNAKAKKK

SEQ ID NO: 9979 - protein, 391 aa, Brassica napus
  misc_feature (84)..(84): Xaa can be any naturally occurring amino acid
MAMAAAVIVPLGILFFISGLVVNLLQAICYVLIRPLSKNTYRKINRVVAETLWLELVWIVDWWAGVKIQVFADNETFNRMGKEXHALAACNHRSDIDWLVGWILAQRSGCLGSALAVMKKSSKFLPVIGWSMWFSEYLFLERNWAKDESTLKSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPEPEDEIAQWCRDQFVAKDALLDKHIAADTFPGQKEQNIGRPIKSLAVVLSWACLLTLGAMKFLHWSNLFSSWKGIALSAFGLGIITLCMQILIRSSQSERSTPAKVAPAKPKDNHQSGPSSQTEVEEKQK

SEQ ID NO: 9980 - protein, 102 aa, Triticum aestivum
SLRNQQRVIYTSPIKALSNQKYREFKEEFSDVGLMTGDVTIEPNASCLVMTTEIWRSMQYKGSEVMREVAWVIFDEVHYMRDRERGVVWEESIVMAPKNSRF

SEQ ID NO: 9981 - protein, 364 aa, Arabidopsis thaliana
MSSIMYHDNHLTDSGKNMSSGLSLLAYVTVMVAEEEEQRSRLLAEKREESKCKMSFFYLFPRKIKSSLAKRRYTQQNPNGASTCSSSLPDLNLIPTDFETDNLQNPCFDEPMVCDEEQRLKKGKSKIVYDEDYDDESEKKLFDNLNGASTSSSSLLNLPCLEPSTETKDVPNPNYQSSSPSSCLTGKTNRKRRAVEQRKSGKVKKVKVSPLPRLCTEMPEWIFQVMRYMNADAETPRLIFERTLFKSDVNSNLSRLLMPFQKLIRNDFLTPAECRAMQKDEDNDEEDDENIGVGTVLVNQRFQKWGLRFKIWAMEKDSGHGTLNYTLNWGWNDVVKSSSLKVGDKISLWTFRCRGVLCFALDTE

SEQ ID NO: 9982 - protein, 352 aa, Nocardia farcinica IFM 10152
MNDLSYAAVPLRWVGPVRITGAVVDDAVEVPLATYESPLWPSVGRGARVTTLTERGVQATVIDDRMTRSVLFEADDAYTALVAVRGLTGRFAELQRVTEASSRYARLLDLHHQIAGNLLFLRFAFSTGDAAGHNMATLAADRLMDHIVATVPGLRHVSVSGNYCTDKKATAVNGILGRGKNVVTEILIPAEVVGQRLHTTARQVVELNIRKNLIGTLLAGGIRSANAHYANMLLAFYLATGQDAANIVEGSQGVTHAEDRGGDLYFSCTLPNLVVGTVGNGKHHGFVEEVLARLGCRDERPDGENARRLAVIAAAAVLCGELSLLAAQTNRGELMRSHTRFERSTTSTGVQP

SEQ ID NO: 9983 - protein, 771 aa, Pseudomonas amyloderamosa
MKCPKILGALLGCAVLAGVPAMPAHAAINSMSLGASYDAQQANITFRVYSSQATRIVLYLYSAGYGVQESATYTLSPAGSGVWAVTVPVSSIKAAGITGAVYYGYRAWGPNWPYASNWGKGSQAGCVSDVDANGDRFNPNKLLLDPYAQEVSQDPLNPSNQNGNVFASAHYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNATYYELTSGNQYFYDNTGIGANFNTYNTVAQNLIVDSVAYWANTMGVDGFRFDLASVLGNSCLNAVHASAPNCPNGGYNFDAADSNVAINRILREFTVRPAAGGTVWICLRNLGPSAATRTSWVDSRRVVRVEWSVPRQLRQAQNELGSMTIYVTQDANDFSGSSNLFQSSGRSPWNSINFIDVHDGMTLKDVYSCNGANNSQASYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIRSARHIPLRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 9984 - protein, 490 aa, Zinnia elegans
MSRKMLIDGDVGSISDEDYDFDLFVIGAGSGGVRASRFSAQYGAKVGICELPFHPVSSETVGGVGGTCVIRGCVPKKILVYGASFGPEIQDAKEYGWQVNENLDFDWKKLLHKKTEEIVRLNGVYKRLLSNAGVKLFEGEGRIVGPNEVEVIQLDGTKLSYTAKHILISTGSRAHRPDIPGQELGITSDEALSLDELPKRVVILGGGYIAVEFASIWRGMGSTVNLCFRKELPLRGFDDEMRALVARNLEGRGVILHPQTNLTKLVKTESGIKVTTDHGEELMADVVLFATGRVPNTKRLNLQAVGVEVDKTGAIKVDEYSRTNVPSIWAIGDVTNRINLTPVALMEGTMFAKTVFGNEPSKPDHSNVPCAVFCIPPLSVVGLSEEQAIQQGTGDILVFTSTFKPMKNTISGRQEKTLMKLIVSAENDKVIGASMCGPDAPEIMQGIAIAIKCGATKAQFDSTVGIHPSAAEEFVTMRSVTRRITASGKR

SEQ ID NO: 9985 - protein, 545 aa, Prochlorococcus marinus str. MIT 9301
MNQVSVININSPFLDQKPGTSGLRKSTLKFQEEHYLEVFIEAILQSLEDLKDSTLVVGGDGRYGNIEAIEKIVQICIAHKVQKVIVPKFGLLSTPATSHLIRKENAIGGIILSASHNPGGIDGDFGVKLNISNGGPAPEIITNKIFKASQLLTSYKICKIQLPDFCQYGTYLYDETTLEIIDGLTDYSNLMEKIFDFDQISDFLKKDYSLIFDAMNAVTGPYAKNIFVEKMGLAPDCVMNGNPLKDFGGLHPDPNLTYASHLADLLLNKKSYSFGAACDGDGDRNMILGSGCFVNPSDSLAVITANTKCVPGYKDGITGVARSMPTSSAVDNVARALNIPCFETPTGWKFFGNLLDSNLITLCGEESFGTGSNHVREKDGLWAVLYWLQVLAEKKCSVSDLMHNHWTQFGRNYYSRHDYEAIPSNIAHQIFGNLTSMLENLKGNSFAGHLVKVADNFSYIDPVDNSISENQGLRLVLDDNSRVIVRLSGTGTKGATLRLYFEKFFDPQQNLSLNPQIALKPLINDLDALLNISKLTQMETPTVIT

SEQ ID NO: 9986 - protein, 122 aa, Bacteroides fragilis YCH46
MNIFIAGISYNLSNADLGELFEEFGEVISAKIVMDRETGRSKGFGFVEMPNDEEGNAAIAALNEKEIDGKTLAVSVARPREEGPRRNSNYGGGNRGGYGNNRGGGYGGGNRGGGYGGGRDRY

SEQ ID NO: 9987 - protein, 399 aa, marine gamma proteobacterium HTCC2080
MTDRQYDIVLFGASGFTGELVAEYLAANVSGIRWAIAGRSASKLEAVRERIGQPDLAILVADSDDAAALTAMADQARVVISTVGPYARYGTTLLEVCAQQGTHYCDLTGEAQWMAEVYERINPIAKNSGARLVHCCGFDSLPSDLSVYFLQKAFKAQFGEYAQSVAGRMGRYSGAVSGGTVASMMLVSEQIMKDEALRKRLMNPYALYPETMEAGPDQPDQMGVAWDENFGSWTGPFIMAAINTKVVRRSNALAGLPYGSDFRYDESQLCKGRFSALTSSIAIGAVMGGALFRPTRALLKRFLPEPGEGPNAETRENGFFEFWAHGVSGADNQNNLRVKVTGKRDPGYGATSRMLAQAGLCLAQDDLSVGGGIWTPATAFPEQLINRLAQVDVHFEVVD

SEQ ID NO: 9988 - protein, 495 aa, marine gamma proteobacterium HTCC2080
MIPETNAKTYKAVSVAIVGGGFGGVGAAIRLLKAGVKDLTVFERSGGVGGVWHANTYPGAACDVPSHLYSFSFAPGTEWSRRYAPQADIERYLNTLVDDFGVRPHLRCNTSVESAEFDAEVGAWHVRTSDGESRNFDLLIAACGQLSNPAIPELEGIDAFEGPTFHSANWDHDCDLTGKRIAVVGTGASAIQFVPEIAKQAGQLDIYQRSAPWIMHKFDREYPEWEKRLFRKVPARVGLSRRFFFSVFEILTYGFTNRHWVLKPMAKLSNAYRRKELGEYPKLLAKATPDYQIGCKRALFTNDWYPTLKRDNVELVHGQAPRVTATGLVDAEGVERPADVIIWGTGFQPLDFVAPMEIRGLEGRELSEVWNGRPEAYLGTTVAGFPNFFMMYGPNTNHGSGSVPYSNECQYNYILDAVERLCAGGYRYLDLEADALKRWRTEMAERSAETVWTQGGCNSWYVTDSGVNTNNWPGPWLEYKRRTQQIDVSDYRFVK

SEQ ID NO: 9989 - protein, 212 aa, Oryza sativa (japonica cultivar-group)
MGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 9990 - protein, 471 aa, Burkholderia thailandensis E264
MSKTVADVMQLAKDEDVKFVDFRFTDTRGKEQHVSVPVSAFGEDKFESGHAFDGSSIAGWKGIEASDMLLMPDPNAAFIDPFYEESTLVLTCDVVEPADGKGYERDPRSLAKRAEAYLKSTGIGDTAYFGPEPEFFIFDSVQWNTDMSGCFVKINSEEAPWSSAKEFEGGNTGHRPGVKGGYFPVAPVDQFQDMRSEMCLLLEQIGIPVEVHHHEVAGQGQNEIGTKFSTLLQRADWTQWSKYIIHNVAHSYGKTATFMPKPVVGDNGSGMHVHQSIWKDGQNLFAGNGYAGLSETALFYIGGIIKHARALNAITNPTTNSYKRLVPHFEAPVKLAYSARNRSASIRIPHVSNPKGRRIETRFPDPMANPYLCFSALMMAGLDGIQNKIHPGEAADKNLYDLPPEEDAKIPTVCAGLDQALEALDKDREFLTRGGVFTDAMIDAYLGLKEQELAKFRMTTHPIEFEMYYSL

SEQ ID NO: 9991 - protein, 335 aa, marine gamma proteobacterium HTCC2080
MTQVKSVVLARRPKGNPVAEDFQVEVSDLPTLRDGELLCHNHFVSLDAGFRNWMNEGSGDAVLPAMELGEPVCGLVLGEVIDSLNPLYAQGDMLMARFAWQTHSISDGSDFIARLPATLEFDPAAYMGVLGDTGMSAYFGMTDILKPSSNDCVLISGAGGAVGSIAGQLAKKSGARVVGLVGSEEKGQWICDVLGYDAAVVRGDADNMAEAIRKVCPEGVDAFFDNVGGEALEAAISNMNHRGRMALCGAVSSYGVPAYGPSNLFEIVTKEIRAEGFMTHFRHDRYEEAREALSEGLRSGALASPEYRLQGIHQIGQAYADLFAGRNFGKTIVEL

SEQ ID NO: 9992 - protein, 238 aa, Oryza sativa (japonica cultivar-group)
VRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILTLAMQPRMLLTVDEDLKPLSVPVRVGQAVDVVGQAGRPKTITGFQTHSTPVLLAAGERAELATEKYLPLTPVLEGFVILRKNPEYHED

SEQ ID NO: 9993 - protein, 297 aa, Campylobacter upsaliensis RM3195
MQEIDKIIQNYLLELAYEPILTMLSKTNTGKKLRSKLLLSIAGESQKAYVLCAIIELIHLASLLHDDIIDESELRRGARSINAEFGAKNALMLGDILYSKAFYELSKQEAKISQILSNAVCKLAIGELMDVNLSKKFNPDKEAYLTMIYHKTAVLIEASARCGALLAKLNENAFAEYGKNLGLAFQIVDDILDITGDEATLGKPALSDFKEGKTTLAYIYLYESLNENDKKILKNLFKKDLNKEERLWLKQKFKEKNIIEQSIKKAKEYGNLSLKAIENDKNEKLEAIIKTLIDRDF

SEQ ID NO: 9994 - protein, 370 aa, Marinobacter sp. ELB17
MIKSRAAVAFAANQPLEIVEVDVAPPQEGEVLVRIVATGVCHTDAYTLSGADPEGLFPTILGHEGGGIVEAVGPGVKNLEVGDHVIPLYTAECGECKFCTSGKTNLCGAVRATQGKGVMPDGTSRFSYKGEPIYHYMGCSTFSEYTVLPEISLAKIPKEAPLDKVCLLGCGVTTGIGAVLNTAKVEEGATVAIFGLGGIGLAAIIGAKMAKAGRIIAVDINPGKFDIAKQLGATDVVNPKDHDKPIQDVIIEMTDGGVDYSFECVGNVQLMRAALECCHKGWGESIIIGVAGAGQEVSTRPFQLVTGRVWKGSAFGGVKGRTELPGYVAKAESGDIPLDVFITHKMPLEDINKAFDLMHEGKSIRTVIHF

SEQ ID NO: 9995 - protein, 291 aa, Haemophilus influenzae R2866
MAENRYELNKNLAQMLKGGVIMDVQNPEQARIAEAAGAAAVMALERIPADIRAVGGVSRMSDPKMIKEIQGAVSIPVMAKVRIGHFVEAQILEAIEIDYIDESEVLSPADNRFHVDKKEFQVPFVCGAKDLGEALRRIAEGASMIRTKGEPGTGDIVQAVRHMRMMNQEIRRIQNLREDELYVAAKDLQVPVELVQYVHNHGKLPVVNFAAGGIATPADAALMMQLGAEGVFVGSGIFKSGDPIKRASAIVKAVTNYRNPQILAQISEDLGEAMVGINENEIQILMAERGK

SEQ ID NO: 9996 - protein, 509 aa, Solibacter usitatus Ellin6076
MAQTRSLPRICIALGLPDVPTLLDHARREAEAGEVFLEFRLDYLSNPCKGAEAIGKFLEEFPECILLATCRRHQNHGKFNGSIEEQLAVLDLAVRNGAHAIDVEIETAEIAQDRLNQFRGRTQVIVSYHNFEATPPMDTVVNRVMKVQADAYKIVSTARKPSDNVRVLAVAKALTKHRVIVLAMGELGFPTRVLSPVFGGVFTYAAPIYAEGTAAGQVSARYLRHLYRVEKLGKSAKIYGVIADPIRHSISPAVHNRAFQSRRVDAVYLPFLVAPACLRDFFSLAAKLPLSGFSVTIPHKQKIIRYLDIVDPLARRIGAVNTVWRKAGKWRGTNTDAAGVTGPLSRLLKISKASVLIVGNGGAARSAACALSDAGAKISLVGRNPDRVRALSKICGAESLLREQLDSRHFDAVVHATPLGMFPHVNECFFEDKIPADIVFDMVYNPLETVLVQRAKEQGKIVVPGLDMFIEQAVRQFEIWTGETAPRPVMLKAALEALNGGAGHAPAPK

SEQ ID NO: 9997 - protein, 312 aa, Zea mays
  misc_feature (117)..(117): Xaa can be any naturally occurring amino acid
  misc_feature (157)..(157): Xaa can be any naturally occurring amino acid
  misc_feature (221)..(221): Xaa can be any naturally occurring amino acid
SWRSCRSTRRRVLEAEQRGGGHGDERPGPVPCPRRSRRRQRATRRRLVPPLNFAMVDDGIFRSGFPETANFRFLKSLNLRSIVYLCPEPYPETNTEFLEKNGIRLHQFGIEGRKGPXANRTGDAQRKVLKVPVDQRSEALLIHCKRGKHRSGCLGGXAEDGANGAFLQAATKAAFAAPKRGTTTEIHGPIDVQAYARTYIVIPRRVLASCPRPAISLLTYXEPFVNIPDDKIREALKVVLDPRNQPLLIHCKRGKHRTGCLVGCLRKLQKWCLSSVFDEYHRFAAAKARITDQRFMELFDVSSLKHLTPSHC

SEQ ID NO: 9998 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLRPMGIAWVFMVFSVICLLSFFFAFYMVPETKGKSLEEIEASLKKRFKKKKSTQNQVLNERTL

SEQ ID NO: 9999 - protein, 173 aa, Burkholderia thailandensis E264
MILIAMGVSGAGKSRIGEMLAQRLSCSYTDGDAFHSAANKEKMHHGIALTDEDRWPWLRSIREAIEARRRAGETAVFTCSSLKRAYRDILRGNDRDVRFVYLKGSFDVLRERLKTRTGHFFDPSLLQSQLDTLEEPGPDEAIEVSIELSPDEIVERVMSELARERQQQQQQQQ

SEQ ID NO: 10000 - protein, 539 aa, Zea mays
MAEVKPEDMVHHLPMDQLQGLEYCIDSNPSWGEGIALGFQHYILSLGTAVMIPTLLVPLMGGNDDDKAKVVQTLLFVTGIKTLLQTLFGTRLPTIMGGSYAYVVPILSIVRDPSFARIADGHTRFLQTMRAVQGSLIVSSSIQIILGYSQLWAICSRFFSPLGMVPVVALVGLGLFERGFPVVGKCVEIGLPMLILFVALSQYLKHVHIRHVPVFERFSLLMCITLVWVYAHILTASGAYKHTALVTQINCRTDRANLISSSQWISIPYPLQWGAPTFSADHAFGMMAAVMVSLIETTRAFKAAARLASATPPPAYVLSRGIGWQGIGTLLDGLFGTGTGSTVSVSMSKSMLNLCLQHSENVGLLGSTRVGSRRVIQISAGFMIFFSILGKFGALFASIPFTIFAAIYCVMFGIVAAVGLSFMQFTNMNSMRNLFIIGVSLFLGLSIPEYFSRYSTSSQQGPAHTKAGWFNDYINTSFSSPPAVALIVAVLLDNTLDVRDAARDRGMPWWARFRTFRGDSRNEEFYTLPFNLNRFFPPT

SEQ ID NO: 10001 - protein, 548 aa, Geobacter metallireducens GS-15
MSDPLIPRTPSAYDYPLLIKNLLFCPVVDNPDQEIVYRDLYRGTYRGLRERVRRLASVLTGLGVKPGDTVAVMDWDSHRYLELFFAVPMIGAVLHTINVRLSPEQILYTIDHAEDDLLLVNSEFLPILEQIRGRLDAVQGYVLLTDEAKAPETAIPFLGEYEALLAAAAPEFEFPDFDENTRATTFYTTGTTGMPKGVYFSHRQLVLHSFGVMTALSTAVGHGTFRRTDVYMPITPMFHVHAWGMPYVASMLGVKQVYPGRYVPDQLLELIEREKVTFSHCVPTILHMLLKHPHAERIDLSGWKVIIGGAAMSRTLCLEALRRGIDVFTGYGMSETCPILSLSHLTPEMLELSPEEQATIRCKTGQALPLVDLRVAGGELRELPRDGVSSGEIVVRAPWLTQGYLKDHKASERLWDGGYLHTGDVAVRDGLGYVRITDRTKDVIKVAGEWVSSLELEDIFAHHPAVAEVAVIGQPDEKWGERPLALVVAKPGEAGRVTEKELVHHVREYADKGVVSKQVVLARVRLVEAIDKTSVGKTNKVALREKYL

SEQ ID NO: 10002 - protein, 557 aa, Magnaporthe grisea 70-15
MPRLAAPPLPVPSHNLLRFLRSQTDGLLSFDAASATTCRTSRVVPSAHGPLGPRALTCKAKTLALPPGRRSFCTSNLRPQRTEGDGSRNFIFDMNKILPRVFRRQRGSTSRGTQEGQYPDEDRPNAYPRATKPTWQEKLGWGGVKSLGSDMGGPGSSDDCGPDNNFTFGSRRAQLMRAPMDPRLRCTEVDENGEVILVDGEYKKSELIAKYGLLPRDLRKIDSSNLPHILVRPSAILINLLHLRVLIKSDRVLLFDVFGSKTSYNQSAFMYDLQGRLRQKQPAGSNAVLPYEFRALEAVLISVTSALEADLLTVREPVVRVLRELEDDINRDRLRILLVLSKKVSTFEQKAKLVRDAIDELLEADDDLAAMYLTEKRHDLYRGVDDHTEVEMLLESYHKICDEVVQEASSLVSSIRNTEEIIRAILDANRNSLMLLDLKFSIGTLGLAMGTFLAGLYGMNLENFIEETNWGFAGVTTFSIFFSLLVCRYGLVKLRKVQRVKMHGTDGGTTSSWFRENVQTIEQGNAPGLGGNMGSIDKFRRIKNKSNNTSSNPGKWI

SEQ ID NO: 10003 - protein, 759 aa, Zea mays
MPDLPCDGDGVCMVCRVASPPEVDLLTCSTCTTPWHSPCLSKPPALADAASWSCPDCSPDSAAVAAPSGPANTLVAAIRAIEADHTLSDQEKARRRQALLTGDAPDGADDDDDEASDDALEIVGKNFSCVFCMKLPERPVTTPCGHNFCLKCFQKWIQNQKRTCGKCRAQIPAKMAEQPRINSALVEVIRMAKISKNPNSAGSAVPYHYLRNDDRPDKAFTTDRAKRAGKANASSGQIFVTIAPDHFGPILAENDPRRNMGVRVGETWEDRLECRQWGAHFPHVAGIAGQSTHGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDDKDGWKWVVPPPVSRKPVLSGDPETDKQIRRATKRVHLSVAERLLKEFACSICRAVIKEPLTTPCAHNFCKTCLLGAYDSQSSIRERSRGGRTLRAQKIVKTCPSCPTDICDFLENPQINREMMELIETLQRKAVEEAKMTSDDAEECGDGDSEENDGDLVKGEDVSGLNEGEQDSADADANVEGSVKIVVEIKEEGKDDKRSKMGATEVVDVLVDEDAVKQTKKRKVDAEAGTNGGKRMKSSSTVEEVAVCVTPVKRSRKSGDMDDERNGSPAVSSGRRVTRSSVDDTGSADSPARRTRSRARADAGC

SEQ ID NO: 10004 - protein, 252 aa, Helianthus annuus
QYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESDFGGKTGTFQNQPSATPVGGVGLNSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10005 - protein, 273 aa, Oryza sativa (japonica cultivar-group)
MAETLDMTLDDIIKNNKKANPSSGRGRRGSAAGGGGGGGGGVGGGGGGGVGPTRRPFKRSGNRAGPYQPPKAPESAWQHDMYSDVAAGGGGGSGGGGRVSAIETGTKLYISNLDFGVSTEDIKELFSELGDLKKYVIHYDRSGRSKGTAEVVFARRGDAVAAVKKYNNVQLDGKPMKIEILGTNTPTAAAALPANNGGYVRNVAKSAPRGGPAGLPQGRPRPRGGGRRRGGGGGSGGPGGSGGRRGKERSQPKSAEELDADLEKYHADAMQTN

SEQ ID NO: 10006 - protein, 746 aa, Magnetospirillum magnetotacticum MS-1
MYSNVVLGVEHHAFEEALEHYKEQKGLNLDTELKADDWKHLIGVYKKIVRDEHGSDFPQKPEDQLWGAIGAVFDSWMIPRAKKYRELNNIPESWGTAVNVQAMVFGNMGDTSATGVAFTRNPSTGESALYGEFLINAQGEDVVAGIRTPQDITEKARIEAKSDKPSMEKAMPESFAELTRIYGILEKHYRDMQDMEFTIERGKLWMLQTRNGKRTAKAALRIAVELAGEGLISKEEAIKRIEPGALDQLLHPTIDPNAERKVIATGLPASPGAAVGEIVFNSEAAEAARKAERRCILVRIETSPEDIHGMHAAEGILTTRGGMTSHAAVVARGMGKPCVSGVGSIRIDYKAQTLTVGGVTLKAGDVITIDGSTGQVIQGEVKMLQPELSGDFAALMEWADAVRTMKVRTNADTPADARAARKFGAEGIGLCRTEHMFFDGDRIVAVREMILADDTEGRRAALAKILPYQRQDFLELFTIMSGLPVTIRLLDPPLHEFLPHTDEEIREVMEATGIAEDKIRNRIRELSEHNPMLGFRGCRLAIAFPEIAEMQARAIFEAAVQAAKDTNAPVTPEVMVPLVFTRMEFDIVKARIDAMAKAVSEETGAQIDYQVGTMIELPRAALKAGEIAETAEFFSFGTNDLTQTALGISRDDAATFLGPYTQKGILPVDPFVSIDQEGVGELVKIGAERGRKTREKLKLGICGEHGGDPASIGFCQEVGLDYVSCSPFRVPIARLAAAQAALGKDA

SEQ ID NO: 10007 - protein, 470 aa, Sulfolobus solfataricus P2
MMSQEVIEVRSPSNLNVIGTVKRMHKDEVRGEIEEAYKGFEIISKMPLYKRTAILRKVSEILEREQERLAKLLAMEAGKPIRDSRVEVLRASRLFRHAAEEVGMVLEGKNYRVDAYEYPPGNENRIVVSTREPIGVVTAILPFNFPINSFAHKVAPALAVGNSVVVKPSINTPLAAIEMKKILVEAGLPDSAVRVVTGYSSEIGDEIITHPLVGLITLTGSTQTGLKIASKAVSLGKRIIMELGGSDPIIILEDANIERASSIAVRARFEYAGQNCNAGKRIIVREEIYDKFVKAFNDKARALKVGDPLDETTDVGPVINKESVENLNSVLADAKAKGGKVEILNKGPESGSFFPLTMVTNPSLDMLVLKSEVFGPIVPIVSVKSDEEAIRIANSTEYGLQSAIFTNDVNRALKLSRELKFGAVIINDSTRLRWDSLAFGGFKKSSIGREGVRETMLEMTENKLIAITLL

SEQ ID NO: 10008 - protein, 204 aa, Oryza sativa (japonica cultivar-group)
MASARPYRFPVPAEGGEPTRRRSAAQSCGTCGASAVASCVALCCCPCAVVGCLTLALVKAPYAAGRRCVARLAAGKRRRMIRPGVATTPRKTNRVWDLDDGQLQEWRPAGADGAVRAERKQDRREPGRTGGAASAAPPGDASVDAISAVGEGSGRARPRVDTAEKTWVEIYQLGHWGFGRLSFSQPQVIRGDTCGNDGVAASRQ

SEQ ID NO: 10009 - protein, 185 aa, Triticum aestivum
  misc_feature (29)..(29): Xaa can be any naturally occurring amino acid
  misc_feature (81)..(81): Xaa can be any naturally occurring amino acid
  misc_feature (130)..(130): Xaa can be any naturally occurring amino acid
  misc_feature (142)..(142): Xaa can be any naturally occurring amino acid
  misc_feature (174)..(174): Xaa can be any naturally occurring amino acid
AYSCSPIYSTWPPPGMASSATTDAPFQGXKYTAGLPVSRRSSGSLGRLSNGGRIRCMQVWAIDGIKKFETLSYLPPLSTQXYLKHVDYLIRSKGVPCLEFTKDGFDLREHNSCPGYYDGRYWTMCKLPMXGCTDATQVLNEXLEDVKKEYPDAYVRVIGFDNLGQVQCVNFIAXRPPRCDESRKV

SEQ ID NO: 10010 - protein, 399 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGHLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDPRAELFQAAKGA

SEQ ID NO: 10011 - protein, 257 aa, Brassica napus
  misc_feature (256)..(256): Xaa can be any naturally occurring amino acid
MSAIIHGAGAATALSTFNSKKLVARSRTNLPGRSKRCIVAAGSDDGSKSFGSSSLSLRHSHKLIANNAVATKADTSATTGHELLLFEALQEGLEEEMDRDPHVCVMGEDVGHYGGSYKVTKGLADKFGDLRVLDTPICENAFTGMGIGAAMTDLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLXH

SEQ ID NO: 10012 - protein, 323 aa, Synechococcus sp. WH 8102
MITVTELLQPVETDLETLLGDLRSLIGAGHPILQAAAEHLFSAGGKRLRPGIVLLLSRALSADGQLTPRHRRLAEITEMIHTASLVHDDVVDEASTRRGVDTVHSRFDARVAVLAGDFLFAQASWHLANLDDLEVVKLLSRVIMDLADGEVKQGLFRFDTAQSFETYLEKSYCKTASLIANSARAAGVLSDCSPSELDGLYRFGRQLGLAFQVVDDILDFTGSDQQLGKPAASDLASGYLTAPTFYAMEEQPGLQALIAREFAEPGDLDQALEMVRSSRAIPRTRELAETFARESRDAISWMSDSPCKRALLELPDFVLSRLY

SEQ ID NO: 10013 - protein, 240 aa, Synechococcus sp. WH 8102
MDWRQQGKIWQLRPSRPLGQVDFIGGSYLAATPQVSYRRLLEDLSNNGLVVNAWAYVPGFDHQSQAREAWTEFRSARKQLEERYGPLPLPLRLGHSLGCKLQLLAPDGGRNSRGLVALSFNNFQADRSIPLLGEIAPRLGVETEFNPSPGETLRLISRHYQQERNLLVRFGRDQLDQSDALLQALEQRPQNRTEVLQLPGDHLTPASAGLRRSVLGDWADDPKRVGVIRQLTEMISSWAS

SEQ ID NO: 10014 - protein, 228 aa, Triticum aestivum
  misc_feature (31)..(31): Xaa can be any naturally occurring amino acid
  misc_feature (108)..(109): Xaa can be any naturally occurring amino acid
  misc_feature (145)..(145): Xaa can be any naturally occurring amino acid
  misc_feature (151)..(151): Xaa can be any naturally occurring amino acid
TRHNTKVDCAATDIGAKRACGFWKIDDVDNXFYTQPFRIKYARQDIYLSLMVSFYIPNSQDEGPATSSVMLKFELLFVPTLGNRIETEDSNDQYLIPVHEFRIPHRAXXGLHTYCPVHFDTFHPVLVDLTIHIVYLKAGVTKSSXEGTQAXQAGSVSKLYDILKALLSSRELLLEEVKRISNGIGTTLEDDGADLTLGKSSVHPTSSFSNYTNGLPVPPKCIAQQFGI

SEQ ID NO: 10015 - protein, 583 aa, Aspergillus nidulans FGSC A4
MEEQYAALASKITSLATSHQKPRYLVAVAGAPGSGKTTLATAVAAQINRSGLLSHKSTNQSDDNSQTNEIAKRALVLSMDGFHLPRSELDTLPNKERTEAYVRRGAPWTFDIPAFLEFMRTLRLWADSGSPSSSSEETAGVLYAPTFSHSTKDPIPNSIVIDHTTSIVIIEGNYLLLDKPQWRDIAPLVDYRVFVDVDLAEARERLAQRHVEAGIEQTLEEGFLRVDRNDAINGALVKGHVVDGVDIVLRKKETNPSFVLRAVKDVAFEDRVIPPLKDPWDVRVQVAQTGICGSDVHYWQRGRIGDFILESPIVLGHESSGIVTEIGSAVKNLKVGQKVAIEPGVPCRHCDYCRSGSYNLCPDTVFAATPPHDGTLQKYYITQADYCYPLPYHMGLEEGAMVEPVAVAVQITKVGNVRPNQTVVVFGCGPIGLLCQAVSKAYACKKVIGVDISQSRLDFAQAFGADGVFLPPPRPEGVEETAWSEKVAALIKEKFGLGEGPDVVLEATGAQSCIQTGVHLVKKGGTYVQAGMGKENVVFPITTACIRDLTIRGSIRYSTGCYPVAVDLIASGKIDVRAGGGGL

SEQ ID NO: 10016 - protein, 564 aa, Arabidopsis thaliana
MESERKLKKMMLSEGVECNTTCNLPFIVLRLGPFSLFSSLVFSLLILISTLNLLNSVSYKCLIVKVYCEDDGIPVWEKRFCEVIGSVPWQKVVEAKDFKSWYNGNVITWDDSACEDTFHNEKKRFWSQVNGLHCDVSIPDPDLYISEVDWDTFVDPELIRDLEKAYFAPPDDVNIGFKRGRGDKNWSGCDTVPEARMLETPWKNSDDIIETGKKSSGWNLTEGSSWEAKPCCVNEKANDTASGGCLTTEEWRENQWIAKDRVNDSWEYSGQGKDDGWDKSGHQNKKVKGSEEYKKIDNPWEAQPSCIKETAKDTTWGGCSGEGWEDRGWNNDSWGSGGWDNRDLGNQGMEMKEWRGKGYSRDFREPKGCNPWKGGFVPDNVAFRESGVNAGGWQTCRGSETKQINWDVKRASDGWGRQNDNAALREYGANAGDWQRRRGCEGNQRNWDAKRTGDGWGRQNKERVDSYGYHSNYKNSWPRRDDYQNRKVNFSTKQCSFSLAIDFHVNSKGMVLCFHFRISICRVYRSTLFDDNVSYILKYSRFLPFEAGLIMIVFFVKMFYSHFS

SEQ ID NO: 10017 - protein, 950 aa, Shewanella sp. MR-7
MRLTRKTDQVVEPKVPALGLNRRQFLKSAGLATGGIAAASMLGTGMMRKAQAQEHIPHNAPTEVKRTICSHCAVGCGIYAEVQNGVWTGQEPAFDHPFNQGGHCAKGAALREHGHGEKRLKYPMKLEGGKWKKISWDQAINEVGDKMTAIRQESGPDSIYFMGSAKFSNEQAYLYRKLAALWGTNNVDHSARICHSTTVAGVANTWGYGAQTNSLNDIRNSKCIMFVGSNPSEAHPVAMQHILVAKERGAKIIVVDPRFTRTAAKSDEYVHIRPGTDIPFIYGLLWHIFENGWEDKEFIKQRVYGMERIRDEVKKYTPEEVENVAGVPKAQMYRIAKMLAETKPGTIVWCMGGTQHHVGNANTRSYCILQLALGNMGVSGGGTNIFRGHDNVQGATDFGLLFDNLPGYYGLTSGAWAHWSGVWDLDPKWVAGRFDQGEYLGQTPQTSTGIPCSRWHDGVLEDKTKIAQKDNIRLAFFWGQSVNTETRGREVREALNKLDTVVVVDPIPTMAGVMHQRKDGVYLLPASTQFETYGSVSATNRSIQWRSKVIEPLFESLPDHVIMYKLAKKLGIEKEFCKHIQVNGEEPLIEDVTREFNKGMWTVGYTGQSPERLKMHQENWGTFDVNSLTAPGGPAKGEVYGLPWPCWGTPEMKHPGTQILYDQSKEVKDGGGNFRARYGVEHNGVNILADGSFSKGSEIQDGYPEFTADMLKQLGWWDDLTEEEKKYAEGKNWKTDISGGIQRVAIKHGCIPFGNAKARCIVWTFPDDIPLHREPLYTPRRDLVAKYPTYEDRMVARLPTLYKSIQDKDFTQGFPLTLTSGRLVEYEGGGEESRSNPWLAELQQEMFIEMNPADAADRGIRDGDNVFVHGPEGAKITVKAMVTPRVVPGECFMPYHFAGIFEGENLAKNYPEGTVPYVQGESANTILTYGYDVVTQMQETKSSLCQVSKA

SEQ ID NO: 10018 - protein, 134 aa, Solanum melongena
PYPRRGRTGRPPTRKDPKSESRIPLILSLDIYVPRDERFGHLKMSDFLTYALKSIVQFILPELHALFDGTPNEFDSFEDVLRLYEGGIKLPQGPLFKALTDALPLEMIRELLRTDGEGILRFPTPLVIKDSKTA

SEQ ID NO: 10019 - protein, 231 aa, Brassica napus
TKIDWKFFGAFLISWLRATNYTCCLFVTDEEESFLLKEEDEASNEEVLPQIMKLKRSQWWIFVSISIFFLISAQAVAVLLGRFYYDQGGNSKWISTLVQTVGFPILYLPLCLRPASPHTSYCSFKTLVWIYLSLGLAIGLNNLLYSYGLLLLSASAYSLICGTQLIFNAVFSYLINSEKITFWTVMSVFFLTVSALVIALDDDSNSPSGGSKWIYGIGCLLTLLASPIYSP

SEQ ID NO: 10020 - protein, 315 aa, Erythrobacter sp. NAP1
MSEFGHDTTADEVLEGKDLSGKTVFITGGNSGLGQETGRAMAAKGAHVILAGRDQGKLDEAVSAIRSEVPDANLETITCDLASLDSVHAAGAEANERFDKIDLLINNAGVMACPKMHTDDGFEMQLGTNHLGHFALTKHLMPLVEAGTDKRIVNLSSRGHHIAPVDFDDPNFESTDYVPFLSYGRSKTANVLFTVGLEKRFGDKGIHSYAVHPGGIQTNLGRHMSEEESAALVERVTENDPGFSWKTIPQGAATQTWAATADELEGKGGLYCEDCNVAEVDDASPNSGVRTYALDPVAADKLWAMSEEMTGVTFA

SEQ ID NO: 10021 - protein, 575 aa, Gibberella zeae PH-1
MALHSRWSQPIPKCSLQQWIFGSSNGPMEDADKSILIDADRPDTHFLTKSQYRLLSKQVALGLIKNGVQPQSRVLVFSANNVYFPSVFLGILMAGGIFTGANPSFTPRELAYQLQNSEATHMFVHAGQLPTALKAAEEVGLKKENIFVLDPSVLPPVGPNPALPAARDDGLRLWTELIADNHEQAKSWQWVEPQDPEDTACCLNYSSGTTGVPKGVEISHFSYVANGSGVVMMSDMEPDPEHRKHAKGLAFLPMYHAYAQTYYVSIYPKVSIPAYIMPSFDFEKMLQHIQRFRVTSLLCVPPILVYLSKHPLVKKYDLSSVNRVSSGAAPLSHEVIHNVEKLWPSGDVTVKQGWGMTEVTCTCMTWDPRHKTDPDKVGELAPNCSAKIMELDGKTQINKPNERGELWVTGPTLMKGYWKNPSATESTISVDEDGTRWLKTGDIAYVDAFKPGGIFHIVDRIKELIKVKGNQVAPAELEAVLLDHPEIADAAVIGIPFEGDEAPRAYIVKAPGSQLTEKQVVDWMESRVARYKRLKGGATFVDMIPKNPSGKILRRALRDKAKAEMDANKAPSSRL

SEQ ID NO: 10022 - protein, 486 aa, Pseudomonas putida
MKEIKHFISGAFVGSASGKLFDNVSPANGQVIGRVHEAGRAEVDAAVKAARAALKGPWGKMTVAERAEILHRVADGITARFDEFLEAECLDTGKPKSLASHIDIPRGAANFKVFADLLKNVANDAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLADDSAVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 10023 - protein, 950 aa, Shewanella sp. MR-7
MKLTRKSDVAQVADKPTLGISRRQFMKQAGITTGGIAAASLMGTGMMRRAEAKDVPHDAPIEVKRTICSACAVGCGLYAEVQNGVWTGQEPAFDHPFNAGGHCAKGAALREHGHGEKRLKYPMKLVDGKWKKISWEDAINEVGDQMLNIRKESGPDSVYFMGSAKFSNEGCYMYRKLAAMWGTNNVDHSARICHSTTVAGVANTWGYGAQTNSFNDIQNANAIFLIGANPAEAHPVSMQHILIAKEKNNAKIIVVDPRFSRTAAHSDLHCAIRPGTDIPFIYGMLWHIFENGWEDKTFIQQRVFEMETIREEAKKFPPKEVANITGVSEEVIYQAAKLMAENRPGTVIWCMGGTQHHVGNANTRAYCILQLALGNMGVSGGGTNIFRGHDNVQGATDLGLLFDNLPGYYGLTSAAWTHWTHVWDLDMEWVKSRFDQNAYLGKDPMTTPGIPCSRWHDGVLEDKSKLAQKDNIRMAFFWGQSVNTETRQREVRDALDKMDTVVVVDPFPTMAGVMHRRKNGVYLLPAATQFETQGSVSNSGRSIQWREQVIQPLFESKTDIEIMYRLAQKLGIAEQYTKRIAKENGLPVIEEITREINRGMWTIGMTGQSPERIKLHTQNWGTFSNKTLEAAGGPAKGETYGLPWPCWGTPEAKHPGTQILYNQSKHVKDGGGNFRARYGVEYNGKNLLAEGSFSKGAEIQDGYPEFTDKLLKQLGWWDDLTAEEKAEAEGRNWKTDLSGGIVRVAIKHGCIPFGNAKARCIVWTFPDQVPVHREPLYTARRDLVAKYPTYDDMQVHRLPTLYKSIQEKDFSGKYPLVLTSGRLVEYEGGGEESRSNPWLAELQQEMFVEINPGDAADRGIRNGEFVWLEGAEGGRIKVQAMVTPRVKPGVTFMPYHFAGVMHGESLAPNYPEGTVPYVIGESANTALTYGYDPVTQMQETKASLCQIVKA

SEQ ID NO: 10024 - protein, 897 aa, Zea mays
MAHPASSGILGCVTLLCIFSSAAAVGSNATGSGQIRLDCGASSSTSTDADGRSWDSDASSKFAPSLNGVAATASSQDPSLPSPTPYMTARVFTSNYTYSFPVTPGRMFVRLYFYPTIYGGNHAPADAYFGVTAANLTLLQSFNASQTSLSLGVAFFVREYSVNVTEGSLDLTFSPSTHHNGSYAFINGIEIVPTPDLFTTPTPTLSNGGNPDPFPILAGTGFETMYRLNVGGQAISPGGDTGFYRSWVNDVPYIYAAGFGVAFGKDDNLTISYTPTVPNYTAPVDVYATARSMGPNAQINLNYNLTWILPVDAGFYYLLRFHFCEIQYPITKVNQRSFFIYINNQTAQQEMDVIAFSGGIGRTVYTDYVTVTAGSGQTYLWVALHPDLTTRPEYFDAILNGLEVFKLQNYGNNSLNGLNPPLPSVQPNNNGNGEPSVRRKGAAPAPAAIAGAVGGFAVLLIAAFGACIVCRRKEVANKESRKPDDGHWTPLTDYSKSRSNTSGKTATTGSRTSTLPSNLCRHFSFGEIQAATKNFDQASLLGKGGFGNVYLGEIDSGTMVAIKRGNPTSEQGVHEFQTEIEMLSKLRHRHLVSLIGYCDDMNELILVYDYMANGTLREHLYNTKRAALSWKKRLEICIGAARGLHYLHTGAKHTIIHRDVKTTNILLDDKLVAKVSDFGLSKTGPNNVDNTHVSTVVKGSFGYLDPEYFRRQQLTEKSDVYSFGVVLLEVLCARPALSPSLPKEQVSLADWALHCQRKGVLGQIIDPHLQGQVSPQCFLKFAETAEKCVADRSVDRPSMADVLWNLEFALQLQGSAEDSGSVVVVTDGTTSSSSNRSSPLIVSGLHSDEPPTDSTTTTTTTSSTTTLSMMGRSLASVESDELTPSSVFSQLMHPGGR

SEQ ID NO: 10025 - protein, 514 aa, Cucumis sativus
MGHPLDHSDAHHRPPSNGVIKVLPPDSDPSLPPPLPKQLPTSSAPPALGRVLARPFSDVRSFYSFRGELGRGQFGVTYLVTHKETKQDFACKSIATRKLIDQDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 10026 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKFLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDEA

SEQ ID NO: 10027 - protein, 1299 aa, Ceratodon purpureus
SSTTSAKSKHSVRVAQTTADAALEAVYEMSGDSGDSFDYSKSVGQSAESVPAGAVTAYLQRMQRGGLIQNFGCMVAVEEPNFCVIAYSENASEFLDLIPQAVPSMGEMDVLGIGTDIRTLFTPSSSAALEKAAATQDISLLNPITVHCRRSGKPLYAIAHRIDIGIVIDFEAVKMIDVPVSAAAGALQSHKLAARAITRLQALPGGDIELLCDTIVEEVRELTGYDRVMAFKFHEDEHGEVVAEIRRMDLEPYMGLHYPATDIPQASRFLLMKNRVRLIADCYASPVKLIQDLDIRQPVSLAGSTLRAPHGCHAQYMGNMGSIASLVMAVIINDNEEYSRGAIQRGRKLWGLVVCQHTSPRTVPFPLRSVCEFLMQVFGMQLNLHVELGAQLREKHILRTQTLLCDMLLRDAPIGIVSQTPNIMDLVKCDGAALYYGKRVWLLGTTPTENQIKEIADWLLEHHNDSTGLSTDSLADANYPGAHLLGDAVCGMAAAKITAKDFLFWFRSHTATEVKWGGAKHDPDEKDDGRKMHPRSSFKAFLEVVNKRSPPWEDVEMDAIHSLQLILRGSFRDIADSDTKTMIHARLNDLKLQGVEERNALANEMSRVLETAAAPILAVDSRGMINAWNAKIAQVTGLPVEEAMHCSLTKDLVLDESVVVVERLLSLALQGEEEQNVEIKLKTFGTQTTERAVILIVNACCSRDASDTVVGVFFVGQDVTEQRMFMDRFTRIQGGEKTTVQDPHPLMRPSFDGDEFGRTFKRNSALGGLKDHATGSVERLDLYLRRAEECMEVMETIPSPKFNNKQCQYLAGKLKAVLQSASLFLRISHHEHHELGASIDMGRHVEIFKLLLALAKEIESFIQGCCKDEWIKAAMTLTNVSEYVSSMGFNLELCKIAFCKSCAASGSLTLDQIEVICKDEAEVVKRNATIDVDTLFAKVIYDLTEKTLSSDQNDLAIYLLQRLKRAKPILPSFSSRPSWWNFYDDWSFSEKFFQWIQITGSLGSGSSATVEKAVWLGTPVAKKTFYGRDNEDFKREVEILAELCHPNITSMFCSPLYRRKCSIIMELMDGDLLALMQRRLDGNEDHDSPPFSTLEVVDIILQTGEGMNYLHEKGIIHRDLKSMNILVKSVKVTKSEIGYVHVKVADFGLSKTKDSSTRYSNQTWNRGTNRWMAPEVINLGYESTEGEISFDGKVPKYPLKSDVYSFGMVCYEVLTGDVPFPEEKNPNNVKRMVLEGVRPDLPAHCPIELKALITDCWNQDPLKRPSFAVICQKLKYLKYLLMTGFSSYQDSYPSTEELS

SEQ ID NO: 10028 - protein, 344 aa, Sulfolobus solfataricus P2
MKAVRIHEYNKPLSLDEVNKPRVSGPYDIVVRIRGAGVCRTDLHIIEGVWKDVLNPKLPFTIGHENVGIIEEKGNAVDWLDVGDQVILHPYITCRHCRACRSGNDMHCPYGKFPGLDGTDGGYAEYLRTSAFSAIKIPKGIDIIPMAPLADAGITAYHAVKKISQYLYPGSIVGVIGVGGLGHIGIQALKAITPARVIAIDISEEKTKLAKELGADEVVIAGKDSGVSDVLKLTDNIGVDAIIDFVGEHSTPQNALRMIRKGGIYSIVGYGGEFKNSTLDFINREIMVVGNLVGTYNELSELVTLYVQNKVKLKVKTFPLEEANSALEELKAGRILGRAVLVPS

SEQ ID NO: 10029 - protein, 500 aa, Atriplex prostrata
MAFPMPVRQLFIDGERREPLLKNRIPIINPSTEEIIGDIPAATAEDVEVAVVAARKAFKRNKGRDWAATSGAHRAKHLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 10030 - protein, 150 aa, Symbiobacterium thermophilum IAM 14863
MERSFVMVKPDGVQRGLIGEVISRLERRGLKLVAAKLMRVSRELAEEHYAQLKDKPFFPSLIEFITSGPVMAMVWEGPNAISIIRKTMGATNPANAEPGTIRADFACDVSYNVVHGSDGPESAEREIRLWFGEVEPSYSRSVDRWIFPEG

SEQ ID NO: 10031 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPNTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLFETWERSTSLLVTGRVDLSSLVSHRLPLSAAEDAFEMALNGQSLKILFEPNGTCI

SEQ ID NO: 10032 - protein, 391 aa, Thermobifida fusca YX
MSEPLVARMAAFGETIFAEMTRLAEHTGAINLGQGFPDTDGPPFLLAEAARYLTEGVNQYPPGYGREELRTAIAADRQERYGLAYDPATEVYITVGATAGIAASILALVEPGDEVVLFEPMYDSYSAVIALAHGVRRPVTLRPSPDNGRYTFDPDELAAAITPRTRAIIVNTPHNPTGTVFTADELAWIARLCRENDLVAVTDEVYEHLTFDGTPHLPLAALPGMAERTLSVSSAGKTFSVTGWKIGWVTGPEPLVRAVATVNQYLTFTANGAQQLAVATALRHGMDWVSEQRDALHAKRDRLVAGLAAAGFQVHPPQGTYFVMADIRPLGYDDGLTFVRTLARRAGVVAIPAQVFYADERHGRHLVRFAFCKRDDVLDEAAARLRAWGDR

SEQ ID NO: 10033 - protein, 339 aa, Zea mays
VGPPVPRCFSAAITGPPLARRSQATPPPPPPPHQATTISYCCRLPAPRLPPGSRNPSPPLLPSSSHLHCAASFVRLPASSVLGSRGRAMKLRTKRPEWKSLMPLQLSRLSRKSAMRFFLFPKVQSAGQSPDDTPVYLNVYDLTPMNGYIYWAGLGIFHSGVEVHGVEYAFGAHDFPTSGVFEVEPRQCPGFRFRKSIFLGTTCLDPIQVRQFMELQSVNYNGDTYHLITKNCNHFCKDMCYKLTGNKIPKWVNRLARIGVICNCLLPESLKISPVGHGPNSQSDDSEKRRLRNPFSCFSSISSHRQLPSSSPFPPSPVKEGTGHPPLLIEETQHGVSEM

SEQ ID NO: 10034 - protein, 488 aa, Photorhabdus luminescens
MTIINHWINGKNVSSKTYFETTNPATGEVLAEVAAGGQEEIDQAVAAAKEAFPKWADLPMKERARLMRRLGELIDENVPEIAAMETKDTGLPIHQTQNVLIPRASHNFNFFAEICQQMNGHTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTVTGRQIMKNAGLKKYSMELGGKSPVLIFEDADIERALDASLFTIFSINGERCTAGSRIFIQQSIYPEFIKRFAERANRLRVGDPQDPNTQIGALISKPHWEKVSGYIRLGIEEGATLLAGGPDKPIDLPAHLKEGNFLRPTVLADVDNRMRVAQEEIFGPVACLLPFKDEAEGLRLANDVEYGLASYIWTQDVSKVLRLARNIEAGMVFVNTQNVRDLRQPFGGVKASGTGREGGEYSFEVFAEMKNVCISMGDHHIPRWGI

SEQ ID NO: 10035 - protein, 457 aa, Oryza sativa (japonica cultivar-group)
MADHQPAASSPKRKKKHSKKPEDSNATVDDSLAAAASPSPKKKEKHSKKKREAIDATMAAASPKKKEKKHSKKQEDTNVPEKKREVVHVTVDASLTGAAAAGAAPVVAYFPTGYDPLGRRRRQEGYAGEAVLPQLTGYALGVLDKASGTLKVVPIAANKILRLDPHLEVQKLAHSQHSGAVGEAVSSAGDADLKVQDITKAFGTQKDKAKDIKWQSLNEQRNDPSAFMDLDLGNADTSVGANESQEPTVRNIPPYDPAADTSERAYLFDEIIPKSIRPHLVDIIGHFESGEISSKGYGSFVSNRVNKLQELQGEDKERLAWILSYITHLLSLLARNSSMSKRHRKENQATSGPVIPQYVYRKMVLMFTEPGSSALSTEKHELLINYILVLTLYADDFRSDPKDICEDLKMTRQMIKPYYDQLGCKSSSAGAFKSSVMTLPAPLKFPKEATRRKRRRF

SEQ ID NO: 10036 - protein, 329 aa, Arabidopsis thaliana [sequence omitted]

SEQ ID NO: 10037 - protein, 142 aa, Prochlorococcus marinus str. MIT 9301
MTNEINPIEEDFNAALSRYKAGQDLIPIVQDFQKIIQQIPNHFAAWTCLSWLQLLLKNNEEALSAARQAVRLNQQDPQARMNLSLALLATNNKGVRDHIELIKKMSMMMPDVKSELKESVEDGLSRYPDWPELTKVKKWLEF

SEQ ID NO: 10038 - protein, 490 aa, Photorhabdus luminescens
MTNDVNTELLRQQAYINGQWVDADNQATFKVTNPANGQVIAHVSNMGAAETERAIAAAQQALPAWRAMTAKQRSQILQRWFQLMMANQQALAELLSREQGKSQAEAMGEIAYGASFIEWFAEEGKRTYGETIPSPMPGRRIVTIKQPIGVVAAITPWNFPNAMITRKVGPALAAGCTVILKPASETPLSALALAALAEQAGIPAGVFNVVTGVDAKTIGGVLTQSPIVRKLSFTGSTRIGKLLMAQSADTVKKLSLELGGNAPFIVFDDANIDAAVQGALIAKFRNSGQTCVCANRILVQETIYDAFAERLAQAVNKLQVGPASDAKSQQGPLINQAAVDKVEEHINDAVSRGARILAGGKPHALGGLFFEPTVLADVNESMLISQEETFGPVAPLFKFRDEAEAIHLANDTEFGLAAYFYSRDIGRIYRVAEALESGMVGINEGLISNEVAPFGGIKQSGLGREGSRYGIEDYLEVKYLCFGGIEDTGV

SEQ ID NO: 10039 - protein, 539 aa, Glycine max
MDSNSSSPNNNNNHHASTTKTNGFLIHPKLGFEPARSRSRLAMASPANTSEPKIVTGTAGYILEDVPHFTDYIPNLPTYPNPLQDNPAYSVVKQYFVHVDDSVPQKVVVHKDGARGVHFRRAGPRQKVYFEADEVQAAIVTCGGLCPGLNTVIRELVCGLHHMYGVKKVLGINGGYRGFYARNTITLTPKSVNDIHKRGGTVLGTSRGGHDTKKIVDSIQDRGINQVYIIGGDGTQKGASAIFEEVRKRGLKVSVVGIPKTIDNDIPVIDKSFGFDTAVEEAQRAINAAHVEAESVENGIGVVKLMGRNSGFIAMYATLASRDVDCCLIPESPFYLEGPGGLYEYIEKRLKENGHMVIVIAEGAGQELVSESVQSMSKQDASGNKLFQDVGLWISQKIRDHFAAQKTLPITLKYIDPTYMIRAIPSNASDNVYCTLLAQSAVHGAMAGYTGYTSGLVNGRQTYIPFYRITERQNHVVITDRMWARLLSSTNQPSFLDAKGDNEEKEEEEALNQLPDGHCAKDTSLASKEINSSIYPTAC

SEQ ID NO: 10040 - protein, 531 aa, Streptomyces coelicolor A3(2)
MGRRLTVQGWFHVVLALMVLMVVGGSVVGARLLEETSDVTDRLADRLQPAQTETYRLQAGLINQETGARGYAIAGDRQFLAPYTQGKAEEARAAARLRELIGDQPRLLADLEAVERQAADWRRTYAEPLVADVSSGESRKSVRATVERGKKVFDEIRDAWETQNADLAEAVADGKEDLAGARTERNVILGAMVAVFLLAGGILAVLVKVLVARPVKALSRASRRVSGGDFDHVILGGGPADLAAVADAVEGMRQRIVAELDASYRQQEVLTRQTADLDAQAVELRRSNAELEQFAYVASHDLQEPLRKVASFCQLLEKRYGDKLDDRGRQYIDFAVDGAKRMQVLINDLLTFSRVGRLNDARVEVDLDQVLTKALANLDTAITETGAHVERPERLPKVVGDPMLLGMVWQNLVGNAVKFRHPDRTPNVGITCEEDADSPGTWRLCVTDNGIGIPEEFAEKVFVIFQRLHGRDAYGGTGIGLALCKKIVEHHGGHIRLDTGHTGGTRICFTLPSGDGTADGTDSHTEDKTLS

SEQ ID NO: 10041 - protein, 478 aa, Burkholderia vietnamiensis G4
MKIYDQFYIDGAWCKPAGAGTIDVIDSATEAVLGRIPEGAATDARHAVRAAHAAFDAWAATPPATRAGYLRRIVERLQTRSEELAQSITGEVGMPIKLSRAIQVGAPVYNWKVYAKLAESFEFEAKVGNSLVVREPVGVVAAITPWNYPLNQITLKVAPALAAGCTVVLKPSEVAPLNAFMLAEAIHEAGLPAGVFNLVCGYGPVVGEVLATDPEVDMVSFTGSTRAGKRVAELAAATVKRVALELGGKSAAVILDDADFPAAVKGTVNACFLNAGQTCSAHTRMLVPHARYDDARALAKAAAEAYLAGDPRQETTRLGALASAVQQQRVQAYIQRGIDDGAELVTGGTGLPDGLTKGFFVKPTVFGRVDPTSAIAQEEIFGPVLSIITYRDEDEAVRIANDTPYGLGGAVWAGSDERALRVARRLRTGQVDINGGSWNSAAPFGGYKQSGYGRENGVYGLEEYLEYKSMQLRPANPS

SEQ ID NO: 10042 - protein, 458 aa, Yarrowia lipolytica CLIB122
MNYPAEPEFQQAYDELYNSIHDSTLFDKHPEFEKVIPVVSVPERIIQFRVVWEDDQGKLQVNRGYRVQFNSALGPYKGGLRFHPSVNLSILKFLGYEQIFKNALTGLNIGGGKGGADFDPKGKSDAEIRRFCYAFMGELHRHIGADTDVPAGDIGVGGREVGFLFGAYKKYKNTWEGVLTGKGLTWGGSLIRPEATGFGLVYYVEKMIEYATSGKESFKGKRVAISGSGNVAQYAALKVIELGGNVVSMSDSKGALVLVSDFTEGFTPAEIEQIADIKLQHKELASLYPSATLPETKFKYIEDARPWCHVGKVDVALPCATQNEVSGEEAKSLVAAGCKFIAEGSNMGCESDAIEVFEAERMARPNGIWYGPGKAANAGGVAVSGLEMAQNSQRISWTKEEVDQKLKDIMVDCFNTCVETASTYSSEKVDGLPSLVKGANIAGFLKVSAAMKDHGDFW

SEQ ID NO: 10043 - protein, 221 aa, Debaryomyces hansenii CBS767
MISNKKIRLVAISALLILFIILFFRTSSESEIRPETLNNDSKAQTLLTANNLIDSKNDDKVDAAINNEISKLNNDESEQDTSSEKAQEDQSEKTEEGFDAAKALLEIRAMSPMVIFSKTYCPYSKRLKQLLRDNYQITPEPTIMELDKHGYGQNLQEYLEETTGRGTVPNVLVGTSLESRGGFDDIKKLHDEGKLLTLLVEWGSTDSKKLDVKKIEAPSNS

SEQ ID NO: 10044 - protein, 329 aa, Candidatus Kuenenia stuttgartiensis
MLNGLTEKQPLSDIDYAKKVLLLESEAIKNQIHRIDNHFQKAVDIIFTCSGRVAVTGVGKAGIIGQKISATLASTGTPSYWIHSSEARHGDLGKIVASDIVLALSNSGETEVVLLLPFLKQMGTKIISVTGNNKSSLALHSDVVLDIGNVEEACPLGIAPSSSTTAMLAIGDAIALTIFKKRNLSKEEYAFYHPGGELGRKLLPVEVVMRKGRENPVADEDMPLLDVLGIMTETKGNPGAVSIVDKNNRLTGFFTDGDLRRLLREGTSFLCKTIKEVMTPFPKVINNRCLVEEAYKILRENKIDQIPVVNDFHTPVGIFDVQDLLEVRF

SEQ ID NO: 10045 - protein, 201 aa, Triticum aestivum
MSIAPESEFVIPNQSTINLGVQLKEKDDLQLVEIPVPKPEKDHVQVQLKCVGICGSDIHLWKYGEIGIFPVTQPQLLGHEGAGIVTAVGENVTSLRVGDRVAIEAGIPCSFCDQCMSGRYHLCPDVIFKSTPPYDGILAKYITHPARWLHKIPASISFEEGALLEPLSVAIAAVDRVRAKFGKSLLITGCGPVGLLILAGA

SEQ ID NO: 10046 - protein, 136 aa, Mycobacterium avium 104
MTERTLVLIKPDGVQRQLVGEIIGRIERKGLTLVALELRHVSQDLAAQHYAEHEGKPFFASLLEFITSGPVVAAIVEGPRAIAAFRQLAGGTDPVEKAIPGTIRGDFGLETQFNLVHGSDSVESAKREIALWFPDA

SEQ ID NO: 10047 - protein, 492 aa, Campylobacter upsaliensis RM3195
MKQKCILIITDGIGYNPNTAFNAFNAAKKPTYDKLFKEVPNSLLKTSGLAVGLPEGQMGNSEVGHMCIGSGRIIYQNLVKINQAIEKNMLKNNANLKALLQKCKRVHIIGLYSDGGVHSLHTHFNALLTICKDEGKEVFAHAISDGRDVSPKSGLKLIRDLESFCEAKKIHFASLAGRFYAMDRDKRWERVEAYYKALLGEAKGVKKMSAYVEENYQKNIFDEFIEPVISEEFEGLNEEDGLIFINFRNDRMKQLVELLSAENFTPLKQKKRFEKLLTMSVYDDKFNIPVLFEKEELQNTLTEVISNAGLSQLHTAETEKYAHVTFFFNGGKEDLLENETRVLIPSPKIKTYDEKPQMSAFEVCEVVKEGIKKGEDFIVVNFANGDMVGHTGDFNAAVSAVEAVDTCLGEIIKEARRQNYAFIITSDHGNCEAMQDEKGNLLTNHTTFNVFVFIEAQICKQIKPNMGLSNVAASVLKILNLEIPKEMNEALF

SEQ ID NO: 10048 - protein, 297 aa, Agrobacterium tumefaciens str. C58
MTKKAFVAIVTCFNDDETINYEATRAQVRRQVTAGNNIMCAGTNGDFTALTHSEKIRILEEVVDEVGGKVDVIVNAGMPATFETLQLAKEFDRIGVKGIAVITPFFIACTQDGLIRHFSTVADEVNTPVYLYDIPARTQNHIEPETARKLATHGNIAGIKDSGGAQETLEAYLQVSKEVDGFEVYSGPDHLVLWALQNGAAGCISGLGNAMPDVLAGIVNGFNSGDITYAERQQSVYTAFRTDLYAHGFPPAMVKRALYLQDPSVGASRQPALLPDAEQDQKIEEILRKYGLLVTKA

SEQ ID NO: 10049 - protein, 304 aa, Shewanella oneidensis MR-1
MSERYLENGIRQLVSEFIAAGCPSVREQSLEERRQGYIASTVLAGEPEAVFEVKSVSLEGIELTLFKPSADNNLPVVIYYHGGCFVSGGIATHNQQLRKIANDSGALVVAVSYRLAPEHVYPAAHDDAFNAANLVQQHCHQWGGDNTNITLMGDSAGGHLALVTCLRLKAKGEWLPKKQVLIYPMLDATAKSQSYIDNGDKYIITRDTLLTGFDMYLDWHPRTDVEASPLRSHDLAGLPETHIITAEFDPLLDEGEQLFRHLLAAGVDAHCRRYLGVIHGFFQLAGVSQSARDAMAQVTHIIRA

SEQ ID NO: 10050 - protein, 211 aa, Glycine max
MVAVVSQENVAALVSRTGRELQRYRKGRRQVVGCIPYRFKIGEKTSLDVVSDELEVLVISSQKGKGMLFPKGGWELDESKKEAALRETMEEAGVRGIVGGKLGKWSFKSKTHDTFYEGYMFPLLVQEQLEFWPEQNVRQRIWMSVTEAREVCQHWWMKEALDRLVNRLSGQKQLGHYRDNKRVLGSMNCKGDAKSASVNSVASLEGRAQLF

SEQ ID NO: 10051 - protein, 248 aa, Photorhabdus luminescens
MQKITLITGGSRGIGRATAFYLAEKGHHIGIGYHTNQDQALEVIEIIRRIGGKAIAIQVDVADEKQVVELFQRTDAELGCITGLVNNAGILKPQTSIEQLTAHRLHDIFATNVIGSFLCAREAVKRMSFRHGGHGGSIVNVSSAASRLGSPHEYIDYAASKGAIDTLTIGLSLEVADQGIRVNAVRPGFIYTNMHSDGGEPNRVDRVKNSLPMKRGGQPKEVAQAISWLLSDEASYVTGNFIDLAGGK

SEQ ID NO: 10052 - protein, 181 aa, Brassica napus
VEMTLSLVKSMINSPKLRLSTAPLGFSRCNRWCVSLPNMSSKSIPFASLTISASSGKKEVVATEKAPAALGPYSQAIKANNLVFLSGVLGLILETGKFVSDSVEDQTEQVLKNMGEILKASGVDYSSVVKTTIMLADLGDFKKVNDIYAKYFPAPSPARSTYQVAALPLNAKIEIECIATL

SEQ ID NO: 10053 - protein, 141 aa, Arabidopsis thaliana
  misc_feature (42)..(42): Xaa can be any naturally occurring amino acid
PSVRGKEEEITRRGKCASYMHSSAVVVTSPTQATMVAPFTGXKSSAAFPVTRMTNKDIASIAIIGGRVSRTKGRPPNEKNKEETVSYLPDLSDAELTKEVDYLVRNKWIPCVEYELEHGSVSREHGNTPGYYEGRNWTMGK

SEQ ID NO: 10054 - protein, 303 aa, Shewanella oneidensis MR-1
MSHILVIGSANADHVMNFEYLPVPGQTLKSRSYRLEHGGKGANQAVACARLCLPDSRVDFICHLGQDSIGNEMRDSWLKDGIQAEGITLVDNVSTGTAMIFVADNGENAIGIAAGANAHLTPLELEKHYALFANAQYLLIQLETPTETVSNALQMAKRLGITTVLNPAPAATQELDYLKWVDIITPNETEAEALTGIEVKHEEDAKLAAQWLHQQGITTVVITLGSKGAFISSPGFTGLIPALTVQAIDTVAAGDTFNGALVVGLSEGMSIAAAVSFANAASAITVTREGAQRAIPYRSEVSR

SEQ ID NO: 10055 - protein, 573 aa, Debaryomyces hansenii CBS767
MSTIPNNRDDIVLIDSEPELENEPPRSSEEDAPPRKKFKNSENNEARGPLVKPFMNSTSGSDNKVSGADSLSDDKSAESSYNLGSSNDSDSESNLSSLSDGHSGSDYIHSLSADSRLSSKKPDTEMDGSRVISSDLEDTSAGTSSSDLNPIPTHVPPAGENEEIEATREVISDTRKYLKKHGTMEFLDKYLPTTASSLDLLQLIKKLGFFPKDIPPFNDGDRLIGLIKLLHTAMKKVNSMRSKLDDFYCVEHVVDQIKKAKKILVVTGAGISTSLGIPDFRSSKGFYSQLQYLGLSDPQEVFDLDFFHSDPNIFYLIAYMILPPEKSYTPLHAFIKLLQNKGKLLRNYTQNIDNLESNVGIKPEKLIQCHGSFATASCVTCKYQVKGEKIYPKIREKEVPYCPKCKNARKILLNKEDAYVPESYGVMKPDITFFGEPLPTRFHNMIRQDLMECDLLISIGTSLKVSPVADIVERIPEHIPQVLINKDPIDHCNFDVSILGYCDDTANYLCKRLGKGWELDHPEGVEAYNQEQFKIVTLNENEGQYSLVNFKPDLYETLEEQHQAKIKEREQGK

SEQ ID NO: 10056 - protein, 486 aa, Pseudomonas putida
MKEIKHFINGEYVESASGKLFDNVNPANGQVIAKIHEAGEAEVDAAVKAARAALKGPWGRMTVAERTEILHRVAAGISARFDEFLEAECLDTGKPKSLASHIDIPRGAANFSVFADLVKNVPTEAFEMATPDGTGALNYGVRRPKGVIGVISPWNLPLLLMTWKVGPALACGNTVVVKPSEETPTTTALLGEVMNAAGVPAGVYNVVHGFGGNSAGAFLTAHPDVDAYTFTGETGTGETIMRAAAKGVRQVSLELGGKNAGIVFADCDLDKAIEGTLRSAFANCGQVCLGTERVYVERSIFDEFVARLKAGAEALVIGPPDDASSNFGPLVSLKHREKVLSYYQQAVDDGATVVTGGGVPEMPAHLAGGAWVQPTIWTGLADNSVVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 10057 - protein, 261 aa, Oryza alta
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINATIQAFECVHDGWGVAVLVGVPHKDAEFKTHPMNFLNERTLKGTFFGNYKPRTDLPNVVELYMKK

SEQ ID NO: 10058 - protein, 441 aa, Candidatus Kuenenia stuttgartiensis
MAVINRAKDDKVKLVQLQFTDINGSVKAVTIPIEKFPESLEKGLWFDGSSIEGFTRICESDMFLKPDAGTYALLPWETVAVTARLFCDVYMPDGSPFEGDPRYILKRAIKNARDMNFEYNVGPELEFFLFKPKNDGAVAPTPHDVGSYFDFSPRDLAGNVRADIIFTLEKMGINVEMSHHEVAPGQHEIDFKYAEALRTAENALTFKQVVKSIAHKHDLYATFMPKPIFGICGSGMHCHQSLFDIRTNTNIFFDENDTYKLSRNAKHFIAGQLEHVRAMSAILSPTVNSYKRLVPGYEAPVYICWGQKNRSALIRVPRYSPGREQATRAELRCPDPSNNPYLALAVMLEAGLDGIKRKLELPKATEENVYEFNKDELAYRNIATLPGSLGEALHELKQSALMKRALGSHTYQIYLHSKFSEWDEYRIQVTEWEQKKYLETT

SEQ ID NO: 10059 - protein, 481 aa, Streptomyces avermitilis MA-4680
MAATHAFWLAGRQATGETTFDVTSPWDGRLVGKVSVPTEAQTEEAVAAAYAVRDEFAATPAHVRAAALDHVSKRLVERTEEIAQLISAENGKPIKWARGEVGRAVSVFRFAAEEARRFNGGEAQRLDTDAGGQGRLALTRRFPKGVVLGIAPFNFPLNLCAHKVAPAIAAGAPIILKPAPATPLSGLVIGDLLAETDLPAGSWSILPVSNDRMPALVQDERLPVISFTGSEKVGYAIMDSVPRKHCTLELGGNGAAVVLADYASDADLDWAAGRIATFSNYQGGQSCISVQRVIADASVYERLLPRVVAAVEAQVTGDPSDDATEVGPLVSEDAAKRVESWVDEAAQAGARVLTGGKREGASYAPTVLVDVPADVTLSCEEVFGPVLTVQKVEGEAAAFAAVNESKYGLQAGVFTHDLQAAFRAHRALEVGGVVIGDVPSYRADQMPYGGVKQSGVGREGVKFAMDDYTYERVLVLTGLAL

SEQ ID NO: 10060 - protein, 261 aa, Oryza alta
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 10061 - protein, 327 aa, Synechococcus sp. WH 8102
MAGTLLFNALREAIDEEMARDPYVCVMGEDVGHYGGSYKVTKDLCEKYGDLRVLDTPIAENGFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPEGEFTCALDQADLVQEGSDVTILTYSRMRHHCLKAVEQLEADGISVELIDLISLKPFDMETIGRSIRKTHRVIVVEECMKTGGIGAELIALITEQCFDDLDARPVRLSSQDIPTPYNGSLENLTIIQPHQIVEAAQQMVRQGV

SEQ ID NO: 10062 - protein, 444 aa, Streptomyces avermitilis MA-4680
MSALPQERRVVTAIPGPKSQELQARRTAVVAAGVGSVLPVFTTRAGGGIIEDVDGNRLIDFGSGIAVTSVGASAEAVVRRASAQLQDFTHTCFMVTPYEGYVAVAEALAELTPGDHAKKSALFNSGAEAVENAVKIARAYTKRQAVVVFDHGYHGRTNLTMALTAKNMPYKNGFGPFAPEVYRVPVAYGYRWLTGPENAGAEASAQAIDMINKQIGADNVAAIIIEPVLGEGGFIEPAKGFLPAISKFAKDNGIVFVADEIQSGFCRTGQWFACEDEGIVPDLITTAKGIAGGLPLAAVTGRAEIMDAAHAGGLGGTYGGNPVACAGALGAIETMKELDLNAKAKNIEAVMKARLGAMAEKFDIIGDVRGRGGMIAIELVKDRDTKEPNPEAAGALAKACHQEGLLVLTCGTYGNVLRFLPPLVIGEDLLNEGLDIIEQAFSRI

SEQ ID NO: 10063 - protein, 309 aa, Bacillus clausii KSM-K16
MLCRSNDELELLISQARAFAGQGEVAQYIPALAAAHKHELSVALYYPDGKGFMAGDTEENFTLQSISKVLSLALALIDQGEECVFTRVGKEPTGDPFNSIAKLETNKPSKPLNPMINAGALAVTHMIKGNTAGERFERLLDFIRCLTGNETITYNKEIAKSEFETAHLNRALVYFMKEHGVIDEDVEELMDLYTKQCAIEMNCIDLARVGCVLAMDGCDPDTGKQLLPIDVARICKTFMVTCGMYNASGEFAINVGIPAKSGVSGGIMGAVPKKCGIGICGPSLDEKGNSIAGIKLLEMMAKRYSLSMF

SEQ ID NO: 10064 - protein, 396 aa, Agrobacterium tumefaciens str. C58
MTPEQIATVMTGKVEAAGKGRHEAVLASPMIQNHAPFLHLADDGALICAWFGGTLEGKSDISIFTSVLAAGSNKWGEPQRLSFDPDHSEQNPVLFAAPGNTLLLFHTSQPSGNQDECRIRMAEVSRDASDPTRLTAGEGLYLDLPRGCFVRAPLTVRADGAWLLPIFRCIQRPGQKWNGSHDRAAVGISEDCGKSWRLEDIDQSTGCVHMSPLVIGDEKLAAVFRRRQADFVYRTESADGGRTWSAPQATDVPNNNSSIAAIRLNDGRIAMICNPTNAAMSSDRRASLYDELGEDDDRPDANPDGGCVPIWGVPRAPVTVCISEDGAKSFPQRITIEDGPGTCLSNNSIDGHNKEMSYPWLLEGADGSLHIAYTYYRRAIKYVRLAPGWARAADGR

SEQ ID NO: 10065 - protein, 308 aa, Mycobacterium avium 104
MADRLPDDAFTAPQVVDPGLRKVARFLPRGYALHRGLKLQRAIMNLMGNAGRLRTVPVVAVNEHVTVRLHRPPNLAEHAPALLWTHGGGTVMGHAAQDDKYLRKLSHRTGVAIAAVEHRLAPEHPYPAPVEDCYAALLWLARQPWVDPERVAVGGASAGGLFAATLAQRAHDRNDVKIAFQMLVYPMLDDRTGAQRDGPRRLMWTESDNQLAWQWYLNGADPDEAAPARRKDLSGLPPAWIGVGTLDLFYPECLEYARRLREAGVPVQEEIVPGAFHAFDQIVDKAPISAKFFESQCDFLRGALAPNG

SEQ ID NO: 10066 - protein, 601 aa, Thermomyces lanuginosus
MANVASPTANGNGGKKRRKGDLKPIVTGEGFSLAESGGSSLNPGASVASPLSHQKPVYESPSRSLSSSSEDDLEAAADEEDSEDYCKGGYHPVQIGETYNNGRYVVIRKLGWGHFSTVWLSRDTVTGKHVALKVVRSAAHYTETAIDEIKLLNRIVQAKPDHPGRKHVVSLLDSFEHKGPNGVHVCMVFEVLGENLLGLIKRWNHRGIPMPLVKQITKQVLLGLDYLHRECGIIHTDLKPENVLIEVGDVEQIVKTYVKEEPKKEEKDNRNGRRRRRTLITGSQPLPSPLNASFGHTDKYGSHNSLNHMVNDGGGKDSLNVPEDERQQREKTADLLEREVSGISLDKKTEPQKQQTDIISVKIADLGNACWVGHHFTNDIQTRQYRSPEVILGAKWGASTDVWSMACMVFELITGDYLFDPQSGTKYGKDDDHIAQIIELLGHFPRSLCLSGKWSQGNLQPQRRTPKHPSAAPLGAPGRAAGRNTISLSRRASRSATFCCQCCIWFRRNGPMPAVWPVMSGSRIHQAWTALIWEFRRGLGARASKAGHARSNGGDFMILCFVALYSGWMDGIYCVLDKLDVDLISFMMTYRELCRRGLPMI

SEQ ID NO: 10067 - protein, 640 aa, Triticum aestivum
  misc_feature (104)..(104): Xaa can be any naturally occurring amino acid
  misc_feature (301)..(301): Xaa can be any naturally occurring amino acid
  misc_feature (346)..(346): Xaa can be any naturally occurring amino acid
  misc_feature (360)..(360): Xaa can be any naturally occurring amino acid
MGNPGAFHHSITLQSFTVFFLLAVFVADYHVQGGDDGCSLFSCGHLRDISYPFRRRGDPRECGVEEYELGCTSSKATIHINTGTYYVTAIKYTGSYFWVMDPNXQYQKQYFGDSIEPLCTNWILGTGPEFPGYRRPTRPSCGYLAMFPLSDPGPGNYYNFSHYADFVKHLRLGFSVRFPLLDPPLSIIGQINSCLDWSFRGRHHDTGNNMKSWTMDILLMDFSFWSCIFGFNLDSNNILDYMRAMIHDQSGHQILPPVFALVIAKWIAVLCRFLLAPLAVLIFLAQKYWKTRITIDAVEFXLQMQQMIGPTRYAYTDIVALTSHFRDKLGQGGYGSVFKGVLLPGXVNIPVKMLEGTSTXHGKNFISEVSPIGNDPTMSMWVRLVGFCSEEMRRALVYEYMPRGSLDKYIFSAEKSFSWDKLNEIALGIARGIDYLHQGCELQILHFDIKPHNILLDNNFIPKVADFGLAKLYPRDNSFVPSRALRGTIGYIAPEMISRSFGAISSKSDVYSFGMLLLEMAGGRRNADPNAANSSQAYYPSWVYDRLTEPEVDEISPATEMHELERKLCIVGLWCIQMRSHDRPMMSEVIEMLEDSVDGLQMPSRPFFCDEGHTHTDDTYHLSSELTEISEEDMSESIDV

SEQ ID NO: 10068 - protein, 122 aa, Brassica napus
  misc_feature (118)..(118): Xaa can be any naturally occurring amino acid
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKXGLTF

SEQ ID NO: 10069 - protein, 472 aa, Bacillus clausii KSM-K16
MNHALFINNECVATDDMIEVENPATKEVIGTVANGGKQEALAAVDAAAAALPEWRAKTAAERGAYLQKWYELIQREEEEIAKLMTLEQGKPFAEALGEVRYANSFLSWYAEEGKRVYGETVPAAATNKRIFVQKQAIGVIAAITPWNFPAAMLTRKLGPALAAGCTAVMKPSELTPFTAYRIVELAKVAGIPKGVVNMITGDAQQIGETWMADERVRKVSFTGSTRVGKLLMRQAADTVKKLSLELGGHAPFIVTAQADIQKAVDGLIASKYRNGGQTCVCANRIYVHESIKAPFVEAFAAEMKKLKVGNGMEPDSHIGPLINEAAVAKVQKHIEDAQAKGGEVIFGQEADATNGYFQTPALIANATDDMLCMKEETFGPLAPIATYTSTEDVIERANHSPYGLAAYVYSNDLSEAVTIAERLEYGIVGLNDGLPSVAQAPFGGMKESGLGREGGHWGIEEYVEVKYISLQL

SEQ ID NO: 10070 - protein, 119 aa, Leuconostoc mesenteroides subsp. mesenteroides ATCC 8293
MRQNTILENVTSAQLRTDIPAFRAGDTVKVYAKIVEGSRERVQLFEGVVIKRKGAGIQATYTVRKISSGVGVERTFPLHSPRVEKIEVTRFGQVRRAKLYYLRALQGKAARIKERRRDV

SEQ ID NO: 10071 - protein, 507 aa, Streptomyces avermitilis MA-4680
MHNPGHRFQAQDRFADGAQYIAGRFAKGTSGRRHAVVDPATGEEVYRYELAGTADVDAAVAAARAAFPGWAATTPGDRSDALHRFAAVLADRAEEFARAESLQCGKPLKLTREFDVPGTIDNTSFFAGAARHLQGQSAGEYSGDHTSYIRREPIGVVGSIAPWNYPLQMAAWKVLPAIAAGNTIVLKPAEITPLTSLLFAEAATRAGIPDGVVNIVTGAGRDAGEHLVAHPDVAMTSFTGSTAVGRRVAEIATSTVKRLHLELGGKAPFVVFDDADLDAAVHGAVAGSLINTGQDCTAATRAYVQRPLYEEFVARTAALMETVRLGDPFAHGTDLGPLVSHAQRDRVAGFVDRARAYARVVTGGEIPEELKDGAYYRPTLIADAAQDSEIVQSEIFGPVLVVLPFDSDDEGIRLANDTPYGLAASAWSRDVYRANRATREIKAGCVWVNDHIPIISEMPHGGYKASGFGKDMSAYSFEEYTQIKHVMFDNTAIVRKDWHRTIFGDRP

SEQ ID NO: 10072 - protein, 507 aa, Arabidopsis thaliana
MAMASLARRKAYFLTRNISNSPTDAFRFSFSLTRGFASSGSDDNDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGVEGLFKKNKVNYVKGYGKFLSPSEVSVDTIDGENVVVKGKHIIVATGSDVKSLPGITIDEKKIVSSTGALSLTEIPKKLIVIGAGYIGLEMGSVWGRLGSEVTVVEFAADIVPAMDGEIRKQFQRSLEKQKMKFMLKTKVVGVDSSGDGVKLIVEPAEGGEQTTLEADVVLVSAGRTPFTSGLDLEKIGVETDKGGRILVNERFSTNVSGVYAIGDVIPGPMLAHKAEEDGVACVEFIAGKHGHVDYDKVPGVVYTYPEVASVGKTEEQLKKEGVSYNVGKFPFMANSRAKAIDTAEGMVKILADKETDKILGVHIMSPNAGELIHEAVLAINYDASSEDIARVCHAHPTMSEAIKEAAMATYDKPIHM

SEQ ID NO: 10073 - protein, 531 aa, Mycobacterium avium 104
MTETVGPARAKPVMSRKAKWLYAIGRVRAATRRRRGPKVAIIGAGFGGLGAAVALRRAGIDDLVIIEAADGVGGTWRRNTYPGAACDIQSHLYSFSFAPNASWSRTYARQPEILAYLESVADAFDLRRHLMLDTTVRSLRWNPHTAAWDCRIDRGGHPATLSADVVVCAVGLFGAAKLPDIDGLAGFAGPVLHTAQWDHDLDLAGRTVAVIGTGASGVQLVPELAGTAGHVTVFQRTPPWMVPKDDRPYSATELARFKRNPLALRRTRWQIWKFQHDNTATFADDPVVTARSRIATSFLDRTVADESLRRALTPDYPFRCKRVLLGDDYYRALQRDNVELVTDPIARIGRMSVITASGAEIEADVIVLATGFETSRYLSGIEVVGAGGRRLHEHWGEEPSAYLGVAVSGFPNFFMLYGPNTNQGGNSIVYILEAGARLVASAVSRLARRGGFLEVRPEAEKRFNDRLSADLERTIWTRCDSYFRSPTGRIVTQWPYTELDYARWTWRLRRRDWIHHRCAPGAATVGAAQEF

SEQ ID NO: 10074 - protein, 225 aa, Oryza sativa
MKLEVMPKQRAMEAEQREEAMEMSGLELWKHEKPASMVVFLPPPPPPPLVPAAAAAAAAACGEEATLVPPLNFAMVDDGIFRSGFPAAANFRFLKSLNLRSIVYLCPEPYPETNAEFLAKNGIKLHQFGIEGRKEPFVNIPDDKIREALKVVLDVKNQPLLIHCKRGKHRTGCVVGCLRKLQKWCLSSVFDEYQRFAAAKARSTDQRFMELFDISSLKHLTASHC

SEQ ID NO: 10075 - protein, 339 aa, Photorhabdus luminescens
MTIKVAINGFGRIGRSILRALYESGRRAEIAVIAVNELADAEGIAHLLKYDSSHGRFAWDVRLNNDLLQVGDDNIRLFHQPDISTLPWQELGVDIVLDCSGIYGSRADGQAHLASGAKKVLFAHPGGNDLDATVVYGVNQHLLTAEDRIVSNASCTTNCIIPVIKLLDDEFEIESGTVTTIHASMNDQPVIDAYHKDLRRTRAASQSIIPVDTKLAAGITRIFPKFCDRFEAISVRVPTINVTAIDLSVTVKSSVTVKKINELMQKSAATSFRGIVDYTELPLVSTDFNHDPHSAIVDGTQTRVSGQHLIKTLVWCDNEWGFANRMLDTTLAMAATGFK

SEQ ID NO: 10076 - protein, 120 aa, Brassica napus
MAPNAHIKKAITAMKALGIEEAQIKPVLKNLLVLYDKKWDLIAEDNYRALADAIFETQETQAIEEKKGKEKKANDEAEGSAAEVDRGKRKANEESDDEDALDEPERPLKRLRRRGGEVVS

SEQ ID NO: 10077 - protein, 355 aa, Oryza sativa
MAGARAIGSLPVPNVQELAKTCNGPDEHIPERYIRPEASSEEVISNYHGEAIPIIDLNKLLSPQSSEECVKLRSACQYWGFFQLINHGVPDEVIANLKRDIVDFFSQPLDAKKEYTQLPNSLEGYGQALVFSEDQKLDWADMLYLQVHPSDSRDLRFWPTSPASFRRSLDAYSSETKSLALCLFEFMAKAVGAKPESLLDLFEEQPRGLRMAYYPPCRQADKVMGLSPHSDAGGLTLLLEINNVQGLQIKKDGKWFSIDAPNGALIANIGDTLEILSNGKFRSVEHRAVINPNKERISAALFHYPSENMVISPLPEFVKDGKVKYRSISYLDFMKQIFTQQLDGKNRVEVLKLDQ

SEQ ID NO: 10078 - protein, 536 aa, Bacillus clausii KSM-K16
MMNTPLTISSMLERAERYFPNKTVVSRTHDNIYRYTYEEIGKRTRALASALTKLGLKRGERVGTIAWNHHRHLEAYFAAPGIGSVLHMINMRLPPDHLAFVINHASDRILLIDEDVLPLVEAIWPQLETVHTFVVMTDKDQLPSSTLEPLYSYEALLAEGDDCFAFYDDIDENEQAAMCYTSATTGMPKGVEYSHRGIVLHSLVQGHVDTTAISENDVCMPVVPMFHVNAWGLPFSATFYGATQVLPGPAFTPQLLAELIEKERVTFTGGVPTVWLGLLQVLEHHHYDLSSLRAVICGGSAAPQSMIERFERKLNVPFYHAYGLTETAPLVSFSRLKSHQKKGGKGEQYQAKAKQGMAVPLIDIKGVNANGEIPWNGEEMGELLIRGPWVADRYFHDERSTEAFKDGWFHTGDVVTIDEEGAIKIVDRTKDLIKSGGEWISSVDLENAIMSHEAVLEAAVVAVPHDKWQERPVACVVLKKDKQATKEEIVDYLKPQFAKWWLPDEVVFMEALPKTSVGKFLKRALRKELFNQSRFL

SEQ ID NO: 10079 - protein, 261 aa, Oryza latifolia
GVTDLAPGDHVLPVFTGECKECPHCKSAESNMCDLLRINTDRGVMIGDGKSRFSINGKPIYHFVGTSTFSKYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 10080 - protein, 160 aa, Triticum aestivum
  misc_feature (42)..(42): Xaa can be any naturally occurring amino acid
  misc_feature (153)..(153): Xaa can be any naturally occurring amino acid
MAERRSGYRDWDRAAAEAGRCWRPPRSQAHGGGNVSVPLWEXKKFCIDACSIPWGKLCEAKKLMSLYTNIVDWDDSAAFEAFKDAKDRFCAAYHGQPCYIPLPDPDMYIDVVNPDEYIDPELVADLERSRRRAPRRDSTAPDGWDSSIFADKXVPAQGWG

SEQ ID NO: 10081 - protein, 470 aa, Coccidioides immitis RS
MNSSVPPATAEYGGDEVSAIILDPGYSSIRAGFAGEDTPKSVTPTYYAKYSTDGQDKHIYGDSIYVSPRPGLSIHNPMGSDGIVEDWDMAEKLWEYSFSSRLTGTKPGNPMLNGLNDTSELPTEMEIVESQEKPLSDSPLLMTECGWNPTKAREKTIEIAMENWGTPAFYLARTGPLAAFAAGKASALVIDVGASTVSVTPVHDGLILKRGVQHSHLAGDYISSQVRALFKQNTPQPITITPHYLISSKTAVDAGQPAQATYRTIPDDQAPDASFRRLLENRTISEFKECVVQVWPGPQGLLNVNPNGVSNEDLAKNSPGRPFEFPDGYNQLFGTDRYRVAESLFDAKAAIPDPDSEFPAPTAAQTIPELVRSALNQVDIDIRPHLLGNVVITGATSLLYGFNDRINSELTAMFPSPRVRLFAPGNTVERKFGSWIGGSIVASLGTFHQMWISKKEYEEHGANIVEKRCK

SEQ ID NO: 10082 - protein, 413 aa, Triticum aestivum
  misc_feature (179)..(179): Xaa can be any naturally occurring amino acid
  misc_feature (392)..(392): Xaa can be any naturally occurring amino acid
MNKWEFFQNPVLKKGGQKAQKKKGFPGGGFKPPGVQKKFFCKVVTVTKNRGYRAPSMVRTTVQELAAAVEEPPRQYVVHERDQDHLLAADEMPDPIPLIDLGRLTAADEAHKLREALQTWGLFLVTNHGIEESLMDAMMSASRDFFRQPSEEKHKCSNLKDGGRHLEVEGYGNDKVVTXQDQGLSWNDRLHLRVEPEDERNFAKWPTHPESFSVSVYRDVLLEYATRTKRIRDLILRSIAKILDLDEDYFVNQISNKARGFARFNYYPPCPRPDLVLGMRPHSDVGLLTILSVDHDVGGLQVQRDGKWYNVPAKPYTLVINLADCMEIMCNGIFMSPVHRVVTNAKKERLSLGVFYVVDGEMVLEPAPGLLDDERPPRYGKFKANDFGFSFXECFRQGKRFIETLKIQVQHIN

SEQ ID NO: 10083 - protein, 664 aa, Photorhabdus luminescens
MTTRKTLANAIRFLSMDAVQKAKSGHPGAPMGMADIAEVLWRDYLNHNPTDPHWVDRDRFVLSNGHGSMLIYSLLHLTGYDVSVDDLKNFRQLHSKTPGHPEYGYTPGVETTTGPLGQGIANAVGFAIAERTLAAQFNRPGHEIVNHNTYAFMGDGCMMEGISHEVCSLAGTLKLGKLIAFYDDNGISIDGHVEGWFTDDTASRFEAYGWHVIRGIDGHNAASVKAAIEEARKVADKPSLLMCKTVIGFGAPTKAGTHDSHGAPLGDAEIAATREALDWNYPAFEIPADIYAEWDAKEAGNVKQAAWNEKFAAYEKAYPELAAEFKRRTSGELPADWEAESKAFIEQLQKNPANIASRKASQNALEAFGKVLPEFMGGSADLAPSNLTMWSGSKPLNEDLAGNYIHYGVREFGMSAIMNGIALHGGFVPYGATFLMFVEYARNAVRMAALMKIRSIFVYTHDSIGLGEDGPTHQPVEQLASLRVTPNLSTWRPCDQVESAVAWKYAIERKTGPSALIFSRQNLAQQERTAEQLANIEKGAYILKDCQGQPELILIATGSEIELAVSAYNQLTEEGRQVRVVSMPSTDAFDKQDAAYREAVLPAVVSARVAIEAGIVDYWFKYVGINGAIVGMDTFGESAPADQLFKAFGFTVENVVAKAKALLK

SEQ ID NO: 10084 - protein, 436 aa, Dioscorea quinquelobata
QKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDELMSNFFAQPDALAYGKVADQLLNEKVPDHLIPHKTFPGNRPSLSLLLPSLNAYNVGQLLAIYEHRIAVEGFVWGINSFDHWG

SEQ ID NO: 10085 - protein, 938 aa, Elaeis guineensis
MMSLLLRIFYFVIFLPFLAESRNPALNDDVLGLIVFKADLREPDSKLVSWNEDDDEPCCWTGIKCEPKTNRVTELSLNGFSLSGKIGRGLLQLQSLRTLSLSKNNFSGTLSSDLLRLESLRNLDLSENKLSGPIPDDFFGQCRSIRAISLAKNAFFGAIPSNVGFCSTLAALNLSSNRLSGSLPWRLWSLNALRSLDLSDNTLVGEIPVGISKMYNLRSISLHGNRLSGHLPDDIGDCLLLKSLDLAGNSLSGSLPESMRKLSTCSYLSLSSNFFSGEVPTWIGEMKSLETLDLSRNGFFGQLPGSLGDLQLLKALKLSRNGFTGSFPESLCSCKSLVDVDLSQNSLTGKLPLWVFESGLQQVLVSENKLNGSIVIPSSSASNLQVLVLSSNAFSGSIPEGLGKLKSLEVLDLSGNRLNGSIPLEIGGAVSLKELRLEKNSLKGAIPTQIGNCASLTSLDLSQNNLTGPIPPTLANLTNLQIINFSRNRLTGTIPKQLSNLPHLLSFNIAHNVLSGDIPSGSFFNTIPPSFLSDNPGLCGSIVNRSCPGVLPKPIVLNPENSSPNSSSGSTFSPSGLHHKKIILSVSTLIAIGAAAIIALGVITITVLNFRARASASQSAAALALSDDFLSQSPTTDANSGKLIMFAGGDPEFSAGAHALLNKDCELGRGGFGAVYKTMLQNGRPVAIKKLTVSSLVKSQEDFEREVKKLGKVQHPNLVALEGYYWTPSLQLLIYEFVSGGSLYKHLHESSASNALSWQERFDIILGTAKSLAHLHRLDIIHYNLKSAYILLDGSGEPKTGDYGLAKLLPMLDHYVLSSKIQSALGYMAPEFACRTVKITEKCDVYAFGVLVLEIQARKRLLEYMEDDVVVLCDMVRGALEEGKVAECVDGRLMWEVPHRGGHCSDEAGFDLHVAGSIESARHGGGGEHPGTYQMPSG

SEQ ID NO: 10086 - protein, 184 aa, Glycine max
MASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 10087 - protein, 290 aa, Arabidopsis thaliana
MEKEITISLYLLDYHRQRILMGEKTANFFSLFLVVADFQNLPCGWRRHARFCLTVVNQISDKLSLHRETERWFDEKIPVHGYEEMISLAKLNVRKGGFLVKNEVKIVVEVDVLQVIGNLDVSEVSSHLHKETSSVDVNGFLVLPSQVESAKLIFERHSDMALEFRAKNQYVRTSCMNVLLSLIDTLCQSLQDFSIDDLGQAERALTYLKDSDFKVDWLERKLEEVKEKKIEEQIEEMLLLSELNAKEGGFLVNNEVKIIAEVDVLQVLPSQNQSNRPILRPPPLVILKSF

SEQ ID NO: 10088 - protein, 222 aa, Zea mays
MTMKLDAPARQKSQDAEQNGRTAAAGVLGIDEPWSQPKLRLTGHAQADADALVPPLNFAMVDDGIFRSGLPDAGSFRFLLSLNLRSVVYLCPEPYPEENARFLQQNGIQLHQFGIEGSKSGSTVPDAMVVQEPFVYIPEETIREALKVILDARNQPVLIHCKRGKHRTGCVVGCLRKLQKWCLSSVFDEYLHFAAAKARSTDQRFMELFDASSLTHLAASQY

SEQ ID NO: 10089 - protein, 238 aa, Triticum aestivum
AYLGDTIEQVCTKKQAGTGPEFPGYRRPTRPGLPSSHTLNTVCLMGYMLHYVRGDGPCDGFMIATGLSLAFMLVTLIGIARVYLGMHSLTDVIAGISFGIVILAFWLVVHDHVDAFVVSGQNVRFFWASLSLVMCFAYPRPEFPTPSFEFHTAFNGVAFGIVYGVQQTYTRFHGPEAPLILSHQLPLLAYAGKVLVGIPTILAVKSCTKALSKWLPPVMCTPPGAFPIVVLPAYGPLA

SEQ ID NO: 10090 - protein, 261 aa, Oryza latifolia
GVTDLALGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMNK

SEQ ID NO: 10091 - protein, 261 aa, Oryza latifolia
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMNK

SEQ ID NO: 10092 - protein, 51 aa, Prunus persica
LIQGLADVEAAVCLCTAIKANILGINLNIPISLSLLLNVCGNKVPKDFQCA

SEQ ID NO: 10093 - protein, 170 aa, Triticum aestivum
  misc_feature (24)..(24): Xaa can be any naturally occurring amino acid
  misc_feature (127)..(127): Xaa can be any naturally occurring amino acid
MASSATSVAPFQGLKSTAGLPVSXRSSSAGLGSVSNGGRIMCMQVWPIEGIKKFETLSYLPPLSTEALLKQVDYLIRSKWVPCLEFSKVGFVFREHNSSPGYYDGRYWTMWKLPMFGCTDSTQVLNXVEEVKKEYPDAYVRVISFDNLHQVQCVSFIDFKPPGCEESGKA

SEQ ID NO: 10094 - protein, 404 aa, Zea mays
MSALGTLSGGAAGVSGLIRLRRRVAPALAAPSHHAAGTLNCAALPDAAPLVWGRQLRPSLLLPATLLPSSSQGARRHTPRRPAAAAGEAKSVGFLEKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDMDSTNVYAYISIIALIVCIPPAVIFEGPRLMQHGFSDAIAKVGLTKFVSDLFLVGLFYHLYNQIATNTLERVAPLTHAVGNVLKRVFVIGFSIIVFGNKISTQTGIGTSIAIAGVAMYSYIKAKIEEEKRKKSA

SEQ ID NO: 10095 - protein, 261 aa, Oryza latifolia
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVSPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 10096 - protein, 1091 aa, Candidatus Kuenenia stuttgartiensis
MPKRNDIEKILIIGSGPIVIGQACEFDYSGTQACHALREEGYTVILVNSNPATIMTDPEVADKTYIEPITTEIITKIIEKERPQAILPTLGGQTGLNAAVSLAEKGVLDKFNVELIGAKLKAIKMAEDRSQFKAAMGRIGVQVPESVYVNSLDTALKIIDAIGFPAIIRASFTLGGSGGSTAYNIEEYKEYITTGLETSPIHEVLVERSVLGWKEYELEVMRDLKDNVVIICSIENFDPMGVHTGDSITVAPAQTLTDMEYQKMRDAAVRIIREIGVETGGSNIQFAVNPENGEMLAIEMNPRVSRSSALASKATGFPIAKIAAKLAIGYTLDEIPNDITRYTPACFEPAIDYCVVKIPRFNFDKFPDTIQELTIHMKSVGEVMAIGRTFKEAVGKAIRSLETGRSGFDPLLPSGIDDWTAEQKSEYLQMKLITPTPDRLWHIADAFRLGMTLDEIYTYSRIDKWFLYNIKQITDLENEIKQRHLMVKLKDNDASQKNRDFVMNAELLAKAKQYGFSDIFLARLCGSDEKTIREYRYRTSVRPVFKHVDTCAAEFKAFTPYLYSTYETSCEADPTTKRKIIILGSGPNRIGQGIEFDYCCVHGVYALKELGYETIMVNCNPETVSTDYDTSDRLYFEPLTMEDVLEIIHKEKPEGVIVQFGGQTPLKLAVPLEKEGVKILGTSPENIDVAEDRERFALLMNRLGLKQPENGCANSAEDAKMIAKRIGYPVLLRPSYVLGGSAMRIVYDEQGLEHYISHAVEVSHEHPVLIDSFLQDAIEIDVDAISDGEEVFIGGVMEHIEEAGVHSGDSACSLPPYSVNNEIIEELKKETRIIALALNVIGLINIQYAVKDKVIYVLEVNPRASRTIPFVSKAIGVPMAKIAAKVIAGEKLRGLNMPENITMRHTAVKEAVFPFLKFKGVDTLLGPEMKSTGEVMGLDKDFGRAYAKAQMSANYCLPLVGSVFISVRDKDKKPIVQIAKKLLQMGFKITATKGTAAALSEENISVTPVLKVIEGRPNIVDHIKNNEVQLVINTAEGKAAQEASFSIRRTALTYQIPYFTTVAGAVAAVRAIEALKSGTLDVRSIQEYHQR

SEQ ID NO: 10097 - protein, 479 aa, Streptomyces avermitilis MA-4680
MSTELRRLRNHIDGEFRDAADGRTTEVVNPATGEAYATAPLSGQADVDAAMAAAAAAFPAWRDQTPAERQKALLKIADAFEERAEELIAAEVENTGKPIGLTRSEEIPPMVDQIRFFAGAARMLEGRSAGEYMEGMTSIIRREPIGVCAQVAPWNYPMMMAVWKFAPALAAGNTVVLKPSDTTPASTVLIADIIGSILPKGVFNVICGDRDTGRAMVEHPTPAMASITGSVRAGMSVAESAAKDVKRVHLELGGKAPVVVFEDTDIPKAVEDISVAGFFNAGQDCTAATRVLVQESIHDEFVAALAKAAADTKTGQPDDEDVLYGPLNNPNQLKQVAGFVERLPAHAKVEAGGHQVGEKGYFYAPTVVSGLKQDDEIIQNEVFGPVITVQSFTDEAQAIEWANGVDYALASSVWTKDHGRAMRLSKSLDFGCVWINTHIPLVAEMPHGGFKKSGYGKDLSAYGFDDYTRIKHVMTSLDS

SEQ ID NO: 10098 - protein, 459 aa, Streptomyces avermitilis MA-4680
MGNPIAVSKDLSRTAYDHLWMHFTRMSSYENAPVPTIVRGEGTYIYDDKGKRYLDGLSGLFVVQAGHGRTELAETAFKQAQELAFFPVWSYAHPKAVELAERLANYAPGDLNKVFFTTGGGEAVETAWKLAKQYFKLQGKPTKYKVISRAVAYHGTPQGALSITGLPALKAPFEPLVPGAHKVPNTNIYRAPLFGDDPEAFGRWAADQIEQQILFEGPETVAAVFLEPVQNAGGCFPPPPGYFQRVREICDQYDVLLVSDEVICAFGRLGTMFACDKFGYVPDMITCAKGMTSGYSPIGACIVSDRIAEPFYKGDNTFLHGYTFGGHPVSAAVGVANLDLFEREGLNQHVLDNESAFLTTLQKLHDLPIVGDVRGNGFFYGIELVKDKATKETFTDEESERVLYGFVSKKLFEYGLYCRADDRGDPVIQLSPPLISNQSTFDEIESIIRQVLTEAWTKL

SEQ ID NO: 10099 - protein, 229 aa, Leuconostoc mesenteroides subsp. mesenteroides ATCC 8293
MNKQKKHAGEFAATLIEDGMVVGLGTGSTIAYFLEALAKRIQDEKMTIIGVTTSTKTARCAEELGIPIRDIDLVPMIDLTIDGADEVDQHLNGIKGGGAAFLMEKIVARYSRRVIWIIDEQKLHSKLGQFPLPVEVVAFGSGKLIAELKERHLHPKLRLDNHQQPLVTDLGHYIVDLDLEQIDQPFELGRYLDGQIGIVEHGLFLNVADQVIIGQDEGYRIMNNLQKEM

SEQ ID NO: 10100 - protein, 383 aa, Saccharomyces cerevisiae
MDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNDDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYFPGRGAKVMFRSKEGAEPKQIGHLGVLHPEVMMNFDVPFAASFVEVNAEVFL

SEQ ID NO: 10101 - protein, 175 aa, Triticum aestivum
MPPPVMASSATSVAPFQGLKSPAGLPVSRRSNGVSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10102 - protein, 203 aa, Nicotiana plumbaginifolia
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLSEIDRYASDSVNKLLVGNKCDLTAQKVVSTETAQAFADEIGIPFMETSAKNATNVEQAFMAMAASIKNRMASQPASNNARPPTVQIRGQPVNQKSGCCLS

SEQ ID NO: 10103 - protein, 124 aa, Zea mays
  misc_feature (61)..(61): Xaa can be any naturally occurring amino acid
  misc_feature (68)..(68): Xaa can be any naturally occurring amino acid
MVRVSVFNDAIKSKCNAEKIGKRQVTIRPSSKEIIKFLPVMQSHGYIGEFEYADVHRAGKXYVVELNXACNKCAVIRSRSDVGVKEIEGWMPSVLPSEQLGSMVISSQGGIMAHAESHSKNIVV

SEQ ID NO: 10104 - protein, 583 aa, Tropheryma whipplei str. Twist
MGFYITTPVFYVNDIPHIGHAYTLVVSDVFARWQRQSGKDTFFLSGTDEHGLKVLRAAEEKNMTPQGWADLMLKTAWKPLLDLMHISNDDFVRTTESRHRERVKWFINRLRENQYIYSGQYSGYYCVSCEEFKTVSQSALPNDESVNGTLGKDPRTCSLPQGEEQNYFCEVHGCQLEHFTEKNYFFRLSAFTDRLLDLYKKNPDFIEPKSAYNEVVQFVKNGVSDLSISRSSFTWGIEVPWDEGHVVYVWFDALINYLTPVMSAKEELPIDGTTPGGAEFCTHSNLNTLESSIPGPGGSAESDRLSHTLSTSADNAALTSPFKKYWPASHIIGKDILRFHAVIWPAMLMAAGLPVPEKIFAHGWLLVDGQKMSKSKLTGIKPQDLTDIFGVDAVRYYFLRQPVFGQDYSFSIESIAACYNSELADGYGNLACRLSSMYTTYLNGRVIVPKIYSEEDESLLQACKDVSDRACKAIDELIPHIAMAEIWSLAVRANTYTTRQQPWSLHKKQDDERLACVLYTALRALSTITILLSPIMPRITNKLWSAFGADGGVSQQNIRSAWGGKLSDKVSLIPPMFPKITIS

SEQ ID NO: 10105 - protein, 108 aa, Haemophilus somnus 129PT
METLDKIKKQISENPILIYMKGSPKFPSCGFSARAVEVLINCNVPFGYVDILQHPDIRAALPNYANWPTFPQLWVEGELIGGCDIMLEMFQQGELQSLLSEVAARYPQ

SEQ ID NO: 10106 - protein, 364 aa, Cupriavidus necator
MSRCGRRAELLHAAGTGSGSASFPMSAAPSSSPDAPATPGLPSSPLDPQVAALLELIARAKRPPIHAMEPEDAKIAYEKSAPILDINPPPVYMAEDLLAPARDGHAIPLRLYTPREASWTEPLPLLVYFHGGGFTVGSVDSHDPLCRLLCGQADCMVLSVDYRLGPQWRFPTAANDAFDVLHWVFAEAGRLGADPARIAVGGDSAGGTLAAACAVEARNAGLAPVLQLLIYPGTCARQDTPSHRALADGYLLTADMIRWFFAQYLDQEASRDDWRFAPLDGGGAGAEVRGTCPAWIAVAGYDPLHDEGVAYAEKLRAAGVAATLADYPGMIHDFFKLGRFVPAVAQAHAEAVAALRAAFGTPHN

SEQ ID NO: 10107 - protein, 1314 aa, Debaryomyces hansenii CBS767
MSSHQRQDSIASLSSTATGNIHPQKIGPWKLGKTLGRGATGRVLLATHQSTGQKAAVKVVSKSELNDDEINKKSADEAGLPYGIEREIIIMKLLTHPNVLRLYDVWETSKALYLVLEYVEGGELFDLLVERGPLQEVEAIKYFRQIILGTAYCHALGICHRDLKPENLLLDSGLNVKLADFGMAALESNGKLLETSCGSPHYAAPEIVSGLKYHGAASDIWSCGVILFALLTGRLPFDDENIRNLLLKVQAGSFEMPCELSPEAVDLIDKMLTVDPMKRIPTERILSHPLLTKYPIPNEDLISVKSLPHPETAYKSLGSEKNIDKQILQNLSILWHDRSQGDIVDCLLKTGSNPEKTFYALLMRYRHNQEESAGSSPTRSNSQNFNNKIGNKDNNRKKRMSQVSASTSRNRPVLFQYKNGIKSSIGNGNGRLSSTSSVSNSPRKSPVRRSSNRYSFAQSPRKFGGTSDETTLHSSSVPRNIYNEIVSAQRNGQGVMPPPLPSKDNMDSKSNPIVDEVSNQDLLSSAKISPTKNKRGSVIRNSISKNRLSRRKSRTSFTPGLKRNSITTKLLSTYAKLAGETDWEFMDKQTKRTSATFATLCDKIFNQEQYDAEDEKLIDEEEKQAKEYERLMEIERKKHEAELRARKELAKQRKREKRKSLLSSRKLSILVKDDANNSEQDITVTDSDALSQPKRQSRNQAMRSISEGHGKESDDLTKEDLENLKRRSVTQPTPRRRKTPVLTRRPVSRLDPLWTAYENEEIERAQDALEAEYRDADFKTKKKINRESMVSVMDDKEVDNEPHVDDDATDEVQDEEAVKAKSRGYELPEPDMERSDLSDEYMSEIRKSRLLNSQLNINAIANGEKEVKSEKRQDKEPKTLIGDVRIPTVTRKSRCFTNSNKRLSVLSMYSTKQSYRDLNSILGDENDENNDVEGQLPQLRTSFADRLDRAGLADAEEEDDEPLDEGSIMDFDQHLANKRSSYYAGDKSRRQSRYSTTKRNSQAPTVDVPAIPKKSNKERDREDDTFVTKDDDVHRRKSAYSAKGANNNDDEDMIFENIKLPNEDRRQSASTAKSNKKKSFQPSAESMLIPNVDNIPEDAKTRKPDPRSQPYEKVRKPKVSNGELKSTGPEGQVKNPLEDTTNEPRENQKRKGSIFRKLSWGSKKTMDNSAAQLPSPADSRAPSVEEKPKSKSGFFRWFSSSSNQPGIESEIRRFKAILPKQEMSSALFALLNSWSNFGLKNLRNDTVGYNITGEISKNNAFNLKNCKFRIKVNPREFNQKSEIVCARVKGSKVTTDTLFKEIEKVLQKEGVMDI

SEQ ID NO: 10108 - protein, 261 aa, Oryza alta
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGVRIAGASRIIGIDLNANRFEEARKFGCTEFVNPKDHDKPVQQVLAEMTNGGVDRSVECTGNINAMIQAFECVHDGWGVAVLVGVPHKDAEFMTHPMNFLNERTLKGTFFGNYKPRTDLPNVVELYMKK

SEQ ID NO: 10109 - protein, 901 aa, Aspergillus oryzae
MKTDFKFSNLLGTVYRKGNLLFTPDGTCLLSPVGNRVTVFDLVHNTSYTLPFAHRTNIDRLDLNPQGNLLLSVDENGRAILTNFKRRIVIHHFSFKGRVSSLKFSPSGRFFAVGVGRRLQFWHTPSTPGADNNGELEFAPFILHRDLAGHFDVIQHLEWSHDSRFILTASKDLTARVWSLDPEEGFEPTTLAGHRQGVKAAFFSADQESIYTVSQDGALFRWEYVTKKDPDTMEDVDEARWRIVKKDFFMQNDAKVNCTAFHAPTNLLVVGFSNGLFGLYDLPEFNMIHLLSVSQSNIDYVTVNKSGEWLAFGSSKHGQLLVWEWQSESYILKQQGHLESMGSLVYSPDGQKIVTTSDDGKVKVWDVKSGFCVVTFTEHSSAVTACQFAKKGSVLFTASLDGSVRAWDLIRYRNFRTFTAPSRLSFSSLAVDPSGEVVCAGSPDSFDIHIWSVQTGQLLDQLTGHEGPVSALAFAADGNHLVSGSWDRTVRIWSIFGRTQTSEPLQLVSDVLSVAFRPDGKQVAASSLDGQLTFWSVADAIQESGIDGRRDVSGGRKITDRQTAANAAGTKFFNCITYSADGSCILAGGNSKYICLYDVRTGSLVKKYTVSVNTSLDGTQEILNSRDLTEAGPRGLIDETGEASDHEDRVDRSLPGAKRGDAGARTTRPEVRVTCVNFSPTGRAFCAASTEGLLIYSLDTEYVFDPFDLDISITPSSIMETLENAKQAYTTGTGDNDDSFLKALVMAFRLNESKFIRLVHEAVPPSEISHVVRALPTVYLPRLLRYVAHAAEETPHLEFNLLWIESLLSSHGRYFKENSGTFAPELRAVQRAIDDIRENLKRMTEKNLYDLNYLLSKPVLAGKKTSNTLTLADVEPDDMAANGDENMADTAGGEEEWIGLE

SEQ ID NO: 10110 - protein, 146 aa, Schizosaccharomyces pombe 972h-
MNSMFRFWIPKTSISMQLRMLSTQTRQALEQAVKEDPIVLFMKGTPTRPMCGFSLKAIQILSLENVASDKLVTYNVLSNDELREGIKEFSDWPTIPQLYINGEFVGGSDILASMHKSGELHKILKEINALAPEQPKDSEEETTKKD

SEQ ID NO: 10111 - protein, 411 aa, Schizosaccharomyces pombe 972h-
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSSKRFLKASIFVHQLVRQRYSVNRTDDDDLQSEPSSSLTNDGH

SEQ ID NO: 10112 - protein, 221 aa, Oryza sativa (japonica cultivar-group)
MATASDGSGSGGEQRRLLSIPKEGERIIAPTRRPDGTLRKAIRIRAGYVPQEEVAIYQSKGAQMRKSGPDVPPGYDPALDAKPKTKAAKRNERRKEKRQQQASTTNDKGKGLHIEDDAGETDNPKDAVDSVTKQISGIAISESLVVATSSTDATDNSKSESSAPDIDKKIRALKKKIRLAEAQVQGDPENLKPEQLEKMKKIEGWKEELKLLENKSSPAAS

SEQ ID NO: 10113 - protein, 368 aa, Streptomyces avermitilis MA-4680
MPKPGELTFVAPRGAKKPPRHLADLSPAERKEAVAAIGEKPFRAKQLSQHYFARYAHDPEQWTDIPAGSRAKLQEALLPDLMTVVRHLSTDQDTTRKTLWRLFDGTLVESVLMRYPDRVTMCISSQAGCGMNCPFCATGQAGLDRNLSTGEIVHQIVDGMRALRDGEIPGGPARLSNIVFMGMGEPLANYKRVVGAIRALTDPEPDGLGLSQRGITVSTVGLVPAIHRFADEGFKCRLAISLHAPDDELRDTLVPVNTRWKVREVLDAGWEYAARSGRRLSIEYALIRDINDQAWRGDRLGRMLKGRPVHVNLIPLNPTPGSKWTASRPEDEKAFVEAIAAHGVPVTVRDTRGQEIDGACGQLAATER

SEQ ID NO: 10114 - protein, 400 aa, Arabidopsis thaliana
  misc_feature (265)..(265): Xaa can be any naturally occurring amino acid
MADSQRLSTASGVKDGQPPWKKKKLSNDTTSNPSLPYDVILIILARVSRSYYTNLSLVSKSFRSILTSPELYKTRTLLGKTENFLYVCLRFPDEANPRWFTLYRKPNQTLTDHTTKKKKKKKKKEEKSSVNLLAPISILNSHPVEWSAIISVDHYLYAISADIEKAPYSNVPYLDCRTHTWNEAPRMRLAHTNSEFEGIVYLPGSFESPDSLNCVEVYNTMTQTWKPVPPEKRMFKLENLEKKIYYKSFHLDSRAGKGLSLSYKXSKHLTCGLVVLDTVDSYLRSSCMIENIAYFYRKGNFIWRGLDGKILVYGKIEGLEGLPKFSRYSSVQLAEYGGKLVVLWDKYVPASGYKEKMIWCAEISLEKRNGKEIWGNVEWFDAVLTVPKSYKILCATAATL

SEQ ID NO: 10115 - protein, 223 aa, Triticum aestivum
  misc_feature (190)..(190): Xaa can be any naturally occurring amino acid
  misc_feature (203)..(203): Xaa can be any naturally occurring amino acid
HSRTSLYKKAGCYRSGIPGISSTHASARTPSSSNQAMSLAPSIPSIKVKVGRIVPPPPYRACRSFAVIRSSKAEGPRRPAAPPLSPPPPMPPKTPALSTPPSLSQPPTPVKPAQPSPPPPETKPAVATAAATPPVGGVVTFEYQRKVAKELQEYFKKKKLEETNQGPFFGWLAKNEIANGRWAMFGFAVXDANRVRHRLGFPXANEDPSLQFWDCGFGLMAHV

SEQ ID NO: 10116 - protein, 138 aa, Burkholderia cepacia
MNTETKPLPAWLDKVRWDDNGLVPVIAQEASTNDVLMFAWMNREALAKTIDTQRAVYYSRSRKRLWFKGEESGHVQHVHEVRLDCDEDVVLLKVEQVSGIACHTGRHSCFFQKFEGTVDAGDWVAVDPVLKDPEHIYK

SEQ ID NO: 10117 - protein, 117 aa, Desulfotalea psychrophila LSv54
MSIIIDRINQEQMRQDHPDFRPGDTVAVHIRIIEGSKERVQLFQGVVIKRQKGTMDASYTVRKISHGVGVEKTFALHNPRIEKIEVITRGRVRRSRLYYLRDLRGKAARIRERSLRR

SEQ ID NO: 10118 - protein, 479 aa, Staphylococcus epidermidis RP62A
MEVFNMTNQLFINNEFIDSQSKETMDVINPATGEAFDTITLATEEEVNDAIEKSQQAQLEWERVPQPTRAEHVKLLIPLLEKNRDEIAQLYVKEQGKTLTQAYGEIDKSISFIDYMTSLSMSDKGRVLQNSIANETIQIINKPIGVTAGIVPWNAPILVLMRKVIPAIVTGCSVVIKPSEETTLLTVRLAELFRASTIPAGLIQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDDNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 10119 - protein, 793 aa, Oryza sativa
  misc_feature (24)..(24): Xaa can be any naturally occurring amino acid
MLLSTWTPGCFQGNKILLRSLITXQQQLVHWMMPPRFRCQDYLLPLLLALSPAAAAAREVEYHHCHCDDVGGGGAGGLWSMDSIFRWQKVSDLLIAAAYFSIPLEILYFVAGLRHLLPFRWVLVQFGAFIVLCGLTHLLTAFTYEPHPFMVVLLLTTAKFLTALVSFLTAITLLTLIPQLLRVKVRESLLWLKARELDREVVLMKRQEEASWHVRMLTHEIRKSLDRHTVLYTTLIELSRVLGLTNCAVWMPAAGEMCLTHELRRDGGGEDGVVGVDDADVVEVRGSDGVKLLGPDSVLAAASGGKEEGTGAVAAIRMPMLKVSDFKGGTPEVIQTSYAVLVLVPPAGKSWGRHEMEIVEVVAGQVPVALSHATLLEESRAMRDRLAEQNRELLQARRDALMANEARQAFQGVMSQGMRRPIHSILGLVSMVQEEALAPEQRLVVDTMARTATVVSTLVNDVMEMSADSRERFPLETRPFHLHAMIRDAACVARCLCDFRGFGFAVHVENALPDLVVGDERRIFHVLLHMVGNLIGRTEPGHVTLRVRAADDDVLDDRLGQRWDPWWPSYSTGYSSVKFVIGVKRQQNGDAGSPLSRRPSGKGIDLRLSFSMCRKLVQMMQGNIWAILDPQGLPESMTLVLRFQLQSPLTSSSLGGSFEQKHSSPSCQIAGLKVLLIDDDDDINLVVARKLLEKLGCVVSSPPSGSGFLSSVGSSAAAFQLVMVNLEMKRVKALDVATRISQYRSGRWPIVMAMASDQKAWEKCAQSGINGILKKPVILQELKDELARILQST

SEQ ID NO: 10120 - protein, 362 aa, Candida albicans
SPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPLNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 10121 - protein, 523 aa, Triticum aestivum
MVLGLLVSSPATVLWSLLGLALLWQVKRLVDYTWWRPRRLQRALRAQGLRGTPYRFPVGDLGDYGRQGKEASSRALPLRCHDIRAHVAPYLCNTVREHGKTCVSWFGPVPKVTIADPGVTREVMSNKFGHFEKLQFPTLTRLLAGGVAVYEGEKWVKHRRILNPAFHIEKLKFMMPAFSACCEELVSRWTQSLGSDGWCEVDVCPEFQTLTGDVISRTAFGSSYLEGRRIFELQSVQADRIVAEVKKIFIPGYMSLPTKKNRLMRQTNNEIEPILRGLIEKRMQSMQQGESTKDDLLGLMLESNMRGTDDKGQPILGMTIEEVIEECKLFYFAGSETTSVLLTWTMIVLAMHPEWQDRAREEVLGLFEKKKPEYDGFSKLKTVTMILYEVLRLYPPAVAFMRKTYKEIEIESITYPAGVIIELPVLLIHHDPDIWGSDVHEFKPERFADGIAKASKDPGAFLPFGWGPRICIGQNFALLEAKMALCMILQHFEFDLGPTYSHMLHNQKMLRPMHGAQIKLRAI

SEQ ID NO: 10122 - protein, 136 aa, Prunus persica
MAEENQVIGCHTTQAWEEQLHKGNENKKLVVVDFTASWCGPCRLIAPILAELAKKTPEVTFLKVDVDELRTVSEEWGVEAMPTFLFLKEGKIVDKVVGAKKDELQIKVAKHVAAAAAASATSASATAATATATASA

SEQ ID NO: 10123 - protein, 442 aa, Tropheryma whipplei str. Twist
MAEKVLIVGGGFAGFGIARILRKKLRYFEVSLVDPLPYMTYQPFLPEVAAGSIEPRNAVVGHRRHLAGVRIISGSVTSVDHTKRVALVTPRCGEPWEEAYDQIVITAGAVSRTFPIPGVSDCAVGLKSIEEAVFVRDTLLSNYEHAAVLPPGPLRSKLLTLTVIGGGFAGIEAIAELRSLATAKVKGSTNIDLSETRFYLVEAANRIMPEVSLKSSKWVIDNLTRRGVDIRLETQLKSCVDGKIELSDGHSYESGLILWTAGVMANPEVAKGSSMPLDNRGRITVLPTLQICDGDKLIPHAWAAGDIAAVPDMSGGGVQGFCVPNAQHAVRQAKCLAKNLCLMQSGRMPRNYLHVTKGSVAGLGVGVGVLQYGRIAVRGFFGWFVHRAYHSLAVSVVERRVRITLDWFSGFVFKRNTVGLRNLDSPRAGFQRWAAKGGKKPS

SEQ ID NO: 10124 - protein, 241 aa, Magnaporthe grisea 70-15
MASPDSQPKPKPSSNGATTGDPAIKLGHQQRQKIFTPPNFALLLCLLLSLVNFYHLQKPGRASVIYVQEPSTPIPPTIYKNTAKMSTEQTFIAIKPDGVQRGLVGPIISRFEQRGYKLVAIKLVTPGKAHLEQHYADLKDKPFFAGLVEYQPADMNSGPIAAMVWEGRDAVKTGRTLLGATNPLASAPGTIRGDYAIDVGRNVCHGSDSVENAKKEIALWFKEGEVVSYQASQASWIYEKP

SEQ ID NO: 10125 - protein, 335 aa, Silicibacter pomeroyi DSS-3
MARTLSMKDAINEALDQEMTRDPTVIMMGEDIVGGAGAAGEDDAWGGVLGVSKGLYHKHPKQMIDTPLSESAYVGAAIGAATCGLRPVAELMFIDFMGVCLDQIYNQAAKFRYMFGGKAETPVVIRAMCGAGFRAAAQHSQMLTPIFTHIPGLKVVCPSNAYDTKGLLIQAIRDNDPVIFLEHKNLYASECDVPEEPYAIPFGEANIAREGSDVTIVTYGLMVPNSLAAAETLKKEGIDVEVIDLRTLSPIDMDTVIESVENTGRLVCVDEANPRCSIATDVSASVAQDAFKALKAPIAMVTAPHAPVPFSPALEDLYIPSPDRIAAAVRKTMGA

SEQ ID NO: 10126 - protein, 534 aa, Mesembryanthemum crystallinum
MGICASKNKATQPEDNGYTPANGVGSNNQSKPPAQQNYHQQPPQQPVAPPQPASHPPVRMPSPKPAPKVEPNTILGKPFEDVKVYYTLGRELGRGQFGVTYLCTDKKTGQQYACKSISKKKLVTKADKDDMRREIQIMQHMSGQPNIVEFKGAYEDKTSVNLVMELCAGGELFDRIIAKGHYSEKAAATMLRQIVNVVHVCHFMGVMHRDLKPENFLLSSKDENSLLKATDFGLSVFIEEGKVYRDIVGSAYYVAPEVLRRRYGKEIDVWSAGVMLYILLSGVPPFWAETEKGIFDAILQGHIDFESKPWPSISNGAKDLVRKMLTQDPKKRITAAQVLEHPWLRDGEASDKPIDSAVLLRMKQFRVMNKLKKLALKVIAENLPDEEIQGLKQMFANMDTDGSGSITYEELREGLARLGSKLTETEVKALMEAADQDGSGSIDYYEFITATMHRYRLERDEHLYKAFQYFDKDNSGFITTDELETAMKEYGIADENCIAEILLEVDTDNDGRINYDEFSAMMRSGTQNPVTKLI

SEQ ID NO: 10127 - protein, 136 aa, Glycine max
PPRIFGALGEYAKVNLFFLGGAIAPFLVWLAPKAFPKQKWIPLIPTPVLLGAPSIIPPPPPVNFPSWKLVGFFSGSIAFRSPQKWWKPSNYVLFGGFNAGTPFMPILLFFALTKNNIMFNWWGNTPKGCPLANFPP

SEQ ID NO: 10128 - protein, 410 aa, Oryza sativa (indica cultivar-group)
MNALAATSRNFRQAARLLGLDSKLQKSLLIPLREIKVECTIPKDDGTLATFVGFRVQHDNSRGPMKGGIRYHPEVDPDEVNALAQLMTWKTAVAAVPYGGAKGGIGCTPGELSRSELERLTRVFTQKIHDLIGINTDVPAPDMGTNAQTMAWILDEYSKFHGHSPAVVTGKPIDLGGSLGRDAATGRGVMYATEALLTEYSDHFRINLVIQGLGNVGSWAAKLIHQKGGKIVAVGDVTGAIRNKSGIDIPALLKHRSEGGSLEDFYGAEVMDAAELLVHECDVLVPCALGGVLNRENAAEVKARFIIEGANHPTDTEADEILAKKGVIVLPDIYANSGGVVVSYFEWVQNIQGFMWDEEKVNRELQKYMKNAFQNIKDMCKSQNCNLRMGAFTLGVNRVAKATLLRGWEA

SEQ ID NO: 10129 - protein, 269 aa, Triticum aestivum
MASPYLLHRLTADEIFQTLEASSSTSSSCYDAFVPVFRPDPSASSLSVSAADRVRSQFLSVERDLFHDALVAPRNDDLGFPEENDEEEEASIRWDCFQLDEEEEPDLPLEASVPAEEFDWEEVAFASGPLVENPEPDWEMLGDMPPSAPAGANEGFVYTSDREAYEVLVAVGDGLFLTNKPPAARSAVKALPSAIVAAGEEGEGEECSVCKDGVVAGERVKMMPCSHRYHEDCILPWLEVRNSCPLCRFELPTDNPKYETWKAGRAMAT

SEQ ID NO: 10130 - protein, 334 aa, Zea mays
  misc_feature (158)..(158): Xaa can be any naturally occurring amino acid
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLXPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 10131 - protein, 128 aa, Glycine max
  misc_feature (51)..(51): Xaa can be any naturally occurring amino acid
VCSMISSPAVTTVNRAGACMVAPFTALKSMVGFPWRKTTIDITFVAINGGXVQCMLVSPPIANKKFETLSYSPYLNDAQLLYEVKYHLKTGWIPCSQFDTDHGLGYHDHNRAPGYYYGLYWTMWKLPM

SEQ ID NO: 10132 - protein, 554 aa, Mycobacterium avium 104
MTSVHTLPDITATPAWDALRKHHDRIGDTHLRQFFEEDPDRGRELTVTVGDLYIDYSKHRVTRETLRLLVDLARTAKLEERRDQMFAGVHINTSEDRAVLHTALRLPRDAELIVDGRNVVADVHEVLDAMGEFTDRLRSGEWTGATGKRISTVVNIGIGGSDLGPVMVYQALRHYADAGISARFVSNVDPADLIATLADLDPATTLFIVASKTFSTLETLTNATAARRWITDALGDAAVAHHFVAVSTNKRLVDDFGINTDNMFGFWDWVGGRYSVDSAIGLSVMAVIGREAFADFLSGFHIVDRHFQTAPLESNAPVLLGLIGLWYSNFMGAQSRAVLPYSNDLARFAAYLQQLTMESNGKSTRADGSPVTTDTGEIFWGEPGTNGQHAFYQLLHQGTRLVPADFIGFSQPIDDLPTAEGSGSMHDLLMSNFFAQTQVLAFGKTAEEIAAEGTPADIVPHKVMPGNRPSTSILANRLTPSVLGQLIALYEHQVFTEGVIWGIDSFDQWGVELGKTQAKALLPVITADNSPAPQSDSSTDALVRRYRSERGRTS

SEQ ID NO: 10133 - protein, 420 aa, Rhizobium tropici
MVEKRFPAAGRDAMAYVLAGGRGSRLKELTDRRAKPAVYFGGKTRIIDFALSNALNSGIRRIGVATQYKAHSLIRHMQRGWNFFRPERNESFDILPASQRVSETQWYEGTADAVYQNIDIIEPYGPEYMVILAGDHIYKMDYEWMLQQHVDSGADVTIGCLEVPRMEAVGFGVMHVDDKDRIIDFVEKPADPPGIPGNPDFALASMGIYVFHTKFLIECLKRDAADPNSSRDFGKDIIPHIVKNGKAVAHRFTQSCVRSDFEREAYWRDVGTIDAYWQANIDLTAVVPELDIYDKSWPIWTYAEISPPAKFVHDDEDRRGSAVSSVVAGDCIISGASLYNSLLFTGVRANSYSKLEGAVVLPSVKVGRRAQLKNVVIDHGVTIPEGLVVGEDPELDAKRWRRTESGICLITQSMIDKLDL

SEQ ID NO: 10134 - protein, 304 aa, Arabidopsis thaliana
MALLRLPGISLQILGHKSNQKNPNPNVAFTNHSLSLSTPSLCRLHRHATFPDSIPAKSRNLTSYFSTTTQEPVLESSSSSSSAPEVVEEEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIRLAKSKQFVKLQAKEGLQPPEEEAEEEPSQSETMTQEHETPAA

SEQ ID NO: 10135 - protein, 374 aa, Coprinopsis cinerea okayama7#130
MVKITVKTTQQKVHHVEVELTDTIGTVKQKISDEHGHPVAAQKIIYSGKILPDDKTIESCALKEKDFFVLMPKATPAASTSTTPAPATPAPAAAAPATAPTPAAAPAPAPSPAAPAPAAAPSEATTAAPAQEGFGTGSFLSGAAYQNAVQNLVEMGFPQEQVVRAMRASFNNPDRAVDYLMNGIPAHLEAEAAGPAAPAPAAGGAPAAAAAPAAQAPAPAPAAPANQPQNLFQLAQQQQQGGGGAGAGGPTLPGGLNIETLRNNPQIAAIRQAMAQNPQAAQALIQQLAQQNPQIAQIIGSDPDLLTNLFLPGEGDIPPGATVVNITPEENAAIERLQGLGFPREVVIQAYFACDKNEELAANYLFEHGFDDDD

SEQ ID NO: 10136 - protein, 450 aa, Yarrowia lipolytica CLIB122
MPNWTVDPANKKRLLALQKDGANKKCFDCDAPNPQWASPKYGIFICLECAGVHRGLGVHISFVRSISMDQFKPDEMERMEKGGNQRAHEFFDKAGMARDTPIKQKYNSVVARNYMNYLTSEIEGTEYVPEKEGATPSVAPSKSRDSSRSGESDLTPQGSNVAFFEGLGAKNASRSADVRPSEGGKYSGFGNTPAPVSSNNRPGATITMDNFQADPLGTLTKGWGLFSKTVSQMSTEVNNQYIKPTVQNIQESEYTKTALEHAQKLGETVQKESKRGLDRFHEFVEGNEGDPQGYSRPGESRNLIQYEDESDEDPFSHLKPKGKSNMTGFGKTADGEDWGEWNEWDDDGVEDEDEDEQVAKVTKDAVPPAAAPSATEAPKAKKPSAKERALAAKAEAEKAAKEAEAKEKTEKVDGAEEKEAEKVEEQDKEPLEEVEPEAEPEMEPKSKKDD

SEQ ID NO: 10137 - protein, 875 aa, Staphylococcus epidermidis RP62A
MTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICERYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEEALKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIISVDGSAGDLYLGAIETVNAEHSEEFDQFMTWSEEIARLQVRMNAETPQDIKAGYDFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGVTCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRQFNQWEIDYVSCSPFRVPGAILATAQSQAEESER

SEQ ID NO: 10138 - protein, 446 aa, Tropheryma whipplei str. Twist
MYSCTGFSRRVCTWWKSVMCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 10139 - protein, 496 aa, Yarrowia lipolytica CLIB122
MSLFSKLTLANGLEVDQPTGLFINGEFVAAKSGKTFETINPTTEEVICSVSEADEEDVNAAVDAAAAAFKTWGFKTAPSARGAALFKLADLIERDLDIIAAIETTDNGKVYAHAKGDVALVVKVIRFYAGYADKIYGDVIHGNDGHFSYTRKEPIGVCGQIIPWNFPLVMWSWKIAPALATGNTVVLKSAESTPLSALYAAKLAQEAGIPAGVLNIVSGYGKVGALMTNHPKIRKVAFTGSTATGKQVLKGAALSNLKKISLELGGKSPNIIFDDANLPNAISWAALGIFFNSGEVCAAASRLYVQEGVYHEVVAALKQRAEALVVGDPFDQQTFQGAQTSKIQFDRVMSFIEAGKAEGATLLTGGCRAKDKGYFIRPTVFTDVKKDMKIVQEEIFGPVVVVTKFKTLEEVIELANDSEYGLAAGVHTQDISRAHYLAENLHAGTVWVNTYNSFHISLPFGGFNQSGFGKEMGKDGLDSYIQTKAVRIMFDQAKLQ

SEQ ID NO: 10140 - protein, 341 aa, Agrobacterium tumefaciens str. C58
MTERLEDIAIKMVADGKGLLAADESTGTIKKRFDSINLESTETARRDYREMLFRSDDAMKKYISGVILYEETLFQKAADGTPFVDIIKAAGSLPGIKVDIGAKPMAFHPHEFITEGLDGLYERLRKYHEAGARFAKWRGVITIGEQRPSWGSIKANSQSLARYAALCQQADIVPIVEPEVLMDGEPGTHDIDRCAEVTQWVLQTVFADLFDARVNLEGMILKPNMIIDGKNARKASVEEVAEKTVKVLKATVPTAVPGIAFLSGGQSSEEATAHLSAMNAGYDLPWSLTYSYGRALQDTALKTWGGKSENVAAGQRAFTHRAAMNSLAAKGNWKQELEKAA

SEQ ID NO: 10141 - protein, 414 aa, Zea mays
MATGPVVHPQPVRGDPIDLKNAAAKNRRALGDIGNVDSLIGVEGGKLDRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLIDCSKLLAFIHSKAGESKLRGVLKKYSKLGRGAVALISPAKSLMSSAP

SEQ ID NO: 10142 - protein, 362 aa, Lotus japonicus
MKNPKRHPSESSLRRVTSEETVTGLKNAHRRRLKIRRMKYSCQAKINAGDGDFPPSGKERREIHESVQISLSLANSSSSSSSEEDRERKRDDGVLPYGSVSVVGSRKEMEDAVSVETGCVTKCDYFAVFDGHGGAQVAEACRERLYRLVAEEVERCGNGVEEVDWEEVMEGCFRNMDGEVAGNAALRTVGSTAVVAVVAAAEVVIANCGDCRAVLGRGGEAVDLSSDHKPDRPDELMRIEEAGGKVINWNGQRVLGVLATSRSIGDQYLRPYVISKPEVTVTKRSSKDEFLILASDGLWDVISSEMACQVVRKCLNGQIRRICNENQSRASEAATLLAEIALAKGSRDNTSVIVIELRGTVT

SEQ ID NO: 10143 - protein, 334 aa, Tropheryma whipplei str. Twist
MSTPSWNRDVDSRREADLTLVSALNLALDDELALDPKLLLMGEDLGALGGVFRVTDRLCKKYGKNRVIDTPLAESGIVGTAIGLAAKGFRLVLEIQFNGFIFPAFNQITTQLARQNFRNKIPMPVVIRVPHGGHIGAVEHHMEAPEAYFAHTPGLRVVNCSTPSDAYWMLRQAIRCPDPVIFFEPLSLYWNKGTVSFSSPDLDLHAASIVRKGNDVTLLGHGGITRTLIAAAEHTRDVSVEIIDLRSLSPVDYETILASVKKTGRLVIAQESPGFVSLGSEIAATVSEKAFYHLEAPVARVSGYDTPFPPAKLEKVYLPDVDRVLTAIKGVMSH

SEQ ID NO: 10144 - protein, 537 aa, Candidatus Protochlamydia amoebophila UWE25
MEFRMSKTSPSHFFNYSASKKLQELAKHPLDLTKELTPERVTQYVAEAGGFKLLYGTERVTNDVLAALKQLSEESHALDKMNRMQDGEVMNFIERFPSENRPALHTATRDLFDYPRTAKKAQEAAQLAKAELEKLRQFLEKNDQNYHFTDLVTVAIGGSDLGPRAHYHALEHLLKPGHHVHFISNVDPDDVAGVFRKIPDLKRTLVAVVSKSGTTLETATNEELVREKFRQAGLDPKKHFVSITMPGTPMDNQEQYLKTFYMWDWIGGRYSTTSMCGALMLSFAFGINTFWEFLKGAHEMDRIALETNLNKNLPLLAALLGIWNRNFLDYPTVALIPYSQALLRYTAHIQQVDMESNGKHIDQQGIMTNFHTGPIIWGEPGTNSQHSFFQLIHQGTATVPVSIIAFKENLYGEDLEFQGTTSQEKLLSNLFAQSLALATGQISENPNKTFLGNRPTNILLAKKLTPYTLGALLSFFENKVAFQGFIWGINSFDQEGVQLGKVLANRLINEFANQRKKTKPSSFAIGEAYLKHLDHFS

SEQ ID NO: 10145 - protein, 116 aa, Streptomyces avermitilis MA-4680
MSHLLDSVDSASLRSDLPAFRPGDTVNVHVRVIEGNRSRVQQFKGVVIRRQGAGVRETFTVRKVSFSVGVERTFPVHTPIVEKIELVTRGDVRRAKLYYLRELRGKAAKIKEKRES

SEQ ID NO: 10146 - protein, 432 aa, Oryza sativa (indica cultivar-group)
MAAAAAAASATAAISGALLPHAVACHRLPPRPQLLAVSSSFRRLSLTASPRRASHLVPRADASAEAGEPEPAAEAEAEAVAASTDAEVEEGEAEAAVAVAEEEQEEEDEPPPPSKPPVKFGEIIGILNKQFIEEAEKVKTLPDLRPGDIIELRMQRPNKRRLSLFKGIIIAKHKSGVHTTIRVRRIIAGVGVEITFPILRYSPRIKEIKVIRHKKVIPCLIVGKMIGTSSASSWKERPDFTLNEDNEGKGVAMGGGGTLISIYPEDLTFLFELDKPCYCNLKVVNNSEHHVAFKVKTTSPRKYFVRPNANIVQPWDSYTITITLQAQKDYPQDMQCKDKFLIQSTRVAASTDMDEIPPDTFNKEVDKVIEEIKLKVVYTVPSGSSDDSGITSLGSRSFKSLSDDFTMLKNASIEEVMQLILKASLILSGNYT

SEQ ID NO: 10147 - protein, 120 aa, Haemophilus influenzae 86-028NP
MIKCLPRLFIGNIMETLDKIKKQISENPILIYMKGSPKLPSCGFSARASEALMHCKVPFGYVDILQHPDIRAELPTYANWPTFPQLWVEGELIGGCDIILEMYQAGELQTLLAEVAAKHA

SEQ ID NO: 10148 - protein, 131 aa, Medicago truncatula
MASEKEAALAATPPDADSPTIFDKIINKEIPSTVVYEDDKVLAFRDIQPQGPVHILLIPKVRDGLTGISKAEERHIDILGRLLYTAKLVAKQEGLDDGYRVVINDGPKGCQSVYHIHVHVIGGRQMNWPPG

SEQ ID NO: 10149 - protein, 263 aa, Xanthomonas axonopodis pv. citri str. 306
MPIRPVGSRPPHSTIATPTTQQGGSSMSHSASRRKLLQCACCAPIAAAAASLPFALRAAPSKKTDLNAEQALEILRDGNNAFVQNRPRKVISDSKRRLELALGQTPFVVLVSCSDSRVPPELLFGRGLGEMFIVRNAGNTVDTTALGSIEYAVSQLGVPLVVVMGHESCGAVAAAVSVVENNTFFPGAIGSMIEPIVPAVLTAKAKGGTDLLADSVKANVKRTVDRLRAASEPALLEPLRAGNVRVVGAYYTLQDGKVDFFDV

SEQ ID NO: 10150 - protein, 92 aa, Arabidopsis thaliana
MASSMLSSATMVASPAQATMVAPFNGLKSSAAFPATRTANNDITSITINSGRVHCMHVWPPIGKKKFETLTHHPDLTDSDLAIEVNYIIRIN

SEQ ID NO: 10151 - protein, 430 aa, Leuconostoc mesenteroides subsp. mesenteroides ATCC 8293
MTYPINEKQHLTVDGVDTIELAKTYGTPLAVYDVTLIRKTMRAFKRIFEQENVPYVVSYAGKAFATKAIYQVAAQENIHADVVSGGELYTAIKADFPTQHLSFNGNNKSYDELVMAVENGVGTIIVDNFLELQLLSEITAEKNVIQDILLRISPGISAHTHEFISTGQQDSKFGFDLQTGQAKQAYDIAIKDNHLHLRGLHAHIGSQIFDVTGFEKNAALLADTAYSWGWQPEVINTGGGFGIRYTDEDQPLPENEFADAIIRVLKEKATQYDWAMPEIWIEPGRSIVGPAGQTLYTVGSRKDIPGIRNYLAVDGGMGDNIRPALYQANYEAVLANQPNAKSEEIVRIAGKYCESGDVLVWQEELPATKPGDILSVLATGAYGYAMASNYNRNPRPAVVFVENGQHQVVVERETFEHMISLDQDYTLGDK

SEQ ID NO: 10152 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGGEFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 10153 - protein, 307 aa, Staphylococcus epidermidis RP62A
MNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSVDAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNLESAIRLANQASSLTVQRKGAQASIPTRKEVEAEYN

SEQ ID NO: 10154 - protein, 426 aa, Agrobacterium tumefaciens str. C58
MRPDRLASAIRHSMVRPELATNQDRPMPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 10155 - protein, 336 aa, Agrobacterium tumefaciens str. C58
MTVKVAINGFGRIGRNVLRAIVESGRTDIEVVAINDLGPVETNAHLLRYDSIHGKFPADVKVEGDTIIVGGGKPIKVTAVRDPATLPHKELGVDIALECTGIFTARDKAAAHLTAGAKRVIVSAPADGADLTVVFGVNDDQLTKDHLVISNASCTTNCLVPVVKVLDDVIGIDHGFMTTIHSYTGDQPTLDTMHKDLYRARAAALSMIPTSTGAAKAVGLVLPHLKGKLDGTSIRVPTPNVSVVDFKFIAKRDTTVEEVNEAIKSASNGKLKGILGYTEEPLVSRDFNHDSHSSIFAIDQTKVMEGNFVRVLSWYDNEWGFSNRMSDTAVAFAKTI

SEQ ID NO: 10156 - protein, 922 aa, Astragalus sinicus
MELQHIWMLRLVVACALFLCIFFRSTSAVEGFESIACCADSNYTDPRTTLNYTTDYIWFSDKQSCKQIPEIVLSQRSNENVRLFHINEGKRCYNLPTIEDKVYLIRGTFPFDSFDSSFYVSIGVTQLGEVRSSRLQDLEIEGVFKATKDYIDFCLVKGEVNPFISQIELRSLPEEYLHDLPASVLKLISRNNLGDKKDDIRFPVDQSDRIWKATSNLSSALPLSFNVSNVDLRGNLTPPLQVLQTALTHPERLQFIHDGLDTEDYEYSIFLYFLELNSTIIAGQRVFDIYLNNEVKKERFDVLAGGSKYSYTILNISANGSLNITLVKASQSKFGPPLNAYEILQIRPWIEETNHIDVKVIQKLRKELLQNPENKALESWTGDPCILFPWKGIKCDGSNGSSVINKLDLSSSNITGPIPSSVTEMTNLEILNLSHNSFVGHIPSFLRSSLLISVDVSYNDLTGPLPESIISLPHLKSLYFGCNHHMSEEDPAKLNSSRINTDYGKCKVKEHKHGQVFVIGAITGGSLLITLAVGILFFCRYRYKLIPWEGFGGKNYPMETNIIFSLPSKDDFFVKSVSIEAFTLEYLEVVTEKYRTLIGEGGFGSVYRGTLDDSQEVPVKVRSATSTQGTREFDNELNLLSAIQHENLVPLLGYCKEKDQQILVYPFMSNGSLLDRLYGDAAKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLTGNWGVAGEPLNIKRPRTEWSLVEWAKPYIRASKVEEIVDPGIKGGYHAEAMWRVVEVALQCLEPYSTYRPCMVDIVRELEDALIIENNASEYMKSIDSLGGSNRYSIVLDKRVLPATTSTAESTITTQALSHPQPR

SEQ ID NO: 10157 - protein, 660 aa, Agrobacterium tumefaciens str. C58
MISRDKHNRMANAIRFLAMDAVEKANSGHPGLPMGAADVATVLFTRYLKFDPKAPLWADRDRFVLSAGHGSMLLYSLLYLTGYEDMTIDEIKRFRQFGSKTAGHPEYGHATGIETTTGPLGQGIANAVGMAIAERKLEEEFGSDLQSHFTYVLCGDGCLMEGISHEAIALAGHLKLNKLVLFWDDNNITIDGEVGLSDSTDQIARFQAVHWNTIRVDGHDPDAIAAAIEAAQKSDRPTFIACKTVIGFGAPNKQGTHKVHGNPLGAEEIAAARKSLNWEAEAFVIPEDVLDAWRLAGLRSTKTRQDWEARLEATETAKKAEFKRRFAGDLPGNFDSSIDAFKKKIIENNPTVATRKASEDSLEVINGILPEMVGGSADLTPSNNTKTSQMKSITPTDFSGRYLHYGIREHGMAAAMNGIALHGGLIPYAGGFLIFSDYCRPSIRLAALMGIRVVHVLTHDSIGVGEDGPTHQPVEQIAALRAIPNLLVFRPADETETAECWQLALEQKHRPSALALTRQNLTPSRKEYEEKNLSAYGAYELVSASDAKVSIFASGSEVEVALKAAATLKDKGVSARVVSVPCFELFKEQPETYRNAIIGKAPVKIAVEAAIRQGWDYFIGNDGAFVGMHSFGASAPAKDLFKHFGITAEAVVAAVEAKLA

SEQ ID NO: 10158 - protein, 159 aa, Zea mays
DLLAPSSTPKAFEMNHCKGKRKELSPQDAALLIQMNYRAHLAHRSQVLRCLRDLAVAKAKLKEIRSFFYNITYRRRIAYDNEELQRFAEKIIVLLLTVDALEGPDYMVRNARRSMLEELEGMLEIVEPQPPGKPRTLSRRRFDLPEGGAIEKETREAGK

SEQ ID NO: 10159 - protein, 749 aa, Aspergillus oryzae
MGHLVTLATCSLNQWALDFEGNCERIIESIRQAKKAGATLRVGPELEITGYGVLDGFLEGDTFLHSWEMLARIIDHADCQDIVVDVGMPVRHRNVRYNCRVIFYNRKIILIRPKMWLANDGNYREMRYFTPWQRPQEIEDYYLESIVGKITGQYKVPFGDAVISTRDTCLGLETCEELFTPNGYALQLRNCDYHANIYVGLIFLMVLPVWPSLQDRPLTSPIGVEIISNSSGSHHELRKLDTRINLVTQATKLSGGIYLYANQQGCDGDRLYYDGCAMIVVNGNIVAQGSQFSLNDVEVVTATVDIEEVRTYRSSASRGMQASKQTPFVRLDLDMRLSRQNEEADPGLAPSEAIAPRYHAPEEEVALGPACWLWDYLRRSGAAGFFLPLSGGIDSCATAIIVHSMCREVIKAVSEGNEQVIKDVRRLCAEPADSTWLPTTSQEVCNRIFHTSYMGTQNSSKETRDRSKRLSTDIGSYHVDFNFDTVVTSLTNLFTMVTNFQPKFKVHGGSRAENQALQNVQARLRMVLSYLFASLLPTVRQRPGGGGLLVLASSNVDAECLRGYLTKYDASSADLNPIGSISKVDLKKFIAWSRDSFELPILHEFLNATPTAELEPITSTYVQSDEADMGVTYAELSTFGYLRKIAKLGPWSMYERLLHVWGNEYSPREIYEKTRHFFYNYAINRHKMTVLTPSYHAEQYSPDDNRHDLRQFLYPSFTWAYKKMEDSVKYWESKGWTAGKAQKKNVKAD

SEQ ID NO: 10160 - protein, 505 aa, Silicibacter pomeroyi DSS-3
MNAPKPVVLCILDGWGLSDDKTANAPYLAKTPTFDAIMTKGPHARLITHGPDVGLPSGQMGNSEVGHTNIGAGRVVAMDLGQIDLAIEDGSFFDNAALRDFIARTRAAGGTAHLMGLVSDGGVHGHLNHIIAAAQAITNAGVPVVMHAITDGRDVAPKSAYGFMAELEDRLPKGARIVTVTGRYFALDRDNRWERVQEAYDAMVRGEGRRVSTAHSAIDYAYNQSESDEFITASVLTGYDGMRDGDSLFCLNFRADRAREILRAIGEPGFADFDTGARPALSALLGMVEYSDAHNAYMTTVFPKRDIVNTLGAWVARHGLRQFRLAETEKYPHVTFFLNGGKEEAEPGEDRFMPKSPKVATYDMQPEMSAPEVTDKFVEAIGAGYDLIVTNYANPDMVGHTGDLKAAIKACEAVDQGLSRVIAALEQAGGAMIVTADHGNCEMMIDPETGGPHTAHTLNPVPVALVGGPAGVTLRDGRLSDLAPTVLALMGLPKPPEMTGESLIT

SEQ ID NO: 10161 - protein, 273 aa, Frankia sp. CcI3
MPPAAHAVTGATRLFAVVGDPVEQVQAPSLLNPLFDELGLDAVLVPVHARQADFPAVLDGLRRIENLDGILITIPHKAAACALADERSPAAAISGSANALRRGPSGRWQADNFDGAGFVRGLTAAGRPVAGTRVSLLGAGGAGSAIAAALLDAGSTRLSIYDPDREKRDGLLARLDEHWPDRAVGVATPLLHDVDLAVNATPLGLRPNDPLPFPPDGLAAGCVVADIIMKPPDTRLLRAAAALGLPTHPGIHMLAHQIGFYRSFFDLVPAAPA

SEQ ID NO: 10162 - protein, 371 aa, Pseudomonas syringae pv. syringae B728a
MSTVTERTAEQLSPVIPKTMQAVVCHGPEDYRLETVDVPTPGPDEILTKVELCGICMGDIKTYRGAPSFWGDAEQPRYVKPPMIPGHEFVCRVVALGPGAEKRGVQIGDRVISEQIVPCWGCRFCNHGQYWMCQKHDLYGFQNNVQGAMAQYMIFTREGIIHKVPDSIAPDEAILIEPLACSLHAAERADVDFDDIVVVAGAGTLGLGIIGAVRMRNPKKLIVLDMKPERAALALRMGADEVWNPAEVDVLAKIREITDGYGCDIYIEATGHHKAVNQGLAMLRKLGRFVEFSVFNDEATVDWSIIGDRKELDVLGSHLGPYMYPRAIDFIGNRKIDMRDVVTHKFPLAQFKEAFAVMERGDKSLKVVLEP

SEQ ID NO: 10163 - protein, 175 aa, Hordeum vulgare subsp. vulgare
  misc_feature (88)..(88): Xaa can be any naturally occurring amino acid
MAAAGDAGEKKMITLKSSDGEEFEVEEAVAMESQTIRHMIEDDCADNGIPLPNVNSKILSKVIEYCNKHVQAKPADAGASSDTASAAXGAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 10164 - protein, 513 aa, Synechococcus sp. WH 7805
MTISSPSRPYLDGKKLNKIEQNKAAKDGLLVGPEIEKFAEIGWEQVDETDLQLRLKWYGMFWRPKTPGQFMLRLRVPNGVLSAQQLRVVASIVERYGESGSCDITTRQNLQLRGVLLNDLPEILKRLKEAGLSSIQSGFDNPRNVTGNPLAGIDPNEIVDTRPYTTELQNFLTNSCQGNPDYSNLPRKWNTAVAGAKDNFLLHNDIVFHPVERDGEMGFGVWVGGILSSQMNAYAIPLNAWVRPDEICRITDAVISLWRDNGERDKRPRGRFRFYLDALGIDAFRSKVETLFGPLTPDPGSVFATTPRSHYGIHPQKQEGLSFAGLHVPVGRLTAQDLQDFAAASLEYGSGEVRLTEDQNVIMVGLPDGAIPAFKADPLLQRFPLEPGSIAAGTVSCTGNTYCSFGLTNTKDQALKIAQELDQELNLSEEVKIHWTGCPNTCGQAFMGAIGLTGTKAKNSDGVMGEGYMLTTGGSQGENPTVGEVKQKAIPADQIKTVLKNLLVEQFGATAKS

SEQ ID NO: 10165 - protein, 347 aa, Oryza sativa (japonica cultivar-group)
MGVSASCLWGGSESRGNQNGSAAVTSPRSGQVISRAGSNVRVFSLKELKLATRNFHMMNCVGRGGFGAVYKGNLKDGTQIAIKKLSAESKQGANEFLTEINVISNVRHPNLVKLIGCCVEGTNRLLVYEYAENNSLAHALLGPRSRCIPLNWQKRAAICIGTASGLAFLHEEAQPRIVHRDIKASNILLDKKLLPKIGDFGLAKLFPDTITHISTRVAGTMGYLAPEYALLGQLTKKADIYSFGVLVLEVISGESSSKSTWGQDMNVLVEWTWKLREQGRLLEIVDPELEEYPEEEMLRFIKVALVCTQATSQQRPSMKQVVDMLSNPTEISLENLVAPARRTMNKN

SEQ ID NO: 10166 - protein, 345 aa, Kluyveromyces lactis NRRL Y-1140
MFSGFSGYGNAYANIPQRLEEFFRCYPIAMMNDNIRKDDANYGGKIFLPPSALNKLTLLNVRYPMLFELKSQESGKVTHGGVLEFIAEEGRVYLPQWMMETLEIQPGSVLQICSTDVPLGQFVKLEPQSVDFLDISDPKAVLERVLRNFSTLTIDDIIEISYNNKVYRIRILEVKPESSSKSICVIETDLVTDFAPPVGYVEPDYKSQKKQTPSFDPSIKGLGSMSKRINYAEILDPTDKDKSFHGEGQKLSGKAIKPKEDDIKEISVSLDGNPAPLNLPEGQLFFGFPYVPPKSDDGEDNEIASSKVFQGEGKSLRQSAKRKDKGSHQGSKTKAPKSPEVIEID

SEQ ID NO: 10167 - protein, 241 aa, Glycine max
HNRRRTQEMESGGNGKRAHEEAGPSSGIDGRKLEMTEKASDDDKEEEEEEEEEEEGAIEDSKNGFFVPGPLLSLKEQIERDKEDESLRRWKEKLLGCLESDIDGQLDPKVKFHSIGILSEDFGEIVTPLPVDENRNGCTLFTLREGSRYQLKLKFSVLHNIVSGLTYSNTVWKGGLQVDQSKGMLGAFAPQKEPYVYALKEDTTPSGALARGVYSAKLKFEDDDRRCHMELKYLFEIKKRS

SEQ ID NO: 10168 - protein, 437 aa, Arabidopsis thaliana
MDRISNLPDGVIYRVISLLSTKEATCLKYTSKNWLNLVTIIPIAVFVDSSASAISASFKDFADRIMLARLASHRIRRFSLKLQSLNFAQYKTVNDCLRNVLECGVLDLELDINVRGDYSLPSEIFTCKSVVKMKLGSGFVIDILPKNAWLPALKTLLLDTVRFEFDNTAGCSFTKLISACPVLEELVIDGHNCEDWKWSRRVSSQILKRLTIRRKEWVHDGSSFEPISLDIPSLEYFKYFDTLRDSYPVVKLNSLVEAKLELPSLYIGDTYNVRNLIKGLKNVQILRLGAVDTMHLFWVFREAVPVFENLFHLSVSTHDAICWDDLRILLEKSPNLKTLTIEALHYHGYGDENSVCECLDGYSFLLSCPIEILKITEFGGEIEEMEQVEYVLENLLCLVLLEIHVKTKKIDRKLQILADLLMLPRASSKCKVQVKFV

SEQ ID NO: 10169 - protein, 288 aa, Leuconostoc mesenteroides subsp. mesenteroides ATCC 8293
MYEGINLITAIITPFTVNDEIDYESLEKLIEHLLNHGSQGFVIAGTTGESPTLSFEEKVELTRFIAKQVGNRALLIANAGSNNTKESVEAAKALSKIEHINGILAVTPYYNKPSQAGMIAHFKAIADASEKPVMLYNIPGRTVVGLTVDSVIELAQHPNINAIKETTSTEFVEAEVEGATGFAVYTGEDAMTLSAYTVGGAGTISVASHLYGDEMSELFSAMNAGNWREAGRLQRYLTPRMNALFAYPSPTPVKTKLAEKGFVREAVRLPLIPLSDAEKLHLNELLEK

SEQ ID NO: 10170 - protein, 339 aa, Kluyveromyces lactis NRRL Y-1140
MRLFQRKGNDLIRQPADLIPCDTFISDPPLRYTKPHRQPELDNEQQVIYHAVLQHFSDPQLRLPVNGHAEDLQDSNNYSTLGDWEKFWLSRECILRYLRATAWNAEQTIRRLHNTLLWRRQFGLADYANLKETATSVANENDTGKISLLGYDRKSQLVLILKNGRQNTDPSFEQIRQIVWFLEAASILAPKGTECWTLIIDLKNHHIDNGGTRSLYEYPPLSLAKQVINIFQDHYPERLYKCLICNVPNSAWTFLKLVYPLIEPEPRKKILYNDPLEIHIESDQLGAEYGGRLDFNYDNSIYWPDLIQTVESRKKVQYEKFEALGANVGIREFEIKRNT

SEQ ID NO: 10171 - protein, 689 aa, Oryza sativa (indica cultivar-group)
MEVADKIVEPKGPLVATAQLPNNVELLKSVVLNPSREGGSSQEQYEKDLLAEGEESFRSEESSDEGGRSSFSGVSHPPEPIDVDLMSTVYVAIDEEKPEPPECLMRGLSVKGASMEDLSVHAMDAKPDVIVCTVNVNGLVEERKVHCAVVAPDAVEAVSSTQASEEKDCVWDASFPPSGNVSPHSSSDSTGAVAATSIRGSSTSTCRSGVLTSESILTVEKTCESAKDSARGNSMESTKTSMSQASDSSGVSDDSNWSNITGSANKPHKGNDPRWRAILAVRGRGNVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPRKHFSEYAARFYAAEVLLALEYLHMLGVVYRDLKPENVLVRDDGHIMLSDFDLSLRCAVSPTLIRASASDSDPRRAGGSFCVQPACMEPSSVCIQPACFMPKLFGQRSKKQGRRPRSELGQGGGAALPELVAEPTSARSMSFVGTHEYLAPEIIKGEGHGSAVDWWTFGIFLHELLYGKTPFKGSGNRATLFNVVGQQLRFPESPSTSYAGRDLIRGLLVKEPQQRLGVKRGAAEIKQHPFFEGVNWALIRCSTPPEVPRHVEAELPAKYGVAEPVASGGGGGKRVVGAEVRSGGKYLDFEFF

SEQ ID NO: 10172 - protein, 108 aa, Buchnera aphidicola str. APS (Acyrthosiphon pisum)
MSIFQKIKKQIQDNIILIYMKGTPEAPSCGFSAQAVQALSFCGEKFAYVNILENPDIRSELPKYANWPTFPQLWIDGELIGGCSIILEMLENGELKKLILKVKKKYQT

SEQ ID NO: 10173 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 10174 - protein, 374 aa, Oryza sativa (japonica cultivar-group)
MATVSGTDRLRDLHAFDDTKAGVKGLVDAGVTTIPYFFRHPPDPLPVASPSEAAAAIPLIDLAKADVDRDHVVSQVTAAAETVGFFQVVNHGVAGELMEAMLAAVRRFNEEPLEAKVPYYTRDVASKVRFSSNFDLFRSPAANWRDTLVIEMWPEPPSPEEIPPPCRGVLEEYAAAARRLGERLLELLSEGLGLPAGYLGREAGCTDGLSVAANYYPACPEPEATMGATKHADPSFLTVLLQDTSGGLQALLDQPRRRWVDVPPVAGALVVNVGDFLQLVSNDRLRSVEHRVLPTGAAGPARVSVACFFRVEYASTRPYVPVVVGGGGARAAAVYRGTTAGEFLAHFNGKGLDGRSALDHFRIPAAASSPPPPL

SEQ ID NO: 10175 - protein, 646 aa, Xanthomonas axonopodis pv. citri str. 306
MCGLAGMLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRDALTLLLRLGYIPAPACIHEHTFKLMPGRVLRIDAQAVAAGAAAHRPDQAQQPFWNAREAMQRALATPFTGTDAQAEEQLDRVLRDAVALRMVADVPVGVFLSGGTDSSIVTAMMQAQSAQPVHTFSIGFEGSHHDEAPLAREVATHLCTDHTELYVSGADALAVVPNLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPDAMVYRGKRGFGAPVSAWLRGDLHGWADDLLAHGALQREGVFAADSVARLWRDFNGGERKWHTHLWTVLMFQAWQAHWREQRAAVVR

SEQ ID NO: 10176 - protein, 496 aa, Staphylococcus epidermidis RP62A
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNGGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGIGRELGKEGLEEYLVSKHILTNTNPEPVDWFSK

SEQ ID NO: 10177 - protein, 864 aa, Cryptococcus neoformans var. neoformans B-3501A
MPRQQSEDELRIRGQAPRSPRSSQGDPLERNSKLEDEEELDLIRRYEDFSTVDWIQDSLHERTFQNKAPRSRIIAQLDRSDGAVGHLWRLIRRALEEGEAYVVISLVGVIIGVSAALISIITTWLSDIKMGHCTTGWWLTRKFCCLEVSDEMEACAEWKNWGGVEPFQWIAYVLFAAAFSFAAAYLVKNFAPYAAGSGISEIKCILGGFIINGFLSVETFFIKGLTLPLAIASGLAVGKEGPSVHVACSVGNVVAKWFSRYERSHLKMREIVTASSAAGVAVAFGSPIGGVLFSIEEMNQTYSNRTMWRSFVCALVATFTLASMDPFRTGKLVIFNVSYDRDWHYFEIPAYILIGIFGGLYGAFVIKFNVQMASFRRKHLSGHGIFEAVALASITAIIGYLNGFLRIDMTEMLSVLFRECEGGGDYNGLCQASSQWRMVNSLLLATIIRTVFIIVSYGCKVPAGIFVPSMAVGATFGRMIGILVKAMYNSYPSAPWFAACAPDAPCITPGTYAFLGAAAAMGGITRLTVTVVVIMFELTGALTYILPAMIVLLVTKAVSDQFGGGGISDHMIKFNGYPFLEKEDKEDPTDHAFIEPIANVMKKDLIILEATGVPLNHVVDIVQHTNYQGFPVVKSHEDQTIVGFVRKNELRIALEKTRRVRNLSFNTTCTFQCIRAIPEDAHELLERPDILIPSQGGRMTVNTGAENREDNGSEISHVDFGQYVDDIPLTVAPKMPLELVMQLFRRMGPRVILVSDQGRLTGLVTVKDVLRHELSEAHHRSRSTHTPLTPSHPAYAQSNGWDTEWTVDDERGHGLEIALEEGLEWTRSKATWAYGAALERWRGIRGQDRRTATFDYELDEGIQG

SEQ ID NO: 10178 - protein, 243 aa, Zea mays
MVSEQSVAELKQTLLATTLELEAAREELRRKEQSIAKLSDLVREVAKERDDARDQAQSLRLLAAQAAPPLVTSSVTDSDCSLASSPVDPFFDPVTSADNRRRCKFSPATPPAAPRQQQQQQQRQPGAGLGSAADAALEMLAAKRPLPHRGRLLAAVMEAGPLLQNLLVAGQLPRWRNPPTVRAPDTLPLGASRAAGFDDAVTLAASGCTKRPMAAALPMLPLTAVLPAASCSPGFIAKRQRLH

SEQ ID NO: 10179 - protein, 448 aa, Pseudomonas syringae pv. tomato str. DC3000
MNMFELSDVPVTSQLKLDAHWMPYTANRNFHSDPRMIVAAHGSYLTDDKGRKIYDGLSGLWTCGAGHTRKEIQEAVSRQLGVLDYAPGFQFGHPLSFQLAEKITELTPGNLNHVFYTNSGSECADTAVKMVRAYWRLKGQATKTKMIGRARGYHGVNVGGTSLGGVNGNRKMFGQLMDVDHLPHTLLASNAYSKGMPEAGGIALADEMLKLIELHDASNIAAVIVEPMAGSAGVIVPPQGYLKRLREICDQHNILLIFDEVITGFGRTGSMFGADSFGVTPDLMCIAKQITNGAIPMGAVIASSEIYQTFMNQPTPDYAVEFPHGYTYSAHPVACAAGLAALELLQRENLVQQVAEIAPHFESALHGIKGAKNVVDIRNYGLAGAIQIAPRDGDAIVRPFEAGMKLWKAGFYVRFGGDTLQFGPTFNSQAQDLDRMFDAVGEALNLID

SEQ ID NO: 10180 - protein, 558 aa, Vibrio angustum S14
MSNAIPEIQKTKCLLIFGYNAADSHPVVARHILKARANGAKIIVCDPRKIESARVADQWLALKNGSNMALVNALANVIIEENLYDKEYVANNTEGFDAFRELVSRYTPESVETTTGLKAEDIRLAARTYAAAPEAMILWGMGVTQYGQAVDVVRGLAGLALLTGNFGREGVGCGPVRGQNNVQGTCDMGMLPHQFPGYQSVEDAEIRAKFEAAWGVSISGKPGYRLTEIGHKVDEGICKAFYVFGEDPAQTEADLAAMRETMRKMELVIVQDIFMTQTAEFADVIFPATSWGEHEGVYSSADRGFQRFYKAITPPGDVKPDWEIFSLLATRMGYPMSYQNTQEIWDEMRHLAPLYTGATYEKMEGLKSVQWPCPTEDHPGTPFLFEGNKFSTPSGKGQFIAAEWRAPLEQPDAEYPLVLSTVREVGHYSCRSMTGNCSALQTLEDEPGYVQMHPDDARQLGIDDQQLVWVSSRRGKVISRANYNERVNKGVVYMTYQWWIGACNELTIEHVDPISSTPEFKYCAVKVENIEDQSWAENYVQTEYSNLKARLKNHVVNA

SEQ ID NO: 10181 - protein, 551 aa, Zea mays
MGGSHSREDLDLSDSDSDDAESRASDNSSDYGTPTPASASSKLASGAGAAATPASIDAIDRHLRQLHLKYNEPISPNPSPGLTLSANPAALNAVKLYLHIGGSSPSAKWIVSDSLAAASFVRTGDDEDDDAPAGGPWCLVVGSKIQARVGPELQLKTFPAQRRVDFVADGVWALKFRHADGFGDFCAKYHSCMFENSYGVAATDEGRAKVFGKDFAAWARPEDGDESIWEDATDGFFSPGPKGSPMPPRTPVLKPLLEDLREFEEPVEEGSGINSLALGALDNSFLVGDKGIEVVRNFEHGIHGKGMSVKFSGGSTNFSTPKKALLMRAETNMLLMSPATDGKPHAKGNGSFEKDGADINLGDITNDSKGAQLDPSESTFLGLDDNRLCRWDMRDRRGIVQNLASATESPVLQWTQGHQFSRGTNFQCFASTGDGSIVVGSLDGKIRLYSKSSMRMAKTAFPGLGSPITHVDVTYDGKWILGTTDTYLILICTIFIDKDGKEKTGFSGRMGNRIAAPRLLKLNPLDSHLAGANSRFREGRFSWMLLSGLWL

SEQ ID NO: 10182 - protein, 175 aa, Triticum aestivum
MAPTVMASSATSVVPFQGLKSTAGLPVSRRSNGSSLGSVSNGGRIRCMQVWPIEGIKKCDTLSYLPPLSTEALLKQVDYLIRSKWVPCLEFIKVGFIFREHNASPGYYDGRYWTMWKLPMFGCTDATQVINEVEEVKKEYPDAYVRIIRFDNMRQVPGVSFIAFNPPGCDDVDKA

SEQ ID NO: 10183 - protein, 538 aa, Zea mays
METVTVVVAPAPVAVTQQPPQHKLAELKPSSFAGVPKSSPATKAKPAKTKKLAGGCGGYVLEDVPHLTDYLPELKSYPNPLQDHPAYSVVKQYFVNPDDTVAKKIVVHKSGARGTHFRRAGPRQRVYFQPDEVTAAIVTCGGLCPGLNTVIRELVCGLHDMYGVATVYGIEGGYKGFYARNTVELTPRSVNDIHKRGGTVLGTSRGGQDTAKIVDSIQDRGVNQVYIIGGDGTQKGAASIHEEVQRRGLKCAVVGVPKTIDNDIAVIDKSFGFDTAVEEAQRAINAAHVEAESAENGVGVVKLMGRNSGFIAMYATLASRDVDCCLIPESPFYLDGRGGLLEFVEKRLRDNGHMVIVVAEGAGQDLIAKSMNFADTHDASGNKVLLDVGLWLSHKIKEHFKKKPSFPITLKYIDPTYMIRAVPSNASDNVYCTLLAHSALHGAMAGYTGFTVAPVNGRHAYIPFYRITEKQNKVVITDRMWARVLCSTNQPCFLTHQDVEGAGLDEEEPQMPLVEGENALVRNPSMCNGNGHLCSGAA

SEQ ID NO: 10184 - protein, 153 aa, Aspergillus oryzae
MSDEQTFIAIKPDGVQRGLVGPIISRFENRGFKLAALKLCSPSKEHLEQHYADLSSKPFFPGLVSYMLSGPIVAMVWEGREVVKTGRTILGATNPLASAPGTIRGDFAIDVGRNVCHGSDSVENAKKEIALWFKPEELQKYKHSQFDWIYEKA

SEQ ID NO: 10185 - protein, 520 aa, Glycine max
MEPLFSSAAAICVVTVLVAVIPIWALKMLNSLWLRPKRFERLLRAQGFHGDPYSLSHHNSNQTLLQQHQLNSQPFPLSDDVAPRVSSLLHHTIDKYGKKSFFWEGRTPKVIITDPNQLKEVFNNIHDFQKPKFSDNVKFLFAGLLNYEGDKWAKHRRIMNPAFHSEKLKNMLPAFSQSCHDMISMWKGMLSSDGKCEIDIWPFLQNLTRDVISQTAFGSSYAEGEKFFRNLRMQGYLLMAGKYKNIPILRHLRTTTTKRMEAIEREIRDSIEGIIKKREKAMENGETSNEDLLSILLESNHKEIQGHGNSRAVGMTKQEVIEECKLFYLAGQETTSSLLVWTMVLLARYPEWQARARDEVFQVFGNQNPNIDGLSKLKIVTMILYEVLRLYPPTTFFSRAPQKDVKLGNLSLPAGIRITMPILFIHHDGDIWGDDAKEFKPERFSEGIAKATKGQISFYPFGWGPRICIGQNFALMEAKIVLSLLLQHFSFELSPVYEHAPTVVLSLQPKRGAHIVLHKL

SEQ ID NO: 10186 - protein, 508 aa, Oryza sativa (indica cultivar-group)
MEEGAKIGREHEQQQQQHGRVNGSGRVAAVGGGSGGGGDEIEIEVAAAAGASPSRQHGGLHGDVQAPTWKRFLAHVGPGFVISIAYLDPSNLQTDLVAGSSHRYSLLWVLLFGFIFVLTVQSLAANLGIITGRHLAELCMGEYPKYVKYCLWLLAELGVIAATIPGVLGTALAYNMLLHIPFWAGVLACGACTFLILGLQGYGARKMEFTISVLMLVMATCFFMELGKVNPPAGGVIKGLFIPRPKGDYSTSDAVAMFGSLVVPHNLFLHSSLVLTRKMPYTSKGRKDASTFFLLENALALFIALLVNVAIVSISGTICANNLSFADTSTCSSLTLNSTYVLLKNILGKSSSTVYGVALLVSGQSCMVATSYAGQYIMQIVLSFVLPFALIPLIKFSSSCTNIGPYKNATSIIRIAWILSLVIIGINIYFFCTSFVAWLVHSDLPRVVNAIISSLVFPFMAAYIAALIYLAFRKVNLSDPFPTNSVSGEIEVQHIQIQEKQEDLGVHL

SEQ ID NO: 10187 - protein, 232 aa, Candidatus Protochlamydia amoebophila UWE25
MNLAWLLAEFIGTFTLIFIGVGAICLNEMNPGSVGLVGIALAHGLAIAVMVSNVGHISGGKLNPAVSIGVLIGGRSDWKTTVAEIFAQLAGAVFAALCLKIIFPTDVTEVTKLGTPVLADGVSMGIGIMAEAILTFLLVFTVYAAAVDPKGAFKSIAGFTIGGVIIFDILVGGGLTGAAMNPARAFGPALVSGEWIDQIVYWIGPILGGLLAGLLYSKLMLKDLTTLSTPSV

SEQ ID NO: 10188 - protein, 264 aa, Candidatus Protochlamydia amoebophila UWE25
MSPSHRPVVITGNWKMYKTVKEACTFAKALLPVVEVSPIQVWIAVPFTAIYPVKQEIRNSRLVIGAQNMNDASEGAFTGEIAGKMVKEAGASFVLLGHSERRHLYKEDNAFINRKVKKALEIGLTPVLCVGETFEERKSGETQQIIRTQIQECLAGLTAEDLKTLIIAYEPVWAIGNGQNAKPEGAQEIHQFCRKIIKEIFSEELAEQIVIQYGGSVNPSNAISLLKQPDIDGLLIGGASLSLETFVEIVNDGGSIFNLKAKLL

SEQ ID NO: 10189 - protein, 458 aa, Pseudomonas syringae pv. syringae B728a
MLNNGLLHSTTSQKTNANYLDRQSKFESNVRSYPRKLPLAIAKAHGVWVTDVEGTTYLDCLAGAGTLALGHNHEAIMASLDSFLTSGMPMHTLDLTTAVKDAFSETLLSLLPGQGRDYCLQFCGPSGADAVEAAIKLAKTATGRHNIISFSGAYHGMTHGALALTGNTAPKNAVANLMPGVQFLPYPHEYRCPLGIGGEAGTEALSYYFTQFIEDVESGVSLPAAVILEAVQGEGGVNPAPAAWLRQIREVTRKHGILLILDEVQAGFGRTGKMFAFEHAGIEPDIIVMSKAVGGGLPLAVLGFKREFDAWSPGNHAGTFRGNQMAMATGLATLEVLQRQNLAGQAAKRGDWLKEQLGLLQQRYPAIGNVRGRGLMLGIEIVDERKAADRLGSLPMDPDLAVAIQQHCFKQGLLLERGGRNGNVIRLLPPLIITEEQCQLVIQRFEQALKAALSQLRK

SEQ ID NO: 10190 - protein, 540 aa, Phanerochaete chrysosporium
MSASAAPPNKLPADFLWGFATASFQIEGATDVDGRGKSIWDDFSKIPGKTLDGKNGDVATDSYNRWREDVDLLVQYGVKSYRFSISWSRIIPLGGRNDPVNEAGIKFYSDLIDALLERGIVPFVTLYHWDLPQALHDRYLGWLNKDEIVQDYVRYAGVCFERFGDRVKHWLTMNEPWCISILGYGRGVFAPGRSSDRMRSPEGDSSTEPWIVGHSVILAHAYAVKLYREQFKANRGGQIGITLNGDWAMPYDDSPQNIEAAQHALDVAIGWFADPIYLGQYPAYMKEMLGDRLPEFTPEELAVVKGSSDFYGMNTYTTNLCKAGGEDEFQGNVEYTFTRPDGTQLGTAAHCSWLQDYAPGFRDLLNYLYKRYRKPIYVTENGFAVKDENSKPLEEALKDDDRVHYYQGVTDSLLAAVKEDGVDVRGYFGWSLLDNFEWADGYITRFGVTYVDYDTQKRYPKDSGKFLSQWFPAHIAESPKPAAETKKAATPSPLKPHGAISNGVSKKSSATKEPKSASRKKGRKAPFARFTAYISAFLGL

SEQ ID NO: 10191 - protein, 472 aa, Neisseria meningitidis Z2491
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDTLVPTVCASLEEALAALKADHEFLLRGGVFSKDWIDSYIAFKEEDVRRIRMAPHPLEFEMYYSL

SEQ ID NO: 10192 - protein, 260 aa, Zea mays
MNRLASTRFTAALTRSVLPQCRRPIGRALCSGAPQNGEMEAAVREVVCFGSGSLDEVGSRLDRLGVAVSPHLIGRVIDSCGETGGGSGRRLLRFLAWCRSKHSGVLGEEALDRAIGVLARAGDLTAMRIAIADAEKDGRRMAPETFSTVIDALVKAGREDEAVRLFRGLERQRLLPECGSRVGGHGVWSSSLAMVHALCKRGHAREAQGVVWHHKSELSAEPMVSIVERSLLHGWCVHGNAKEARKVLNEMKSSGVPLGL

SEQ ID NO: 10193 - protein, 130 aa, Sorghum bicolor
ARVVPLVAALLVLLALAVSSTRNRNAQEGEESMALDGGIKDVPANENDLHLQELARFAVDEHNKKANALLGYEKLVKAKTQVVAGTMYYLTVEVKDGEVKKLYEAKVWEKPWENFKELQEFKPVEEGASA

SEQ ID NO: 10194 - protein, 449 aa, Desulfotalea psychrophila LSv54
MDPIIQQLHAKDQDQHEFHQAVEEVLESVKPVLDRNLWYRQQGVWERLIEPERVIMFRVPWVDDEGNVRVNRGFRVEMNSALGPYKGGLRFHPSVNLSIIKFLAFEQTFKNSLTTLPMGGGKGGSDFNPKGCSDFEVMRFCHSFMLELYRHIGPNTDVPAGDIGVGAREIGYLFGMYKKIKNEFTGVLTGKSLGWGGSLIRPEATGYGNVYFASEMLTTRDQTIEGKSCLVSGSGNVAQFTIEKILDLGGKVHTISDSDGYIYDEEGIDCDKLGWIKQLKNIRRGRVAEYVETYPQAVYTPIDPTLGYNPLWDHSADCAFPSATQNEINEQDAKNLVKNGVFLISEGANMPSSPEAVAVFHDANCLYGPSKAANAGGVAVSGLEMSQNTIRMSWPREEVDTRLKQIMHSIHSTCVDAASEYNYGQNYVAGANIAGFVKVVNAMLDQGVV

SEQ ID NO: 10195 - protein, 187 aa, Glycine max
MGMAAEAQFHVLAVDDSLIDRMLIERLLKTSSFHVTAVDSGSKALKFLGLVEEKRNEEPPPCIALESHQDVEVNLIITDYCMPEMTGYDLLRKIKESKSLKDIPVVIMSSENVPARINRCLEEGADEFFLKPVQQSDVNKLRPHLMKSKVKDGEDQQISNKRKETEESHSPDKTRTKMEPQKVVNFS

SEQ ID NO: 10196 - protein, 343 aa, Haemophilus influenzae 86-028NP
MKDLDWNNLGFSYIKTDYRFIAHWKDGKWDEGKLTTDNTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFYSETEVGPVTRRLYDELTGIQFGDIEAPEGWIVKVE

SEQ ID NO: 10197 - protein, 115 aa, Oryza sativa (japonica cultivar-group)
MSQLKSSSLAALLIFLLAVFTTAAAAAGTECQNDVEVLKTTCYKFVEKDGPKLQPSPDCCTSMKGVNVPCVCTYLGSPGVRDNINMDKVFYVTKQCGIAIPGNCGGEQASLDWPH

SEQ ID NO: 10198 - protein, 931 aa, Rhodobacter sphaeroides 2.4.1
MTISGGTFDPSICEMEPIATPGAIQPHGALMTARADSGRVAHASVNLGEILGLPAASVLGAPIGEVIGRVNEILLREARRSGSETPETIGSFRRSDGQLLHLHAFQSGDYMCLDIEPVRDEDGRLPPGARQSVIETFSSAMTQVELCELAVHGLQLVLGYDRVMAYRFGADGHGEVIAERRRQDLEPYLGLHYPASDIPQIARALYLRQRVGAIADACYRPVPLLGHPELDDGKPLDLTHSSLRSVSPIHLDYMQNMHTAASLTIGLADGDRLWGMLVCHNTTPRIAGPEWRATAGMIGQVVSLLLSRLGEVENAAETLARQSTLSTLVERLSAGDTLAAAFVAADQLILDLVGASAAVVRLAGQELHFGRTPPVDAMQKALDILGRPSPLEVLSLDDVTLRHPELPELLAAGSGILLLPLTSGDGDLIAWFRPEHVQTITWGGNPAEHGTWNPATQRMRPRASFDAWKETVTGRSLPWTSAERSCARELGEAIAAEMAQRTRAELARLRHYDPLTGLANRSYLQERLAQDGQPAAALLFIDLDRFKAVNDSMGHSVGDGLLIEVARSLVATVRPHDLVVRLGGDEFVVLCHRLDAAGIVSLAERLRQALEQPFEVAGRKCHISASIGIAMADSIGDLDLVRAADIAMYAAKKNGGNRGELFRPSLYEETTQLVELDNDMRGAIESEQFHLVYQPIFALSPEAERLVGFEALLRWDHPHHGALQPGIFIPLAERLGHIHAMGDWVLRRAILQLQAFRSAGPELDLKMNVNVSPRQLAKPDFPARLADLLAQVPDLPRHALCLEITETSLSDEAVSEALISIRALGVRIAIDDFGTGFSSLACLRRLPVDVAKLDRAFLGGGHTAAQDHRFFAAVTGLVHAADLKVVQEGIETLDQLALVRAAGADFAQGFHLAAPLSIAAALDLIAASREE

SEQ ID NO: 10199 - protein, 350 aa, Staphylococcus epidermidis RP62A
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKELGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 10200 - protein, 182 aa, Vibrio angustum S14
MFKLLKTVLKTGEVTTKYPFAPLEVNEDFRGKPELDADQCLSCGACMRACPANALVMETDEKSGTRRWELSMARCIYCGRCEEVCPTKAIKLSQNFELAVTRKEDLYEHAVFQLANCRQCERPFVAKKLLDYVLDTLAQTGVSADQLELRRQQLETCPECRRSNNMLDSENVSHLRYLEEEM

SEQ ID NO: 10201 - protein, 272 aa, Cleome spinosa
MSPSDSTREENVYMAKLAEQAERYEEMVEFMEKVANTGDTEELTVEERNLLSVAYKNVIGARRASWRIISSIEQKEESRGNEDHVSMIKEYRGKIEAELSKICDGILNLLESHLIPSASSAESKVFYLKMKGDYHRYLAEFKTGAERKEAAESTLLAYKSAQDIALTELAPTHPIRLGLALNFSVFYYEILNSPDRACNLAKQAFDEAISELDTLGEESYKDSTLIMQLLRDNLTLWTSDINDEAGDEIKDASKGESEEGQQAAQAAAPPAQ

SEQ ID NO: 10202 - protein, 831 aa, Rhodobacter sphaeroides 2.4.1
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKRVLKEKGPKAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSMDLADTPIIFRPGTDLAILNYIAHHIISTGRVNRDFVDRHTNFALGATDIGYGLRPEHQLQLAAKGAADAGAMTPTDFETFAALVSEYTLEKAAEISGVEPALLEELAELYADPDRKVMSLWTMGFNQHVRGVWANHMVYNLHLLTGKISEPGNSPFSLTGQPSACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRCADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLRWPVVEGEETRWRYREGFDPYVKPGEGLRFYGKPDGRAVILGVPYEPPAESPDEEFGFWLVTGRVLEHWHSGSMTLRVPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 10203 - protein, 337 aa, Cleome spinosa
MAAISFVSNNHRLSDNRRHHHGPVVEEIEPLLRVFSDGCVERPPVVPTVPPSVLSDPSKLTASDIKLTNDIWTRVYVPAGHHTPLPLLVYFHGGGFCVGSASWGCYHEFLCNVAVKVRCVIVSVNYRLAPEHRLPAAYEDGETVIAWIKQQAFDKNQKSWLSKCDLSSVFLVGDSAGANIAYHVAVRLTASGRSVNPLNFKGIVLIQPFFGGESRTASEKVSDKKNSNSALTMSASDTYWRLALPRGATRDHQWCNPNPASLREAGKFPAAMVMVSEMDVLKDRNLEMCKMMRGCGKRVEAVVYGGVGHAFQILHNSPMAHVRVQEMMSHLKNFINP

SEQ ID NO: 10204 - protein, 864 aa, Yarrowia lipolytica CLIB122
MRGVSTADLLVRRSPSTSAANSQTNVSERHSHSSHRNSDNSVHRSESHRNSENSNQNNSASKIQLPTVSTHAPSDQPVNHTHLNLSYASSAIQNSDFRTRMNDCHDIHVSESRAFFGVYDGHGGDATALWCKSKLRPLIYAALGAVHERPVGNKPRPSMYARAMSVSQSVVTDTTNTSGANNATNATNAPNTNNLQVPNTNNNTTPSQPRYYTPDLSLRISAAFYKLNEWIVSRSGYSLGGACATVAYIEHTRRESLAQSSNNHDGSMITRLVVANVGDSVCVLSHKGRAQRMTADHTLSAPSERERVVASGGLITHKKVDGLHRVTRSLGDKSFKRYISSRPFVSDTVLGAADEFLILASNGLWDVVDDQTCVDLIRHVDDCKVASDTLVSYALKHGAADNVTVIVVRFVSSDMCREYPQLGETASIVSSEGENRRLLSTRRAFSQSGYIPGPGLATLNESKRVHDRVSRFNMFSTLTRTHDAIFDNPENYNVIMAAAEVSLKLRGRVGPLVSNSSERMSERMSSDRMNSIVSMGTVSSCSPRSSLTYSDDESTTPATSMAKRPSISSSSSSGSSFNRRSQYMRSRSQVSGIATFEQLEEMEELDRLRSVNYSGLAQPADLRAITDTESAIEEDDDEVLEEVDTQLELPRSKKVLFANSTRSQRSSASTLEVARTHSAASTASSSATIDDDTVAERFTNMFNNSRPARKMSRALENISFEPRRGSFEKEERDFDGSNSSNSASNTPSGTPSASQSFISLQRELRDKAHVASHHLTGAASAATGLRHPHIGGFFPEHHHNHSHSHSHSHSHSHKKSNSVAIPYPDKDGSGSNSREGSKERSFSVQLGNAPHHISHLLHGSKTKM

SEQ ID NO: 10205 - protein, 762 aa, Synechococcus sp. WH 7805
MVTTPDAAGIGGFSIHRIAAMSPTTASVQSQCPYCGVGCGLDLLPPGEAGKAVKRDAEGNPMWSARGHREHPSSHGQVCIKGATVGETLGQGRLSQPLYRATLADPFQAISWNSAFDLLTERIRSTLASKGADAIAMYGSGQFHTEDYYIAQKLLKGALGTNNFDANSRLCMSSAVAGYTRSLGSDGPPCCYEDLDHCSVAFLIGTNTADCHPVLFQRLLKRKKRDPKGLTIVVIDPRCTDTAKIADYHLALAPGTDLALLHGLARLVLQDNGFDSDFIDSATEGFAAFTQTIKAWTPGKTSKFCGIAEKDLRSVARLWSRKEGILSLWSMGVNQRREGTAVVGGLINLHLLTGEIGKAGAGPFSLTGQPNAMGGREAGGLAHLLPGYRLVTNAEHRHAVEKAWGFAPGSIAAQPGLDAWKQVEAMERGELDLWWVAATNPLVSMPDLERVKAAMQRCKLVVVSEAYADTETSHYAHLLLPAAQWSEKSGAMTNSERRVTLCPAFRPRHGDSRADWEVFAELGRRLGFVDQFSYSSAAEVYEEFTSLTAARVCDMSGLSHSLLKEHGPQQWPYPKGEGPTRTSKRLYEKKRFPTASGRARFQKDSPLGLAEPPCEMYPLVLTVGRYLGQWHTMTRTGKVARLNAMHPEPSLEMHPSDAKRFGLEDNGLAAITSRRGTLTARVCVSERIRVGSVFLPMHWGFTQAEACEANALMHDQACPISKQPELKASAVVVAPAVSVVKPTEQDTGVLENLRRLLTPALR

SEQ ID NO: 10206 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10207 - protein, 402 aa, Pseudomonas syringae pv. syringae B728a
MHKVPETVLAAIKEARALETDPLAAFFYDLDALQQHVSEVMAALPAGVELYYAIKANSEALMLETLAPLVSGFEISSGGEIERVMACPTRKPYVFSGPGKLDSDLRSALLNKVEAIHLESLNEIARLQQLAEQAGRVQPVFLRINPQLPAAQSSRLAMAGTATPFGIDEADLAEAVRRVDNASHLTLKGFHVHAMSHQMSVERHEQLLDFYLQRWQEWKALARDPSQLTHFNVGGGIGVDYLNSQQFDWQRLCRYLEKRLGEQHDAPILRFEPGRFISAYCGYYAIEVLDSKTSHGEHFLVCRGGTHQFRLPVAQSHDHPVIHLPSTPQPAASSEQAYTIVGQLCTPKDVLSRRQPLKGVNIGDLLVLPLAGAYGYNISHADFLCHPRPSQHFVRNGERVRQ

SEQ ID NO: 10208 - protein, 467 aa, Aspergillus oryzae
MSSFRPHASGFPVRYGRLNQSLAGNLSWRPASSIHHASAARFNSTASAASASTATAATAVETAAPEQASDLSDFDITAIPEKIGYLKDLGLDYGWGPSSMIEYFIEHFHIWAGLPWWASIVGTGLLVRLALLKPMLSAADVSTKIHNLKDVVAPLRAKMAQAANEKRHADMMQTRAELQQLHSDHGIKFYKTMIPFIQLPLGFGCYRVVKGMTSLPVPGLAAESVGWIKDLTVADPYFLLPAATAFAMYMSFKKGGENGMNQMANSPVGRAVLYGMPAFSFAFMSFFPSALQLYFLSTGLFALGQAYMLSSNSFRQFANIAIPKKPVEATGMSPEEHGRAIRMILDTQKADKPMEVPAVEEGQKLSFVDRTLNSVKKNYDNLTTDVKGKLDSAMGNEPKKNADGSLAEPARLSEKDRKLAADYEQRRKEEEDWKREERNHARREAHLRALELEREKARSAFKHSKQR

SEQ ID NO: 10209 - protein, 342 aa, Candidatus Protochlamydia amoebophila UWE25
MKGLVKKISAPGLWMENLPIPSHVKDDEVLIKTIKTSICGTDVHIYKWDAWAQKNVPVPLVIGHEFIGEIAEFGKNVKGFKIGERVCGEGHIVCNQCPNCRMGRKHVCMHTKGLGYHISGCFAEYFVLPAENVFSLPPSISDDLGAIFDPYGNAVHTTLAFNLIGEDVLITGAGPIGIMAAAIAKQAGARHIVITDVNDYRLDLARTMGVSHAINVNRESLDNFMQSLGIKYGFTVGLEMSGHPDGLKTLTEKIRHGGNIALLGILPPATSIDWNLVIFKMLTLKGIYGREIFSTWYQMVHLLEIGLNLAPIITHHFSVDNFEKGFEVMLSGQSGKVILDWV

SEQ ID NO: 10210 - protein, 887 aa, Buchnera aphidicola str. APS (Acyrthosiphon pisum)
MSENLYNDVDPIETRDWVQAIESVIRREGHKRAHFLIEQVLKTAKINRKEFFRSSFTSDYINTISREDEYEYPGNLILEKRIRSAIRWNAIMMVLRASKKNLELGGHLSSFQSSATIYEVCFNHFFQAKNHKDGGDLVYFQGHISPGIYARSFLEGRLSEEQIDNFRQEVDGIGLSSYPHPKLMPNFWQFPTVSMGLGPLCAIYQAKFLKYLHNRELKNTSKQIVYAFLGDGEMDEPESKGAISIAVREKLDNLIFIINCNLQRLDGPVVGNGKIVNELESFFYGAGWKVIKVIWGSRWDCLLKKDTSGKLIQLMNETVDGDYQTFKSKDGAYVRKYFFGKYKETYDLVKDMTDEEIWKLNRGGHDPKKMFNALKKAKETKYKPTVILAHTVKGYGMGVIAEGKNIAHQIKKININGIIHIRDRFNIPVSNDEINKLPYVTFKKNSEEYCYIHSQRKKLGGYIPFRLSSFTGKLILPKLIDFQSLLEEQKKDISTTVAFIRVLNIILKNNSIKHLIVPIIADEARTFGMEGLFRKIGIYSSSGQKYTPQDREQLAYYKEEKKGQILQEGINELGAASSWLAAATSYSTNDFPMILFYIYYSIFGFQRIGDLFWAAGDQQARGFLIGGTSGRTTLNGEGLQHEDGHSHIQSLTIPNCISYDPAFAYEVAVIIQDGLRRMYGPSQENIYYYITTINENYYMPAMPIGVEEGICKGIYKLKTLHGTTSKVQLIGSGAILRSVCEAAEILLKDYSITTDIYSVTSFTELARNGEDCERWNMLHPNEKNKIAYVKQIMNKNPTVAATDYMKLFAEQIRHYIPSQEYHVLGTDGFGRSDSRDKLRDHFEVNAYYIVIAALNLLANINDIKKKVVEDAIMKFNIDANKINPRLS

SEQ ID NO: 10211 - protein, 469 aa, Pseudomonas aeruginosa PAO1
MHVATSVIEDQPLRATPAEGETLYEFSQSPLLERQSRQESNARSYPRRIPLALKKARGLLVEDVEGRTFIDCLAGAGTLALGHNHPVVIEAIRQVLADELPLHTLDLTTPVKDQFVQDLFGLLPPALAAEAKIQFCGPTGTDAVEAALKLVRTATGRSTILSFQGGYHGMSQGALGLMGNLGPKKPLGAVLSTGVQFLPYPYDYRCPFGLGGEAGVKANLHYLENLLNDPEGGVQLPAAVIVEVVQGEGGVVPADLDWLRGLRRITEQAGVALIVDEIQSGFARTGRMFAFEHAGIVPDVVVLSKAIGGSLPLAVVVYREWLDKWQPGAHAGTFRGNQMAMAAGSAVMRYLKEHDLAAHAAAMGERLAEHLRILQRDYPQLGDIRGRGLMLGVEIVDPQGEADALGHPPTDGALASRVQRECLRRGLILELGGRHGSVVRFLPPLIIGAEQIDEVARRFARALGAALAG

SEQ ID NO: 10212 - protein, 473 aa, Buchnera aphidicola str. APS (Acyrthosiphon pisum)
MNKKIYTQVVVIGSGPAGYSAAFRCADLGLDTVLIERYDKLGGVCLNVGCIPSKTLLHIAKVIKEAKELHKTGVSFNKPDIDIKKIKNWKQHIVNKLTDGLSSMRKKRKIRIFQGHAIFETDKSLCVTNTEDKFTIFFDNAIIATGSKPIKIPSIPHDDIRIWDSTDALSLKKIPNNFLIIGSGIIGLEMATIYSALGSKVDIIDRFNHFLPVIDEDISSIYKKSINQQFNLMLNTHIDKVEVKKDALIVDMIHENIPKKNILYDAVLVAIGRTPNIDSLGLDRIGLKINNFGFIQVNNQLKTNIPHIYAIGDVAGTPMLAHKGVHEGHIAAEVISGKNHYFEPKVIPSIAYTDPEIAWVGLSEKEAKQENINYEVAIFPWNASGRAIASNCSIGKTKLIFNKQNNKIIGGSIVGSNAGELIGEVGLAIEMGCDAEDIALTIHAHPTLSESIGLSAEVFQGTVTDVLNFKLNK

SEQ ID NO: 10213 - protein, 175 aa, Oryza sativa
TVAACRSTSRQLQGDPWLAARREGTRSSVRLPFVPRHQVRPHPASRAVRVAATAAVADVQELKAKFGKPGAVELKEGRGGLPTVVLKHPDGSSAEVTLFGGCVTSWKTSGGTEILYIRPDAVFDKSKPISGGIPHCFPQFGPGPIQLHGFCRKLDWELVGASGDGKPQVQLQLTD

SEQ ID NO: 10214 - protein, 286 aa, Buchnera aphidicola str. APS (Acyrthosiphon pisum)
MDHKKTWHEKLYCHLGQYFLIEKMLYKKKTPHHQVMIFKNSVFGKIMVIDDIVQTTERDEFIYHEMLTHVPIIAHGSIKSVLIIGGGDGGILREVCRYKMIENITMVEIDVNIIDLCKKYFPNHSNQAYQDSRLNLIIDDGLNFIKRTKEKFDLIISDSTDPIGCGKNLFRSEFYFNCKNHLEENGIFVAQNGVFFLQKNETILTYKNLKKYFYDTRFYQANVPTYYGGVMVFAWGTNNIEYRKNSLEKIQIRIKNTKLDFNYYNAKIHISSFYLPQYILNELNES

SEQ ID NO: 10215 - protein, 239 aa, Oryza sativa
MSKLCQSACKAAKSLLSATAAASSPRTSLLAEGRNAALATLTNLGRKSLPTAYAYSYHHNSSAAAAGWLAAIPAAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 10216 - protein, 573 aa, Rubrobacter xylanophilus DSM 9941
MLTNLEIARGAKLLPIEEVGRSMGLREERHLEPYGRHVAKVDLCAIEDLSERPKAKYILVSAITPTPLGEGKTTTTVGLGQAFSHIGKRATIAIRQASMGPAFGIKGGAAGGGYSQVVPMERLNLHLTGDLHAVTEAHNMLAAMIDNHLYHGNGLGIEPHSISWRRVMDVNDRSLRNIVIGLGARTDGVPRQSGFDITAASEVMAILALASSLEDLRERLGRIVIGHNREGNPVSAEDVRGAGAMAVILKEAIKPNLMQTLEGTPALVHAGPFGNIATGNSSVVADLIGIRTADYLITEAGFGADMGAERFFNIKCRISGLEPDAAVVVATVRALKAHSGRYQIKAGAPLPEELLEENPQDVLAGAENLKKQIENIKLHGVPAVVAINAFPTDHPSEHKAIEEAAKEVGARCAVCRHFTEGGKGAVELARALEETIEENERERRRGGGGSFRFLYPLEMPLKQKIETIAREVYGAEGVEYDAEALRALEGFERAGFGRLPVCLAKTHLSLSSDPALKGAPRGWKLSVREVRASVGAGFIYPICGQMRTMPGLSAHPAAERIDLDGEGNVVGLF

SEQ ID NO: 10217 - protein, 304 aa, Vibrio parahaemolyticus RIMD 2210633
MKVDWKGVYPAVSTQFRQDQSIDLDATQTVIDNQIKDGVNGIICLGTVGENCALYPEEKRQVLQAAKEVVNGRVPLIAGTAESITTAAIDYMQDAHKIGIDGCMVMPAMVYRTSESETYDYYRTLAEATPEMPIMIYNNPVAYGVDVNLDIMAKLAEFDSIVAIKESTTDTRRITELYNKFDDRFTVFSGVDDIALESLMLGATGWISGLTNAFPEESVAIYKLASQGRYAEALEIYRWFLPLLRLDTIPTLVQCIKLAEQVCGRGSEQVRAPRQLLKGEERQQVIQMVEHALATRLDLSKYNL

SEQ ID NO: 10218 - protein, 426 aa, Clostridium cellulolyticum
MIRKEMIAMLLAGGQGSRLGVLTKNVAKPAVLYGGKYRIIDFSLSNCTNSGIDTVGVLTQYQPLKLNAHIGIGKPWDMDRIEGGVTILSPYLKAEMGEWFKGTANAVYQNIQYIDKYSPHYVIILSGDHIYKMDYSKMLDFHKENHADATISVINVPYEEASRYGIMNCHENGKIYEFEEKPKNPKSTLASMGVYIFTWSTLREYLIKDNECSDSVNDFGKNIIPAMLGDGKSMWAYQYSGYWRDVGTIQAFWESSMDLVSRVPQFNLFDPEWRIYTPNPVKPAHYIASSACVKKSIIAEGCSVHGTVINSILFPGAYIEEGAVIQDSIIMSNSRVCKNAYINRSIISEQAIIGEKARLGEGPDVPNEYKPGIYDSGITVVGEKSSIPADPVIGKNVMIDIGASAVDFTSLNVQSGKSVFKGGVAE

SEQ ID NO: 10219 - protein, 351 aa, Staphylococcus aureus subsp. aureus COL
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEIPFDMEKVIQKEITVVGSRSQKPADWEPSLQLMADGLVNAEALVTKIYDISKWDEAYQHLKSGEGIKVLLKPLDLDENEGEN

SEQ ID NO: 10220 - protein, 572 aa, Staphylococcus epidermidis RP62A
MVNTNNHISDELDKNLDEMEFLKANSDFLRGTIEQSLANPITGSITQDDAKLLKFHGSYMQDDRDLRDERRKQKLEPAYSFMIRVRVPGGKATPEQWIAMDDISNQYANHTIKLTTRQAFQFHGILKRNLKQSMKNINHAVLDSIAACGDVNRNTMCNPNPYQSQVHKEINDYATRISNHLLPRTNAYHEIWLDGEKVLDSSEEKEPIYGNTYLPRKFKIGIAVPPSNDIDVYSQDIGLIAIVEQDELIGFNVTIGGGMGMTHGITETYPQLGRLIGFIPKEKVVDVCEKILTIQRDYGNRENRKNARFKYTVDRLGETWVTEELNRRLGWEIKAPRDFEFEHNGDRLGWIEGINNWNFTLFIQNGRVKDTEDYLLKTALREIAEIHTGDFRLSPNQNLVIANVSPEKKEEIQAIIDKYKLTDGKNYTGLRRNSMACVAFPTCGLAMAESERYLPSLITKIEDLLDESGLKEEEITIRMTGCPNGCARPALAEIAFIGKAPGKYNMYLGGSFKGERLNKIYKENIDENEILESLRPLLLRYSKERLDGEHFGDFVIRDGVIAKVHDGRDFHS

SEQ ID NO: 10221 - protein, 307 aa, Cleome spinosa
MGWQKQPALPLWFPLHVLGESRRRKTAAAEQSHLMMQFVDETSFYNRIVLGHLLPANLWDPLPHFLQTWLRNYLAGTLLYLISGLIWCFYIYYLKHNVYVPKDAIPTRKAMLLQIYVAMKAMPWYTLLPTVSEHMIERGWTRCFSEIDDYGWTLYLVYLAFYLVIVEFGIYWVHRELHDIKPLYKYLHATHHIYNKQNTLSPFAGLAFHPLDGILQAVPHVIALFIVPIHFTTHLALLFMEAVWTANIHDCIHGNIWPVMGAGYHTIHHTTYKHNYGHYTIWMDWMFGSLRDPIEEEDSSSSSKKAK

SEQ ID NO: 10222 - protein, 437 aa, Streptococcus mutans UA159
MELINNKRRASMTREFSFETLQLHAGQSVDPTTKSRAVPIYQTTSYVFNDAQDAEDSFALRTPGNIYTRITNPTTAVFEERMAALEGGVGALATASGMAAVTYIALALAHAGDHIVSAATVYGGTFNLLKETLPRYGITTSFVDVANFAEIEAAITDKTKFIIAETLGNPLGNIADLEKLAEIAHRHAIPLVIDNTFGTPYLLNVFSYGVDIAVHSATKFIGGHGTSIGGVIVDSGNFDWEKSGKFPQFVEPDPSYHDISYTRDIGKAAFVTAVRTQLLRDTGACLSPFNAFLLLQGLETLSLRVERHVENAKKIAYYLENHPKVTKVNYASLPSSPYYDLAQKYLPKGASSIFTFNVAGSAKAAREVIDSLEIFSDLANVADAKSLVVHPATTTHGQMTEEDLRACGIEPEQIRVSIGLENADDLIEDLRLALEKI

SEQ ID NO: 10223 - protein, 322 aa, Pseudomonas syringae pv. tomato str. DC3000
MQPQAFYRAVADDFSAVDLIIKKQLTSRVPLVSKIGDYITSAGGKRLRPLLVLLCGKALGREGDDIRLLAATIEFLHTATLLHDDVVDMSGMRRGRSTANALWGNAPSVLVGDFLYSRSFEMMVELGSMEVMKILSKATRIIAEGEVLQLSKIRDASTTEETYMEVIRGKTAMLFEASTHSAAALCKASEAQTEALRTFGDHLGVAFQLVDDLLDYRGDAETLGKNVGDDLAEGKPTLPLIYTMREGSPEQAALVRQAIQKGGLEDLESIRNAVESAGALDYTAQLARDYAARAIACLDALPPSEYRDALIELSEFAVARTH

SEQ ID NO: 10224 - protein, 516 aa, Yarrowia lipolytica CLIB122
MNGNGRQPVTYRGYNTTEMTRLLLQALGDLGYKATAETLESESNISLESPHVAQLRQAVTSGQWDDAERYFDGVTLRSGTNPAEYRFLIRKQHCLELLAQGDDKGGLRVLREELAPLGVNTHELAVLSNHVFETRETVLRLLDGDAAKSRVALLTQLQAFIAPSEMIPEYRLATLLSQAQQHQVAKAAPYHMVPQQQMSLFEDYKGQPDLFPDRVSHVLEGHSHEVWNLEFSHCGKFLASVSCDKSIIIWNLDTYTAEKRLQGHSSAPVMALWSPDDSMILSGSQDKTARLWNAKTGEQIHVFEGIHAHTVSCAWLPDGKRFITSCADDATMILWSAEDCTEVHRWKYKAIHAAVSPDGKRLVAVGGPGPAHNFVVFDLVTFEEVAEVATSQKTTSVSISADSRYALINFMGPKTGDGVHELQLWDICKLRLCQRYIGNSPSGCVIRSCFGGIDDSLVLSGSEDSRVYVWNRADANLIAILQGHSSLVNCVQWHPTRPMFASAGDDHTVRIWDKEQ

SEQ ID NO: 10225 - protein, 372 aa, Salmonella typhimurium LT2
MKYDLIIIGSGSVGAAAGYYATRAGLKVLMTDAHMPPHQQGSHHGDTRLIRHAYGEGEKYVPLVLRAQTLWDELSTHNEEPIFVRSGVVNLGPADSAFLANVARSAQQWQLNVERLDATALMTRWPEIRVPDNYIGLFEADSGFLRSELAITTWLRLAREAGCAQLFNSPVSHIHHDDNGVTIETSEGCYHASKALISAGTWVKALVPELPVQPVRKVFAWFKADGRYSTKNRFPAFTGEMPNGDQYYGFPAENDELKIGKHNGGQLIQAPEERKPFAAVASDGAEAFPFLRNVLPGIGGCLHGAACTYDNSPDEDFIIDTLPGHENTLVITGLSGHGFKFAPVLGEIAADFALGKTPSFDLTPFRLSRFSQ

SEQ ID NO: 10226 - protein, 674 aa, Synechococcus sp. WH 7805
MCGIGGVFLADRRQTLDRQLLVNMAAIQSHRGPDGFGVECIDAAGVGFCHARLSIIDLNESRARQPFLSDDRQVLMAHNGEFYDFQRIRADLTAQGVRFSTKSDSEILLRLYQRQGLESTLPLLRGEFAFALFDAVDDCLYLVRDRFGIKPQYWTMTPEGVVFGSELKVLFAHPLVERRFTSEGLFHQLMQTMVPGTTAFAGVHQVQPGHVLKVQRRGDRLEVSESTYWDVDFPRLDQRDSTLTEADHIANVRAALLEAVEMRMVADVPVGCYLSGGIDSCSILGLASAVSQGPVKAFTIGFDDARYDETPIAAEMAEATGAEQDVMRLSGRELYGHMEQTLWHTERTIYNTLAVAKYLMSRHVNNVDYKVVMTGEGSDELFGGYPAFRRDMFLHGLDDLPQSDRQDWESLLQTNNSLVQGAMLAADQVDDPDLDAVVGFTPSCLQPWLACAPLVPDLLAEEHRQALAEYSPGKAIAEQLNPQQLEGRHALDKAQYVWIKTMLEGQILTWGGDRVDMANSMEARPAFLDHHLAAAAVQVPPELRIKGKTEKYVLREAMAGLLPEVLYKREKFAFMAPPAHTEPEKWAQMKQLADDYLSDEAIDAAGLLSKEGVRTLFARHDDPVTTDAERVQMDAVINHLLGVQMLHRMFVAADVPAQAREQADHLGWRVLMPV

SEQ ID NO: 10227 - protein, 395 aa, Arabidopsis thaliana
MISEVEQPKEKRSLSSEPPSLMSLPYEIIENILARISKWSYPNLSLVSKSFLSLLSSPQLYKTRSEIGTTEPCLYFCLESANHSSPQWYTLWMKPDETLTGTGTIHDYSLIPLPSSSPVLRTSTVAVGSEIYVIGGHFNRSSSVRIFDCRSNTWRDGPNMTVARSDPVAVLIDQRIYVLGGREMDESDDWFEVFDIKTQTWRALPSFRAGLELRRYIVWPNRYFPRLGDSQTAVRLINVNPNALEGKLYVAAQINDYTYEPKDDTWKVVSKSSIRRVKVWCVIENVMYACHDVFLRWYDYEDRRWREIQGLEELCYHPTRGFSGAERIVNYGGKLVVMWRPVQSDGKDKIEIWCAQIALEKRSKDEIWGKIEWINSVLTVPKLCDLCYSCVVVSI

SEQ ID NO: 10228 - protein, 343 aa, Candidatus Protochlamydia amoebophila UWE25
MLVLGIESTCDETACAIVRDGKDILSNIVASQIDLHKEYGGVVPELACRRHIDLIIPVIDQALNQAKLTLEQIDLIAVANGPGLIGALLIGLNTAKALALALRKPFIGINHVEAHLYAAIMSHPQDFQFPCLGVVLSGGHTALVLIKQIGQYELIGQTVDDAVGEAFDKVAKMLNLPYPGGPEIENLARHGRSVKFNFKAGQVKGRPLDFSFSGLKTAVLYAIKDPKALKEMVLLSSEMTQDIAASFQEAACSDIVKKSLLAAKQYGVNTLLFGGGVTNNCYLRKLFSVANSNLNYIWPSAGLSLDNAAMIAGLGYYRYQLQNKSDSMDLEPLTRTPLQSVKE

SEQ ID NO: 10229 - protein, 175 aa, Triticum aestivum
MAPTVMASSVTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10230 - protein, 1249 aa, Oryza sativa (indica cultivar-group)
  misc_feature (804)..(804): Xaa can be any naturally occurring amino acid
MPEPDVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLGACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCSVRRYNACKLQCMDPSMFGVSMPLLLLWRVKFLSLEGCSQLTTRGLESVITSWSDLQSLKVVSCDKIKDEEISPALSELFSTFKELKWRPDNKSRLAASLAGTGMGKKGRVLCKRQILPGHQRVKGTMLNYSTVLVQLREREMKGKGQRTDAGAQLSTNRARMSVKGRAPPPEEGKKNGEKMAAAAAVPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDVERTNPVPPRFIHKATPARLMRRACSSHNYRRRLGAMDAINEWRLPKVSEEEDEAVDQTNWQADTLSSRISSARDWNFEAGGAYEGSDHNGGAFNHSDGENSPVAVQRMGRWPQXSAVKHKENFIHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWFLEVFVCPSNCNQNNSSALSTIPMRSGEGRDCEVPGSTAVQGTNVPTISQEQDRSVYKELRSQNEEFFELFMLKVSLKRQIDRVNHHLALCRKLWRQANESAGGHRCGNSSCSGGHRHRAVAVPVPHAEATPRAMPSTPLAVPLPATAMAQRTQCNLARMPRPQQPNCGGRPGSSRGGAVGLSAAGRMLETPGQPHVAPNGWPAGHGHPASGTLAAAMACSSRPVARQQGNRREQGWDAHQAQVGAQHQNLQRFPPQQGGGNIGERQGQGQFRPGTPSYVQEQRPPPQSSSSHEALQAGERQQANNNSSGSSRQQRQTDTATVASRREPMSK

SEQ ID NO: 10231 - protein, 373 aa, Schizosaccharomyces pombe 972h-
MALKELLGSDAPLEKVCSALLEYESKRKSSENIDSESKKTNLLEDEQDDIEPVWLQLATLKFIGNNRKLIPYKIAIKNPVIPSSSEACLIVKDPQRVYKDLVNEAGLSKVVTRVIGLSKLKAKWNSYEQKRQLRDQFDIFLADDRVIPMLPRILGKTFYQKSKVPVPVKISKGTAEQLKREVVSAYGATYFNSAPCSSFMIKCGHVSNTSTELAENVESILQFVSKHIVPDGAKGIASIHLKTSQSIAIPLWNNPNLKELIASSRKVVTKETASSKRKSDEESLPSQKKQKKVEVAKESKDSKQQNVSDKKQVTVKEVPKKLSVKNAAKTTNRDEDSKGKKAKASPKVSQSSLKANGTTAIKKVKAGKNKVKH

SEQ ID NO: 10232 - protein, 566 aa, Magnaporthe grisea 70-15
MGRILSQPSPGWSLRGYGDEVCKEQLLIKASVPAEDRLYVDVINYLSSEDLAKKRTGTLVARTETADRCIVPFWHQKTTRDDSHDCQIIYTSKFGTRFFCHDGKPLFLRLRFAKPSGPQNSRKPDANEELLEILCLGWSRDPIDKFLRHCHKFRQGQRKGSVAVYIHRGSDFGSRAFWDTTIVKPQRPLSTVYLDEGEKSRLVEDIREYLRPQTRNFYRDRGVPYRRGYLLHGPPGTGKSSLSLALASEFNLDVYILEIPSLRSDIELKALFTQLPQRCIVLLEDVDAIGLQRRRALSNSDLENKSDSEDEHSDSVEKRSGCSLSGLLNLLDGVASPEGRILVITTNAIEKLDTALFRDGRVDIKVYLGNMDKESARLMFKTMYQLQSETLPSVQIDNSTKQQSCYRRQRKPRLLVDRTPVGTGLDGGEGLVGMVNGGVHGACTVVNCYAIPDIVGSRIGSVPSTTHSELAALVATLQISVVVIGARHAQHLHGRGDLLGGLRKKNACWGNLCAIQGPISRQSIVIKSREVPGQAVAKANSLEDVTLKEGPGSKDSKRALRSMRDL

SEQ ID NO: 10233 - protein, 347 aa, Staphylococcus aureus subsp. aureus COL
MKALKLYGVEDLRYEDNEKPVIESANDVIIKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 10234 - protein, 884 aa, uncultured bacterium 580
MDLSLDNDELETQEWRQALNSVIDAEGSERAHFLIEMMIDQARRSGSNLPYNATTAYVNTIPTHLQQRHPGDPGIERRIRALIRWNAIMAVLRANTKSPGIGGHIASFQSAATLYDVGFNHFFRAENESFGGDLVYFQGHSSPGIYARAFLEGRMTEEQLDNFRMETKGNGLSSYPHPWLMPEFWQFPTVSMGLGPLMGIYQARYLKYLHDRGIADTSDRKVWVFCGDGEMDEPESQGAISLAAREKLDNLIFVVNCNLQRLDGPVRGNGKIIQELESNFRGSGWNVLKVIWGSYWDPLFAMDKDGLMKKRMEECVDGEFQNFKAKGGAFTREEFFGKYPELKERVAAMSDQDIWRLNRGGHDPHKVYAAYAAAVAHKGQPSIILAKTVKGYGMGDAGEGQNITHQQKSMDIESLKTFRTRFDLPISDEEVENLAYYKPGKDSPELKYMMERRNALGGFLPIRKKQGNKLNVPSIDAFSKQLESSGDREISTTMAFVRILTTLVKDKDIGKFIVPIVPDEARTFGMEGMFRQLGIYSSVGQLYEPQDSDQVMFYKEKKDGQILEEGINEAGSFSSWIAAATSYSNSGIQTIPFYIFYSMFGFQRIGDLAWAAGDSRSRGFLLGATAGRTTLNGEGLQHEDGHSHLLSATIPNCISYDPCFSYELAVIIQNGLERMIKNQEDVFYYITIMNENYTHPEMPKNINEDIVKGIYKFSENKAKGPKVQLMGSGVILREVIEAASILEKDFNVSSSIFSVTSFTEVRRNALDTQRWNMLNPDKTEKKSTLDEIIVDLESPIITATDYMKSFAEQIATFLPNKFISLGTDGFGRSDSREALRDFFEVDRNHIVIAALKALTEKQEIEKSVLLSAIKKYKIMNDKPNPVSL

SEQ ID NO: 10235 - protein, 417 aa, Rubrobacter xylanophilus DSM 9941
MPVEIRVPELGESVTDATVGRWLKKEGEAVKSGEPIVEVETDKINFEIEAEQDGVLESIAKGEGETVGVGDVIGTIAEGDGRAAAAAEEEEEPEEREEAPAAEAPAGREEAAEEGFRASPSVRRLAQEYGVDLAEVSGTGSGGRITREDVERLIRERSRPPAAPEEDGRREERPAPPPERAPGREALEERVRFSRRRQTIAQRLVESQRNAAMLTTFNEVDMSAVMDLRRRRKESFQERTGARLGFMSFFTKASVAALKAFPQVNAELAGNELVLKKYYDIGVAVSTDEGLVVPVVRDADRKSFAEIEKEIADLAVRAREGRLTLEDLRGGTFTITNGGVFGSLLSTPILTLPQVAILGMHKVQERPVVVDGEIQVRPMMYVALSYDHRVIDGAEAVSFLVRIKELVEDPETLLLEG

SEQ ID NO: 10236 - protein, 450 aa, Aspergillus nidulans FGSC A4
MILSVRPSRACGSAGSSLQAIARENLTGILWSPAARSQSLRRLPQDRPPQPLQRTRLPFLQVHSSRAFHSTPKRDSYTPRISYRVAASSSGKSRRFLPTKNAYNFNPELHDALGVAVDTQDPATKRKRRPDSGEDAFFVSTVGRRRDPSKDNTIAFAVADGVGGWAESRVDPADFSHALCDYMAQTALDWDGPAEQLRAKYLLQAGYDRVVADETIPAGGSTASVGIGLDDGRIELANLGDSGSVLLRQAAVHHYSIPQTHGFNTPYQLSIIPKRMRQQASIFGGGFLEDFPRDANTTTLHMHHGDVLMLATDGVFDNLNNQDILKLVTGRMIYTGAWRASTSPNTGIIPADRETLDRLTGAEGVATLVPSAMPKSTSNKSTIVSNPNNHIYTLQSLLAASIAGEAKLASLDPRRDSPFAKEAQRYYPGDHYRGGKVDDIAVLVIIAVEE

SEQ ID NO: 10237 - protein, 580 aa, uncultured bacterium 580
MAELKKIHIPNIGDFDSVEVIEVMVKVGDKINIEDSLITVESDKASMDIPSPASGLIKSIDIKVGDEVKEGSLILSIDSEIEDSSGEKAPEEKKQATQKKEVQPAPQGDKSDEEYDVAVLGSGPGGYTAAFRAADLGLKVALVEKYTTIGGVCLNVGCIPSKALLHTAKVITDAEDTASHGVSFTQPKIDLEQLRNWKSNKVVKKLTMGLSQMAKQREVEVIEGEGKFSSPNQIIVNLKDGTKKSIGFKSAIIAAGSQSSKIPNTPDDERIMDSTGALELRDIPKKLLIIGGGIIGLEMGTVYDALGSEVSVVELSDGLIQGCDRDIVKPLHRRMEKRFEDIWLKTKVTKIETIKEGVVVHFEGDDAPEKLTFDRVLVAVGRKPNGHKIDAEKAGVKVDEHGFINVNKQMKTNVDHIYAIGDIIGQPMLAHKATHEGKVAAEVIAGEKVEFQAMTIPSVAYTDPEIAWAGVTEEDAKTQNLEIEKSVFPWAASGRAISTNRTEGMTKLIFDKKTQRIIGAGIVGTNAGELIAETVLSIEMGADAHDIGLSIHPHPTLSESVAMASEIKEGTITDLFIKKR

SEQ ID NO: 10238 - protein, 410 aa, Rubrobacter xylanophilus DSM 9941
MASGGEEQRRFETRAVHAGESRPGAGGDRGGDGFYPISTPIYASTTFSHADAQTTDRVLGGEEPGYSYARWGNPSVAALEEALTALEAPQGGARALAFASGMAAMHAALTAAELGEGARVLAADQLYGSTATLLLQIFGPAGTEASFFDAYDPGEAEKKVSSLRPRAVVVETISNPLLRVADIPRLAEISRSHGAALIVDNTFGTPYLQRPLELGADMVVHSATKYLSGHGDVTAGVVAAGPPYDAALEQIRKTVGSTLGPFEAWLLHRGLKTLPLRISRQCANARRIAAWLAEHPKVFRVHHPSLEGHPDREATGRLLADTGGLVAFELAAEGREAAFRFLNALRLCVRAPSLGDIYTLAIHPATSSHRELPPSRREQLGVRENLIRLSAGIEHPEDIIADLEQALERL

SEQ ID NO: 10239 - protein, 222 aa, Cleome spinosa
MSSRRGAPKHQNKFAWKPNAGVKINETEVGGRFRPLSDITGVCPRCREQIDWKRRYGKYKTLTEPAKCQKCTKRNVRQAYHKLCNGCAKEQNVCAKCCCRVDQIVGRDVSEVEAEQKMLEEAIKNARERDRRSLLRAMNKENNPKKSDKAPTRNDGKVGDIFPSISLEEYANSGRISKIGNSSVRDQDHDDDDDEEEDASGPDSDEDHAVDDAEEPYSQQHE

SEQ ID NO: 10240 - protein, 333 aa, Frankia sp. CcI3
MGTGTGENQADTRPPGAVASPDGPPPLRAAAERPGVVQFRMNSCRAAGFLSCRRVTTGRRHDRPRAGESQATTGNAGRAGRRAGRISGMPTLVLLRHGESIWNRENLFTGWVDVDLSEKGAKEATRGGELLRESGVLPDVVHTSLLTRAIRTAWLALDAAGRTWVPVRRTWRLNERHYGGLQGLNKAETLEKFGAEQFQLWRRSYDTPPPEIGPEQVSGVDERYDDLAPDVIPRTECLADVVARMLPYWYDAIVPDLRTGRTVLVAAHGNSLRALVKHLDHISDTDIAGLNIPTGIPLRYELDDQLGVVSSGYLDPDAAALAAAAVAAQGTKK

SEQ ID NO: 10241 - protein, 490 aa, Arabidopsis thaliana
MESMIRIILLSLIIFITILFFIKQKKGKKSNTPASPPRLPLIGNLHQLGRHPHRSLCSLSNRYGPLMLLRFGLVPVLVVSSADVARDILKTYDRVFASRPRSKIFEKIFYEARDVALAPYGEYWRQMKSVCVLHLLTNKMVRSFRNVRQEEISLMMEKIQKSSSLQVNLSELLGSLTNDVISRVALGRKYSDETDFKELMKRLTKLLGEFCVGTYVPWLAWIDWISGLDGQLKKTGNDLDEFLEKVVQDHEDGDAQRTDFVDVLLRIQREKSVGFEIDRLSIKAIILDVVVGGTDTSYALMEWAMTELLHRPECLNRLQEEVRTICKGNSSVSEDDIKDMNYLKAVIKETMRLHPPLPLMVPHESTQDVRLGDYHIPAGTQVMINAWAIGREAATWGPDAEKFRPERHLNSSVDFRGHNFELIPFGAGRRICPAISFAVILIEVTLANLVHRYDWRLPEEYIEDQTNVAESTGMVIHRLFPLYAIVSSTT

SEQ ID NO: 10242 - protein, 337 aa, Streptococcus mutans UA159
MKRIAVLTSGGDAPGMNAAVRAVVRKAISEGMEVCGINRGYAGMVEGDIFPLDAKGVSNILSRGGTFLQSARYPEFAKLEGQLKGIEQLKKHGIEGVVVIGGDGSYHGAMRLTEHGFPAVGLPGTIDNDIVGTDYTIGFDTAVNTATDALDKIRDTSFSHGRTFVVEVMGRNAGDIALWSGIAAGADQIIIPEEPYDIKEVVANVKNGYLSKSKNHHLIVLAEGVMHGEEFAAQMKEAGDNSDLRVTNLGHILRGGAPTPRDRVIASWMGAHAVELLREGKGGLAIGIQNEELVEHPILGSAEDGALFSLTEQGEIVVNNPHKARLDFAALNRDLSN

SEQ ID NO: 10243 - protein, 370 aa, Silicibacter pomeroyi DSS-3
MRTRAAVAVEAGKPLEVMEVNLEGPKAGEVLVEIKATGICHTDEFTLSGADPEGLFPAILGHEGAGIVLEVGEGVTSLKPGDHVIPLYTPECRQCEYCLSGKTNLCQAIRTTQGKGLMPDGTTRFSMLDGTPILHYMGCSTFSNHTVLPEIALAKVRPDAPFDKICYIGCGVTTGIGAVINTAKAEIGCRAVVFGLGGIGLNVIQGLRLAGADQIVGVDLNPDKVAMATRFGMTDFVNPAEVEGDMVAHLVELTRGGADYSFDATGNVGVMRTALECAHKGWGESIIIGVAPAGAEISTRPFQLVTGRVWKGTAFGGAKGRTDVPRIVDWYMDGKIEIDPMITHTLSLDEINKGFDLMHAGESIRSVVVY

SEQ ID NO: 10244 - protein, 254 aa, Oryza sativa (japonica cultivar-group)
MPSLIDGAASLRSLLRPSSDGRRTTKLSGGGGGGGAGGVGGIFKMFKLLPMLTTGCKMAALLGRHSGGRAAPLLADHAPTVTLFGHRRGRLSLAIHEDTRAPPAFLIELPMLASAMHREMATGTVKLALESDTRSARRRLLEEYVWAVFCNGRKAGYAIRRKDASDDDRHVLRLLRGVSMGAGVLPPPPADRRGGAGPDGELTYMRARVERVVGSKDSEAFYMINPDDGSDNGGAAGRDRECAPELSIFLVRKK

SEQ ID NO: 10245 - protein, 337 aa, Aspergillus oryzae
MSISTLQPPYPLHPSVKDLLDPEYISFYNEYVINQQQVHLQPVEASRTSGVLIPGGGPLLEVGKTEDITIKRRATEGPEILLRAFTPAGETPDGGWPVMLYFHGGGWVLGNINTENPVCTNLCVRGNCVVVTVDYRLAPENPFPAAVHDCWESLLWLISDGPSRLSINTSKMATGGSSAGGNLASIITHKALTLSPPVHFLAQLLSVPVTDNTATVQNNESYRLYEHAPALPAAKMIWYRDHYLPNHGDRTNPEASPLFYEGDWSKLPRALVMVGELDVLRVEGEQYAERLKKAGVEVDLQVMKGMPHPFLAMDKVLKEGKRSIMLMCDLLKEVFWS

SEQ ID NO: 10246 - protein, 450 aa, Triticum aestivum
MGKGAGAAGVDEPLLPELSGGHGGGASVSGAVFNLSTSIIGAGIMSIPAAMRVLGVVPALALIAAVALLSDVSVEFMLRYTAWASGTPSYAGIMGDAFGRRAGAAALNIFIAFTTAGTLVVYLIIIGDVLSGSVEGGGEHAGVLQELFGRQWWTGREFVILATAVVVLLPLVLLRRVDSLRYTSAVSILLAAVFMLITMGIAVYTVFTGTAKMPRMLPDFSTLASPFELFTAVPVIVVAFTFHFNVHPIRAELSKTSDMKSAVRISLVLCAAIYAAVGFFGFLLFGDATMPDVLANFDRSSGSGVPQALNDAARLSYALHLVLVFPLLHYSLRVNVDELLFPGRRPLATDTRRFVALTAVLMAVLYVLAIAIPSIWTLFQYSGSTFAVCISLIFPGAIVLRDVHGIAKRKDKAMAAMMITLAVITSSIAIASNVMSSIKGEVKGVNAGAS

SEQ ID NO: 10247 - protein, 207 aa, Synechococcus sp. WH 7805
MGSKLRLGVAGPVGSGKTALVEALCRRLRDQLQLAVVTNDIYTQEDAQFLTRAGALEPSRIRGVETGGCPHTAIREDCSINRAAVAELEAQFPALDLVLVESGGDNLAASFSPELVDLCIYVIDVAAGDKIPRKGGPGITRSDLLVINKIDLAPLVGADLAVMERDSLRMRGDRPWCFTNLHSGEGLDFVVAFVLRQLPNVESISSF

SEQ ID NO: 10248 - protein, 402 aa, Bacillus anthracis str. A2012
MKTPKIVVLGAGYGGMITTVRLQKALSVNEAEITLVNNNSYHYQATWLHESAAGTLQDEKICLDIQDVIDTNKVNFVQDTVVEIKAAEKRIILKDGELEYDYLVIGLGFESETFGITGLKEHAFSIANINATRQIREHMEASFAKYATEKRDELVTIVVGGAGFTGIEYVGELANRVPELCKEYNVPREKARIICVEAAPTALPGFDPALVEYAVKQLEKKGVEFRIGTAIKEATEEGIIVANGDDTELIKSETVVWAAGVRGNGIVEESGFEAMRGRVKVDEYMHAPGYEDVFMVGDAALIINEEINRPYPPTAQIAIQQGYNIAHNLTVLVRGKGEMKKFVFDNKGSVCSLGHDDAMGVVMGKKLTGWKASFMKKVIDNRYLFLLGGPLLVLKKGKLKFF

SEQ ID NO: 10249 - protein, 365 aa, Silicibacter pomeroyi DSS-3
MAQTLTILGLESSCDDTAAAVVRQTEGQAAEILSSVVHGQADLHSAYGGVVPEIAARAHAEKLDICVRQALTEAGVSLTDLDAVAVTAGPGLIGGVMSGVMCAKGIAAATGLPLIGVNHLAGHALTPRLTDQIAYPYLMLLVSGGHCQYLIAHGPEQFSRLGGTIDDAPGEAFDKTARLLGLPQPGGPSVEGEARQGDPKRFRFPRPLLDRPDCDLSFSGLKTALMRMRDQLVGEKGGLTRQDRADLCAGFQAAVVDTLAEKTRRALTLYLDEAPAEPVVAVAGGVAANAAIRAALETVCAEAGARFTAPPLRLCTDNAAMIAYAGLERFRSGARDGLDLTARPRWPLDQSSPAMLGSGKKGAKA

SEQ ID NO: 10250 - protein, 149 aa, Arabidopsis thaliana
  misc_feature (110)..(110): Xaa can be any naturally occurring amino acid
MPSSTFSGTVSTPKLSVAVDMGNPFLNLTVDAFLKIGAVGVTKSLAEDTYKAIDKGSLSKSTLEHALKKLCKEGVYWGAAGGVYIGTEYGIERIRGSRDWKNAMLAGAAXTGAVLSAVGKKGKDTIVIDAILGGALATASQFVNNHYFY

SEQ ID NO: 10251 - protein, 436 aa, Streptomyces sp. 139
MRLPRSRAVNERLHALVPGGAHTYAKGDDQYPQDLAPVISHGRGAHVWDVDGNRYIEYGSGLRSVSLGHAHPRVLEAARRELDRGSNFVRPSVVEAEAAERFLATVPTAEMVKFAKNGSDATTAAVRLARAVTGRARVALCADHPFFSTDDWFIGTTPMSAGIPAETTELTVTFPYGDLAATEELLDRHRGEIACLILEPAAQTEPPPGYLAGLRELADRHGCVLVFDEMITGFRWSEAGAQGLYGVVPDLSTFGKALGNGFAVSALAGRRALMERGGLRHDDDRVFLLSTTHGAETHALAAAMAVQATYTEEGVTARLHALGERLAAGVRDAAAAMGVGDHLVVRGRASNLVFATLDGPGRPSQEYRTLFLRRLLTGGVLAPSFVVSAALDEADVDRTVDVVGQACAVYRKALDAGDPTPWLGGRPVRPVFRRRA

SEQ ID NO: 10252 - protein, 504 aa, Cucumis sativus
MDMNVPNYKLGKTLGIGSFGKVKIAEHALTGHKVAIKILNRRKIKNLDMEEKVRREIKILRLFMHPHIIRLYEVIETPSDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSSGARELIPSMLVVDPMKRITIPEIRQHPWFQAHLPRYLAVPPPDTMQQAKKIDEDILQEVVKMGFDRNQLVESLRNRIQNEATVAYYLLLDNRFRVSSGYLGAEFQETMETGFNRMHPSDPTNPAVGHRLPGYMDYQGMGLRAQFPVERKWALGLQSRAHPREIMTEVLKALRELNVAWKKIGHYNMKCRWLPGIPGHHEGMINNPVHSNHYFGDKSTIIENDGVVKSPNVIKFEVQLYKTREEKYLLDLQRVQGPQFLFLDLCAAFLAQLRVL

SEQ ID NO: 10253 - protein, 375 aa, Solanum lycopersicum
MACCFPVILDRSMRSSFKLSKSSSSSKLDKSKSSICSPTSLSTKKKSIQENDNLVVCFGELLIDFVPTVSGVSLAEAPGFKKAPGGAPANVAVGIARLGGSSAFIGKVGADEFGYMLADILKQNNVDNSGMRFDTHARTALAFVTLKSDGEREFMFFRNPSADMLLTEAELDKNLIQKARIFHYGSISLIAEPCRSAHLAAMETAKNAGCILSYDPNLRLPLWPSEEAAREGILSIWDQADIIKVSEDEITFLTNGEDAYDDNVVMTKLFHSNLKLLLVTEGGDGCRYYTNNFHGRVSGVKVAAVDTTGAGDAFVGGLLNSMASDPDIYMDEKKLRDALLFANGCGAITVTEKGAIPALPTKEAVLKILDGATAN

SEQ ID NO: 10254 - protein, 102 aa, Ustilago maydis 521
MAAKQAAEKLISEHLVAVFSKSYCPYCSQAKSVIEKLGLDKSKVGILELDQMGSEGSDIQAYLLDKTSQRTVPNIFINQKHLGGCSDLLDAQKSGKLQQLLQ

SEQ ID NO: 10255 - protein, 460 aa, Coccidioides immitis RS
MGQTLSEPVVEKNSEEGSDECVIYGLSAMQGWRISMEDAHSAVLDLQAKYLAKDHHPTDPSKRLSFFGVYDGHGGEQMALYAGKNVSRIVTNQETFARGDIEQALKDGYLATDRAILEDPNYEEEVSGCTAAVAIVSKDKIRVANAGDSRSVLGVKGRAKPLSFDHKPQNEGEKARISAAGGFVDFGRVNGNLALSRALGDFEFKKSPDLSPEQQIVTAYPDVTTHEITEDDEFLVIACDGIWDCQSSQAVVEFVRRGIAAKQELHRICENLMDNCLASNSETGGVGCDNMTMIIVGFLNGKTKEEWYNMIAERVANNDGPCAPPEYAQFRGPGVRRQFDDSPDEYDPGLDSRPTGRSGRIILLGDGTELLTDMGDGEMFENGDRVSEQESTREVTSSVDEPRNERKGTPGPQTNHVAHSNGPSNGLTAEASTTEMNPPAPAGVEQSANASTTEEQPKTT

SEQ ID NO: 10256 - protein, 334 aa, Haemophilus influenzae 86-028NP
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVASGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKEE

SEQ ID NO: 10257 - protein, 271 aa, Medicago truncatula
MYPGGYTAEITNLTPRATENDVQNFFGYCGVIERVDVIRSSDYESTAYVTFRDAYALETALLLNGSMILDRCISISRWETYTDDSNNWNNLTPNHEDSITYSQDMHMDKFVSSPGEALTMAQQVVKTMVAKGFVLSKDAFVMAKAFDESRSVSSTAANKVAELSNKIGLTETINSGIETFKSVDEKYHVTDITKSAATVTGTTAIVVATVTGRAAMAAGSAIANSSYFAKGALWVSDIDYHLVGDESLLDDSSIGTPMREMCLQRHSNAIF

SEQ ID NO: 10258 - protein, 341 aa, Rubrobacter xylanophilus DSM 9941
MDKGQLESTARALVAPGKGILAADESFGTIGKRFKAVGIESTEDTRRRYRQMLFTTPGIGEFLSGVILFDETIRQKADDGRPLPRVLEDQGVIPGIKVDKSTTALPLSPQEKFTQGLDGLRERLEEYRGMGARFTKWRAVITIGEGIPTERCIGANAHGLALFAAFSQEAGLVPIVEPEVLIDGDHTIERCYEVTEWTLNRTFDYIYEMGVELSGMLLKPNMVISGKDCPEQAGVEEVARMTVECLKRSVPAAVPGIVFLSGGQSDIQATAHLNAMNRLYDDLPWELSFSYARALQGRPMEIWKGDDANVEAAQKAFYHRAKMNSAARSGSYSEEMEKEAA

SEQ ID NO: 10259 - protein, 222 aa, Rhodobacter sphaeroides 2.4.1
MDLTEDDAMHNARPLPNYLVQRFHGWRATTFADNKSWYRRLSESGQHPRAMVISCCDSRVHVTSIFGADEGEFFIHRNIANLVPPYSPDGKQHGTSAAVEYAVTALGVAHIVVLGHSNCGGVKGCHDMCSGKAPQLEETSSFVGRWMDILRPGYERVKDLPEEERVTALEKEAVLVSIGNLMTFPFVREAVEREVLTLHALWTHIGEGSLEQYTPGQGFVPV

SEQ ID NO: 10260 - protein, 304 aa, Staphylococcus aureus subsp. aureus COL
MTNKVVILGSTNVDQFLTVERYAQPGETLHVEEAQKAFGGGKGANQAIATARMQADTTFITKIGTDGVADFILEDFKVAHIDTSYIIKTAEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSIGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 10261 - protein, 218 aa, Methanococcus maripaludis S2
MICIPVIDKDVSDAINSAKEALKYGDIVEFRIDLLNDVNFKDIEEFSKIPSIITIRAEWEGGAWRKSNEERIELLKNAIKNNAKFIDIELKEEKNLELVKYRNEIGSTTKIIVSYHDFEKTPEIDELIDVVEKELKIGDIAKFATFAHSKEDTLKILNLMNRYSGKIIAIGMGESGKLTRILGLDFGSILTFASMGGKASAPGQVDVKKLKEILKLIN

SEQ ID NO: 10262 - protein, 413 aa, Deinococcus radiodurans
MKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 10263 - protein, 392 aa, Rhodobacter sphaeroides 2.4.1
MTANAPITQDVMTLPRKLPEGGPVNIVGLTREELLAALVAAGTPERQAKMRAGQVWQWVYHWGVRDFAQMTNLAKDYRALLAEHFAIVLPEVVTRQISADGTRKYLIRIAGGHEVETVYIPEEGRGTLCVSSQVGCTLTCSFCHTGTQKLVRNLTAAEIVGQLMLVRDDLGEWPERGAPKDETRLVSNLVLMGMGEPLYNFENVRNAMKVVMDGEGLSLSRRRITLSTSGVVPEIARTAEEIGCQLAISFHATTDEVRDILVPINKRWNIRTLLDSLRDYPRLSNSERITFEYVMLDGVNDTDADARRLVKLISGIPSKINLIPFNEWPGAPYRRSTPERIAAFADIIYKAGYASPIRTPRGEDIMAACGQLKSATERARKSRAQIAAETGL

SEQ ID NO: 10264 - protein, 289 aa, Staphylococcus epidermidis RP62A
MNLLKFHNKIKGYTQNRQPGIEADMEPKPIAELEEYKAAGKLENKVALITGGDSGIGRAIAILYAKEGANVAIGYYDEHQDAEDTVNRLQEMGVKAKAYAHDLKDEKQSQKLIKDVINDFGSLNILVNNGGVQFPRDHFEDITPQQVKETFMTNIFGMMFLSQSAVPYLSEGDTIINTTSVTAYRGSGHLIDYSATKGAIVSFTRSLATTLMEKGIRVNAVAPGPIYSPLIPATFDEEKVEHQGDETPMGRRGQPAELAPSYVFLATHADSSYITGQVIHVNGGDFITS

SEQ ID NO: 10265 - protein, 341 aa, Streptococcus mutans UA159
MTVDLDWKNLGFEYHKLPFRYISYYKDGKWDDGKLTEDATLHISESSPALHYGQEAFEGLKAYRTKDGSVQLFRPNMNAERLQRTADRLLMPQVPTDKFIDAAKQVVRANEEYVPPYGTGATLYLRPLLIGVGDVIGVHPADEYIFTIFAMPVGNYFKGGLAPTNFLIQDDYDRAAPHGTGAAKVGGNYAASLLPGKVAHERQFSDVIYLDPATHTKIEEVGSANFFGITKDNEFITPLSPSILPSVTKYSLLYLAEHRFGMKAIEGDVCVDELDKFVEAGACGTAAVISPIGGVQHGDDFHVFYSETEVGPVTHKLYDELTGIQFGDVKAPEGWIYKVDD

SEQ ID NO: 10266 - protein, 505 aa, Cleome spinosa
MEMWFFIAVSLSISLFLHAVFSLRRSPRRLPPGSHSAIPFVGTPQGLAGLVPHLRRLHRRLGPIVTVRINSRPAIFVSDRSLAHQALIQNGAVFSDRPPALPAGKVFSSNQHNISSASYGPTWRILRRNLTSEILHPSRLRSYSHARKWVLQILVDRFRTSGGQEPVVVVDHLHYAMSALVVLMCFGDKLDEKIIKQVESAHRKLLLSVSRFNILDVCPKITKFLFRKRWEEVLQLRRDQEALLLPLIRARRKIVEENARPGISDSDNKDYVVSYVDTLLDLELPDEKRKLDEGEMVTLCSEFLNGGTDSTATALQWIMANLVKYPEVQKRLHEEIKSVTGETGGEVKEDDLQKMPYLKAVVLEGLRRHPPGHLALPHRVTDETDLGGYSVPKNGTINFMIADMGRDPEVWEDPMAFKPERFVNGGDPIDITGSRGIKMIPFGAGRRICPALNLALLHLEYFVANLVAAFEWRAAENDDVDLSEKLEFTVVMKNPLKAHAVPRSL

SEQ ID NO: 10267 - protein, 448 aa, Aspergillus oryzae
MAASQAANIVEKVVGHNDNATVTTDVSNYNKGAYGQETGEKIKATTWQGKNSVQIVEMPKPRVVDEGDVIVKVTGSTICGSDLHLYHGVIPQLEKGDVLGHEFCGVVESVGPTVKKVKAGDRVVAAFPIACGECRNCKEQLTSACERTNENSITNAMYGKRTAGMFGYSHFTGGFAGGQAEYVRVPYGDVNLLQLPADVPDEKGLYLSDVLATAYHCVVDTGVKKGDVVAIWGGGPIGQMAAEYSFSQGATRVILIDGGEGAWRLDFVTSKIPKLETIDFSNLPRGESITSQLKKIVPGGPDVALECAAGEYAKGWAHYFEMLLGMETDTSEILNEMITAVRPFGRIGVTGVYAGYTNHFNIGALMQTGIRFIGNGQAPVQKYWEHLLELIRRQEINPLDMVTHRVSLENMPELYAAFEGRDKGMQKVYVQTRFSSPPAEGSPQLTEL

SEQ ID NO: 10268 - protein, 491 aa, Agrobacterium tumefaciens str. C58
MNIHNNSGTATHPATDPVTAIVTGFNLKTPGSKRAAAYNRDFLSDKSSIGLPFTMQTKEALYPIVATHAEGAYLQDVDNNRYVDILMGLGTNLFGHNPSFIRTAIEAQLTKGFALGPQSDLAGETAELFCCITGKDRVTFSNTGTEAVQTAMRIARAATGRDKIVLFTGSYHGHSDPALHKATKLEYIRRGALLRSHPAWLVALKPLLKRMVLTKAVPGFSGVAPSSARDIVLLEYGNPRSIDYIRRHGDSLAGVLVEPVQSRNPELQPREFLHELRSVTEKTGSALIFDEMITGFRVAPGGAQSHFGIDADIATYGKIAGGGLPLSLIAGKGRFMDFVDGGAWAYGDSSFPKVAPTFFAGTYCRHPLALAAAKAVATRLLEDGPTLQEGLNARTQAFVERLNGALKGAGLPVAFMSFGSFFAISAARSRISPQAVTMLSFLLLTSGVHLRAGDRGGFLSTAHSDDDIAFVHDAVLQSLTALADHRLLDRH

SEQ ID NO: 10269 - protein, 716 aa, Candida glabrata CBS 138
MSDISLAESIELNSSVPKDDQVFDDEIPDAEVQSEPSEEPPKLKRRLYLEEEDKTDEALSTFVNLEDCLYSNKHVGNCNSNDFMECDCYEDFQNGKNHACGEDSDCINRLTLIECVNDLCGTCGNDCANQRFQKKEYANIAVFKTKMKGYGVRAESDIEINDFIYEYKGEVIEEEEFRDRLVDYDQKKFRHFYFMMLQSGEFIDATIKGSLARFCNHSCNPNAYVNKWVVAGKLRMGIFAKRKILKGEEITFDYNVDRYGAAAQKCYCEEPNCIGFLGGKTQTDAASLLPQNVAEALGVKASEEKKWIKLKKAEGQKIEKSEAENINIEFLESITINPCNTATDVQKVMSVLLQIENKTVAQKLLQRLYLSSNEELLHHVIKLHGYTCFTKLLQLFALEEDELKKILYFLERLPKTTKNGIISSHIDFQVKSVCKNHSSLSSIGDSLIEKWKAYEEYKRITKLDINNSTKTKLQDIRRIKLPPGWEIVFENGRPMYYNAEKKTKLLYPPTGASKTFASQKSSSPIPKFKNKRDQNNGIKRKLTDEEYEERKRKRIELEQENIKKAKEEELQRLKAKFNQEREQKQILENIIAEANRKKEEERQNQLKIEKEKKDKKESKKQLSQISKMEHKWTKFFASVVPNILKKYESDKKIDHDNMKQCARDIVKILAAKEMKKDSSKEPEATVSKEKRHKIKQFVHGYMEKFLEKLDKKKQRH

SEQ ID NO: 10270 - protein, 478 aa, Nicotiana tabacum
MTNFDLFFYISIFLLTILFLYLWFVITRNKKSSPQRKAYKLPPGSMGWPYIGETLQLYSQDPNIFFINRQRRYGEIFKTKILGCPCVMLTSPEAARFVLVNQANLFKPTYPKSKETLIGQSALFFHQGNYHIHVRKLVQTSLNPEAIHNQIPHIEELAISALNSWAGGHVVNTYHEMKKYSFEVGILAIFGHLDAHLKDQLKKNYIIVDKGYNSFPTNLPGSPYRKSLQARKRLGKILSEIINERKEKKLIEKGLLNCFLNAKDEKGLVLNEDQIADNIIGVLFAAQDTTASVLTWILKYLHDNPKLLKNVKAEQKAICQSNEQENHGLTWTQTRKMPITNKVVLETLRLASIISFTFREAVADVEYKGYLIPKGWKVMPLFRNIHQNPEFFPNPQNFDPSRFENVQKPNTFMPFDSGVHACPGNELAKLEMLIMTHHLVTKFRWEAEGSNSGIQYGPFPVPMGGLPARFWKESTTST

SEQ ID NO: 10271 - protein, 152 aa, Casuarina glauca
MALTEKQEALLKQSWEVLKQNIPAHSLRLFALIIEAAPESKYVFSFLKDSNEIPENNPKLKAHAAVIFKTICESATELRQKGHAVWDNNTLKRLGSIHLKNKITDPHFEVMKGALLGTIKEAIKENWSDEMGQAWTEAYNQLVATIKAEMKE

SEQ ID NO: 10272 - protein, 1114 aa, Ustilago maydis 521
MPPPPSSTHNPSANGGIRNAAPSSSAMASSAPQSVNEPSPSSSVKLDNQKHAAYKLPSRPTHLQAPSGANQPQRRQWPQPSSAAQNGNSFNSVAPSSRHDYDDEDEDEEGAIDDSATSKPAANLLSSFRPAPPKTPPYPSNSQPAHEEHRGNDRFQPSDARKDQNHSSSYQLRSPSPPRRSQQSTTTSRAHVAHLRSPSPPESSSRRPGRDHDNGMTRISTNDRYHRGDPHLYHPSASELRSKDDRHDAAGSHMWDRAKQDLKRASNDDWRREDRGWNHDRRAGAGARGGGGGGGGGGGGGGGGGGGGGGARSWDREYDRRYDRNERDRDRPRTHSRYHDPRDELPREKPSNRNGRDKELSPHTAGTEQQYAGWSPTPPQGQPADPLSNGNNGEPFANRPPSRMGRAAPPPLLSNIDHPPTFNANRDLDSSLAKRARSRSPPAGLLKRKANFNAVMPPALAPVNPDASAPAESENVTPGAPLPPKVETLQSPSMPASRLGSESVAATAALGSLPGSAIATAASSGAATATFPTAASGGSVAVPADANFNATCQALDDFTLPSVRLSCLPRKLPDRPSTSGRERRKARGPPVPLNQRKFVGCSSLDDYEISIKLGQGTFGEVLKGRQILTGTQVALKKVTIHDAKDGLPITALREIKLLKKLRHPSVVPVIDMAFRPSGERGKLGDVYMVEPYMDHDLNGMLENPSIRLEHSQIKLYMKQLLEGTLYLHKNRILHRDMKAANLLIDNQGQLQIADFGLARPYRDPGQSWTGKGWTAGTHRYTNMVVTRWYRPPELLAGEKKYGPPIDMWGIGCILAEMITGRPLFKGTSEINQLELIAKLCGSPNETNFPGWSSLPGVKDADPTGRPDPHPEIPGQHAFGDYPRKVKDHFRSVYDAGPGCADLIDKLLVLDPRKRLTAQQALEHEWFWTKPYPADPKSLPKYEHSKEIDRARRDWKPAPAAAAAAPGGGGMAAATMARPRPAMQQLPYIAGAPQQRAYNRPAGFAQSAGYAMPATGMPTPDATDTWDARAAPPPMAGGGARHAFPHPQGGARFTHPNTRPAHHAHPQQPQQPQQAQQAHAYYPNHREPAQQRQQHSLPQRPVGPPRASGGNPYSM

SEQ ID NO: 10273 - protein, 62 aa, Brassica napus
MRGILADWLVEVSEEYTLVPDTLYLTVYLIDWFLHGNHIERQNLQLLGITCMLIASKYEEIY

SEQ ID NO: 10274 - protein, 287 aa, Pyrococcus horikoshii OT3
MEGVIVPLITPFKEDHSIDFEALEWLIKFLEEKGVHGIFINSTTGEFTSLSLEERKILAEKGREVTSRTYLVGTGSTSTFEVIELTKHAKEIGADGVVIVSPYYCRLKEDAIFKHFSMVAEKVDIPIILYAIPSCANPISLEVVRKLALEYSNVIGVKASVDSLTYLSGLIEIKEERKDFKVFTGLDQYFLPNLILGGDGGIMACANFVPEIHLEVWNAFKKGNLEKAMNSARKLVKITKIYSIASSFASAVKLAMVARGFPIKPILRPPYMMDGEEVFKKIKEIVS

SEQ ID NO: 10275 - protein, 471 aa, Rubrobacter xylanophilus DSM 9941
MADKFDLVIIGGGNAGYIPAIRASQLGMSVALVERREGGHLGGTCLNLGCIPTKALLQTAAMLHDARNGEEFGVKVGDVRFDYRQAAKRRDQVVNQLRRGVAGLMKKNKVSVYNGTGSFIQPRRIKVELNDGGTEELEAENVLIATGSAVNTLPGLEFDGEKVISSDDVVTENDGYPESVIILGSGAVGVEFASMYNDFGTEVTIVEILDRLVPLEDPEVSAELEKQFEGRGIRCLTGTKADPGSLDKSGDGVKIKVAGEGGEETLEAEKLLVAVGRKTVTEELNLEATSVKTDDRGIIQVDEFYRTDEPGVYAAGDVIGGYWLAHAAGHEGIVAVEHMAGKDPMPLDQNLIPRVTFCRPEIASFGLSEEQAREEGYEIKVGKFPFRAIGKALIEGEPNGFLKVVADAETDLILGMHAIGPHVTELIAEGVFAKLVEGTPEEIGMAVHAHPSLAEIVGEAAMAVDGHAIHF

SEQ ID NO: 10276 - protein, 375 aa, Xanthomonas axonopodis pv. citri str. 306
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLIECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 10277 - protein, 596 aa, uncultured bacterium 580
MKNIRNFSIIAHIDHGKSTLADRIIQHCGGLADREMEAQVLDSMDLERERGITIKAQTVTLSYKAKDGELYVFNLIDTPGHVDFTYEVSRSLSACEGGVLVVDASQGVEAQTVANCYTALDQNVEVFPVLNKIDLASAEPDRVKKEIEDVIGIEADDAILCSAKTGQGIEDVLETIVHKVPAPIGDIKKPLKALIIDAWFDNYVGVVMLVRVIDGEIKAKDKIHLMATKDEYACESVGIFTPKSIVRDSLGAGEVGFVIAGIKDLESTKVGDTITLSKNKADEALPGFKEIQPQVFAGLYPIESNQFDALRTALEKLKLNDASLNFEPENSTALGFGFRCGFLGLLHMDIIQERLEREYEMELITTAPTVVYELLLKNDDVISVENPSRLPDLSTIEEIREPIINLNILLPHDYVGPVMKLVNEKRGIQKNMQYMGRQVMITYEIPLNEVVLDFFDRLKSVSRGYASMDYEFMEFRAADLIKLDIMVNGDRVDALSLIVHRSNSISKGRELASKMRSLIPRQMFDVAIQSAIGANIIARETIKALRKNVIAKCYGGDVSRKRKLLEKQKAGKKRMKQVGNVEIPQEAFLAILQVDD

SEQ ID NO: 10278 - protein, 182 aa, Nephroselmis olivacea
MNTLVEELEYEHLQSILTTKREKTHEARRQKDEAKRKKEQPAKSQVTKEDKEKKEKIEYRPLPAIAVGDLVKVGLLILEGDKERVQTYEGTVISKHRAGLNSTITVRKTFQGVGIERVFCLYSPRMVFVEFIRHSKARRAKLYYLRNRVGKQSRLEERFDLVTNTILLDLLASESDPSNSRT

SEQ ID NO: 10279 - protein, 391 aa, Rubrobacter xylanophilus DSM 9941
MKGAAHARSEREPGVEVSGGAAFAPGLEGVVATRTRLSMVDGAAGRLVIAGFPVEELAGRASFEETLYLLWNGVLPDAGRLEGLRGDLAARRALPEAAGEVLEAAVAGGAAPIDALRMAAGTLAPSGNDRDDALTSVAAFPTIVAACWRLSQGREPVEPDPGLSHAANYLYMLSGEVPGEERVRALETYLNTVSDHGMNASTFAARVISSTGSDLISAVVGAIGALKGPLHGGAPGPALDVVFEIGEPGRAEGVLRERLDRGERLMGFGHRVYKVRDPRADVLAGAAERLYASDADEELYRLALEVERTALRLLEEYKPGRNLDTNVEFYTALLLHGLGLPTGLFTPTFAVGRVAGWTAHCLEQRETGRLIRPQSEYVGPEARKWVPLEER

SEQ ID NO: 10280 - protein, 130 aa, Glycine max
MEKPSISSPTTKTIQSNPTVERGEARRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 10281 - protein, 361 aa, Brassica oleracea
MENEKGESSSIFKMGNSAQERSLPYVPDCYAVPPSYEPRDALDSNFEIVPTIDISRLKGSDDERRGVIQELSSACQLFGFFQVVNHGINQNILDDALEVAHGFFELPAKEKKKFMSNDVYAPVRYTTSIKDGLDKIQFWRIFLKHYAHPLHRWIHLWPQNPPEYREKMGKFCEEVRSLSLEIMGAITESLGLGRDYLSSRMDKNGMQVMAVNCYPPCPDPTTALGLPPHSDYSCITILLQNLTGLEIFHLSAHGGSGRWVLVPEVKGVLKVHIGDHVEVLSNGLYNSVIHKVTLNEEKTRISLASLHSLGMDDKMSVPYQLVNNENPARYRESSFNDFLAFLVKNDISQGERFIDTLRIKD

SEQ ID NO: 10282 - protein, 386 aa, Staphylococcus epidermidis RP62A
MEMSERLASIPDSYFGKIMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDEFLEKQNEIFRRRRDNFESQLKHAHLPFVHSKGGLYIWLHTPPGYDSEAFEQLLLKEKSILVAPGKPFGENGNQYVRVSLALDDKQLEEAANRLTQLRYLYER

SEQ ID NO: 10283 - protein, 494 aa, Coprinopsis cinerea okayama7#130
MLRSGSQASKKPSSTSHTERAGGPEPQQPQPHIPISQKLRVYHDDQPYVGLALHESSSTIKSLLPSPPTSPIPSRRRFRIRKPHLSLPLPSLYSFKLVLRDFFLQIHARLPGTPRLPDKFKNSPLLWIFLYFALNLSLTLYNKYVLIHFPFPYTLTALHALCGSAGTFVMLHLGLTTDPPIPNLSLKESTVLVLFSLLYTVNIVVSNASLKLVTVPFHQVVRGSAPLFTIALSAILYRKGCSRAKLVSLLPVIAGVGFATYGDYYFTLFGFLITILGTLLAALKTILTNQFLSPPGSNSSPNPLTKGSDGSAGDTLSTKHQKVPSIFRHLRQTDSQYRLTTARLRFNLPKLSLTPLQLLYLMSPLAFIQTTMMAHMTGELDRVNRHLANPQLPHHSGNYNPVGIIRGSTWWLILNGILAFALNVVSFNSNKRIGPLGMTVAANVKQVLTVLCAVGLFNLTITFTNGIGIVLTLIGGAWYAYVEVQEKKQTKRSG

SEQ ID NO: 10284 - protein, 271 aa, Cleome spinosa
MSPADLTREENVYMAKLAEQAERYEEMVEFMENVAKTVDTEELTVEERNLLSVAYKNVIGARRASWRIISSIEQKEESRGNEDHVSTIKEYRGKIEAELSKICDGILNLLETHLIPCASSAESKVFYLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDINDEAGDEIKDASKQESEEGQEAQTAAPPAH

SEQ ID NO: 10285 - protein, 299 aa, Bordetella parapertussis 12822
MQYPAQSPFQDIWIPLVTPFADGAVDLPALRRLVRDYKAAGVDGLVACGSTGEAAALDEAEQLAVLDAVLEEAGALPVAMGLAGNHQGHVLRRLARLGERPLAGVLAPAPYYVRPSQAGAQAYFCALADASAAPLILYDIPYRTGAQLDTATLLALAEHPNIAAVKDCGGSVDKTLALIAHGGVAVLAGEDLQGLGTLCLGGTGMIAAAAHVRPDLFVAMHRAVRAQQLGQAQRLFLALAPVIRLLFAEPNPAPLKALLASQGRLRNEMRAPMLPAAEALTRRLQAELDVLDRAFAPGA

SEQ ID NO: 10286 - protein, 339 aa, Corynebacterium glutamicum ATCC 13032
MTCDREGRHIPSKMSEGLHRHMTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 10287 - protein, 137 aa, Pyrococcus horikoshii OT3
MSFPYYFVVIPMKEVIFTENAPKPIGPYSQAIKAGNFLFIAGQIPIDPKTGEIVKGDIKDQTRQVLENIKAILEAAGYSLNDVIKVTVYLKDMNDFAKMNEVYAEYFGESKPARVAVEVSRLPKDVLIEIEAIAYKE

SEQ ID NO: 10288 - protein, 102 aa, Oryza sativa
  misc_feature (78)..(78): Xaa can be any naturally occurring amino acid
MAPYVMAASVTTVAPLQGLKFTGGMPVDRRSGNFSFGNVSNGRRIKCMQVWPIEGIKKFETLSYLTPLTVEDLLKQIXYLLRSKWAPWLEFNKVCLDYRENH

SEQ ID NO: 10289 - protein, 330 aa, Aspergillus oryzae
MDKAQQPSSFQQLEKLGEGTYATVFKGRNRQTGELVALKEIHLDSEEGTPSTAIREISLMKELKHESIVSLYDVIHTENKLMLVFEYMDKDLKKYMDTRGERGQLDQATIKSFMHQLLKGIAFCHENRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYKPNFHVYATQDLGLILPQIDPLGLDLLNRMLQLRPEMRVSAHDALQHPWFHDLPQMQAQLQQQQQQQQQQQQQMSGYGGMVTSQQAYQ

SEQ ID NO: 10290 - protein, 449 aa, Oryza sativa (indica cultivar-group)
MASYDDGTNLVDDEYDDLDDFIVDNEDDVVLGEEQQDEFEEEEEEQEEEEEEEPPVGQVEILTLREQLKADIRRKNQAQQGATAGRASCSSSVQPLAKDRFGSFFGPSRPSLARRVIEEGCSSIIKEKQNVPSNKSSVSSASKKQPIPSGQQQKPKFVKEEKRKVDALRQNRDYSCLFSDDADTPQATKEQPDNMPVLPMKSDVGDIASTSKLISQTDKVSKDSGLKGPSIQSRVRLVGKEPHPNTKRTIASSAKNGSSLPAMKKIQRVQPSSNGQKMQQTLQSKRPQAMLSQSHGQQSLQSRKPKPSLNGQNFRQKVSAPLAQKHLAPSSRPKPSSAVHNDHGKGKTRRLVKRKSKEDGCDEEEVDYKSIIRGMFNYNPAKFVGRDEDDRDMEANYASIQMEERRSARLARQEDDEELRRIMDEERREKQERKRKKLAQKAVVDASQD

SEQ ID NO: 10291 - protein, 227 aa, Coccidioides immitis RS
MSHHHHHHHHHGHGHGGHDHDHDHSDDLTPAFQSLLYKQIDFDGIVTLNESEPKAGTAIVKKTWAQRLDDSPELESDVDEQMLMYIPFTGQVKLHSLLFYAPPTTSAPKTIKLFRNRPDLDFSTASDLQATQTLTVPQTLTGSDADALEIPLNRAQWNTTTSVTLFFEDNWSGGDEEVTKVGYIGFKGHYMALIREPVTVLYEAAANPKDHVIIQGVGEGVGRTIGQ

SEQ ID NO: 10292 - protein, 320 aa, Oryza sativa
MTIYIAREASKVWRKVTTETSVELSLLREKWGLLLAGIVFQLVPRSYMVYAIVEDLGFMALPEFGQDKGYLSESIFASIFASFVLASQVLRIITFYSTQLPGPNYHCREGSKLATLPPPNNVFEVLLINFPRGVLFGCGDLIFSSHMIFTLVFVRTYHKYGSKRFVKLLAWFMAIVQSLLIIASRKHYSVDVVVAWYTVNLVVFFVDNKLPGYIFVTFVALRLYRDLYGKHFVTSFVEIFTEMPDRTNGVPLLPLSTREKDGRLKEEKDSRLKEEFHKLLNGNHGDPTDRRQRAQMNGRHDEDINHAHSTLSDAAVNGGT

SEQ ID NO: 10293 - protein, 478 aa, Xanthomonas axonopodis pv. citri str. 306
MSEQFDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRLAVIGAGVIGLELGSVWKRLGAEVTILEALPDFLALADAEVAKTALKEFKKQGLDIKLGAKVGKTEITGSDDAKQVVLSYTDATGEQTLTVDKLLVAVGRKAATKNLLADGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 10294 - protein, 403 aa, Xanthomonas axonopodis pv. citri str. 306
MATEVKVPVLPESVSDATIASWHKKAGEAVKRDENLVDLETDKVVLEVPSPVDGVLKEIKFETGSTVTSNQILAIIEEGAVAAAAPAEEKQAAAPAATAAAPAAAPAPAAAAAPAASKSAADSLPPGARFSAITQGVDPSQVEGTGRRGAVTKEDIVNFAKAGGVGKASGARPEERVPMTRVRKTIAKRLMESKNSTAMLTTFNEVNLAKVSAARKELQDEFQKAHGIKLGFMSFFVKAAANALQRFPLVNASIDGDDIIYHGYSDISIAVSTDKGLVTPVLRNVERQSFADVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 10295 - protein, 466 aa, Cunninghamella echinulata
MSGQTRVFKRSEVSDSLKAYQAGDKNADKFLIVDNKVYDITDFIADHPGGAQVISTHIGKDASDVFHAMHPESAYELLANCYVGDLAADHAGVQGELVNGVHKKSKAFADEMRSLRERLETEGAFNGSVPFYIYKVVSTLAIGATGLAMLYYGGHSTSVVLAAAVVVGLFWQQCGWLAHDFGHHQAFADHTVNDVMIAFLGGFCQGFSLSWWKNKHNTHHASTNVHGHDPDIDTAPVLLWDEFATANFYGNLEGQKDSAFSRFIAEHVLPYQTRYYFFVLGFARLSWAIQSLQYSFTVGTLNKSKTLNLFERTMLVSHWILFTTWTLLFINSWTNMVMFFVVSQATTGYALALVFAMNHSGMPVLTQEQAQKMEFYEIQVVTARDVTLGALGDWFCGGLNYQIEHHVFPDMPRHYLPKVKPQVKALCKKHNILYHDTSALRGTLEVLQTLDVVQKLCASSLKRCFR

SEQ ID NO: 10296 - protein, 130 aa, Methanococcus maripaludis S2
MSLMDPLANALNHVSNCESVGKNVAYLKPASKLIGRVLNVMQDQGYIGNFEYIEDGKAGVYKVDLIGQINKCGAVKPRYAVKNHDFEKFEKRYLPAKGFGLLIVSTPKGLMTHDEARNAGVGGRLISYIY

SEQ ID NO: 10297 - protein, 417 aa, Arabidopsis thaliana
MGNCLVGRNNENIAEEEEEKFEEVMKKDYKRKDRKLKIVLRRDELEKIILFQLNADGANKGGDAKLASFGVFLRELEAERLAGEAAAAVAKEEKSSRRLCRRWKPSLESVIEWPEEIVVNEIDENEEDNGAYNNDELNLGLNSQASVSLHHTLCKKTKMSSQICRSASKAAKSLLSSAKNARFFSEGRAIGAAAAVSASGKIPLYASNFARSSGSGVASKSWITGLLALPAAAYMIQDQEVLAAEVTIVISILDFGLSALCSSSLNVSDSIRWNELLLLSSLMISEIISRFERKGFKLVGIKVIVPSKDFAQKHYHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 10298 - protein, 458 aa, Brassica oleracea
MEFTEAYKQTGPCCFSPNSRYVAVANDYRLVIRDTFSFQVVQLFSCLDRISYIEWALDSEYILCGLYKKPMIQAWSLTQPEWTCKIDEGPAGVSYARWSPDSRHILTTSEFQLRLTVWSLLNTACVHVQWPKHGSKGVSFNKDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCRAAIFKEVDEPLQLDMSELSLDDNFMPSNYDASEGYISVRYEVMDLPVALPFQKPLVDKPNPKQGVGLLAWSKDSQYICTRNDSMPTALWIWDMQRLEVAAILVQKEPIRAAVWDPTCTRLLLCTGSSHLYMWTPSGAFCVCNPLPGFSITDLKWNIDGSCLLLKDKDAFCCATVPPLPESSDYSSDD

SEQ ID NO: 10299 - protein, 379 aa, Cucumis melo
MPSLTAPHGLPLFLFLLLFLFSSVSAQFQPAPDPRSDPYQYRLSGSMAVIIVILIAALFFMAFFSVYIRHCNDSPSNTVRPITAAAGRSRRATRGLDPAVIETFPTLIYSDVKEHKIGKSALECAVCLNEFEDDETLRLIPKCDHVFHPECIDAWLASHSTCPVCRANLSPQPTDSVHRADDSNAVVNSDTDGGDIEAQSNDVVSETTAPPTVQIQTESELSTTTSNKALNRTRTRGSRSNRLRWLFPRSHSTGHSLVQPGEDTERFTLRLPVEIRKQVVNRKLHRATSMVVLARQSSSMRGYRFGSGEGSSRGKYYRRLERLDRTSKSDRWVLSMTPPFFTRMSSMKTPRGGSNRAEPGSGRELGQGNTAVDSSRLPV

SEQ ID NO: 10300 - protein, 266 aa, Cleome spinosa
MAMETPAPFSSKAWIARKLALSGYAVFAMDYPGFGLSEGLHGYIPSFDVLVEDVTEHYSIVKGEPEFSSLPSFLFGQSMGGAVALKIHFKQPNSWSGAVLVAPMCKEIDIQIADDMVPPRLLKQILIGLANVLPKQKLVPQKDLAEAAFRDTRKRRLTPYNVICYKDKPRLRTALELLHTTQEIEQDLEKVSLPILVLHGEADTVTDPSVSRALYEKASSRDKRIILYKDAFHSLLEGEPDDMILRVLSDILAWLHHRSSTHLRNP

SEQ ID NO: 10301 - protein, 197 aa, Coprinopsis cinerea okayama7#130
MPSAVVLLADGTEEMEFTITYDTLVRAGVQVVSAFVPAQSPGASVSPPAAKCSRGVRILPDSYLDPTECGPDKHDLLVIPGGAVGAATMSANATVQKLIQAYLDKKKYVGMICAGSLAARTAKLPKQPITSHPSVRGDLEADFEYSEDPVVVSGTLVTSRGPGTAFPFALTLVELLCGKEKREEVRSPMVFPTGTPF

SEQ ID NO: 10302 - protein, 128 aa, Arabidopsis thaliana
MEKVSIVCFFFFLLFGSGYGGLPPFWRATVVTMTNLIGGPPLTIHCKSKQDDLGIHVVPFKQEYHFKFQPNLWKSTFFFCSFQWDSQFKSFDIYDAQRDQGICDDCQWEIKPDGPCRLGKKAKCFPWK

SEQ ID NO: 10303 - protein, 287 aa, Synechococcus sp. WH 7805
MSEAPSTACDWIDEHHNGVRYGLQGKVIVDEQSTIQRITVIHSNRYGNGLLLDGCWMTAEHQERHYHEPLVHPALCAANAIDRILVIGGGDGGTARECLRHKEVKHVDLVEIDGRVVELSQKYLGAIGGGCWSDTRFQLTVGDGIAWVSQASDASYDVVLVDGSDPAGPAEGLFNRSFFQHCRRILKPGGVFATQSESPEAFRDVHIETVRMLREVFGYADPLYGWVPMYPSGWWSWTFAASDGPRYRNPDPIRAAAICDGCDIWSPRWQEGAFDAIPAGIERELSA

SEQ ID NO: 10304 - protein, 149 aa, Glycine max
MVEQTSIMIKPDGVQRGLIGEIISRLEKKGFYLKGLKLVTVDRPFAEKHYAHLSAKPFFSGLVDYIISGPVVAMIWEGKNVVTTGRKIIGATNPAQSEPGTIRGDFAIDIGRNVIHGSDAVESANKEIALWFPEGPANCQSSQHSWIYE

SEQ ID NO: 10305 - protein, 437 aa, Glycine max
  misc_feature (213)..(213): Xaa can be any naturally occurring amino acid
  misc_feature (235)..(235): Xaa can be any naturally occurring amino acid
  misc_feature (309)..(310): Xaa can be any naturally occurring amino acid
  misc_feature (314)..(315): Xaa can be any naturally occurring amino acid
HRENKTKILEFLRKSWEIDRRTEWSIWMVYSKVAMPRQNMSNGVEGTSLSHGMRGRSIITRRFTDDPIQTAAMRAELHRRGIAQMRINNRSLQDMYIFGDPLRVPIIIVECLENMHRSASVKSYFLPLEDKARHILENGSRAIIKLPGNSPPQNEHVLRVVVFVHGFQGHHLDLRLIRNQWLLIDPKIQFLMSEANEDKTSGDFREMGSRLAXQEVICFLKKKMDKASRNGNLKXIKLSFVGHSIGNLIIRAALAESIMEPYLRYLHTYVSISGPHLGYMYSSNSLFNSGLWLLKKLKGTQCIHQLTFXXDHVXXNTFIYNLSKKKTLANFKNVILLSSPQDGYVPYHSARIELCPAATMDFSKQGKVFLEMLNNCLDQVRTHSEHRVVMRCDINFETSSYGRRSFNTLIGRAAHIEFLECDIFVKFIMWSFPELFS

SEQ ID NO: 10306 - protein, 333 aa, Ustilago maydis 521
MGDTNSTLKQPELVPLSNQVAGHPDGVQSLEGGRLVVKACLPRELEFYAKVKQAAAGLAGLESRQVELLGRLLKAMPECHGSWQEYTGSQTAASPSKDESARIVMENLTYGYEKPNVCDIKLGTQLWDEEASEEKRQRMEKAAASTTSGSHGIRLTGWQVYDSETNTYRSVPKTFGKTIHAEHLALGMRMLLACPEQGDAEEAEALLEGTSISEGTSRHRLASLPEGLVVRLLRDHLINDLEELYAIFAEVEVRMRGASLLSVYEGDPARLDATLSRDGSHGQGRPQVRLIDFGHATIVPGQGPDQGILLGLSTVLELARKTLEKLESKSMQE

SEQ ID NO: 10307 - protein, 174 aa, Zea mays
MKLEVMPKQRVLEAEQREEAMEMSGLDLWKHEKPPRICSLPPPLPAPPACDEAALVPPLNFAMVDDGIFRSGFPETANFRFLKSLNLRSIVYLCPEPYPETNTEFLEKNGIRLHQFGIEGRKVRKTWFQRNPLLLRGWLAIVHGGVELLLEGLKYGLLSVTSMMYGLFAPSRRC

SEQ ID NO: 10308 - protein, 274 aa, Oryza sativa (japonica cultivar-group)
MAAATSTMSLLPPITQQQRWHAADSLVVLASRCHNSRRRRRCRYVVPRARLFGPAIFEASKLKVLFLGVDEEKHQHPGKLPRTYTLTHSDVTARLTLAVSHTINRAQLQGWYNKLQRDEVVAEWKKVQGHMSLHVHCHISGGHVLLDLIAGLRYYIFRKELPVVLKAFVHGDGNLFSRHPELEEATVWVYFHSNLPRFNRVECWGPLRDAGAPPEEDDAVAAAAAEEAAAEQMPAAGEWPRRCPGQCDCCFPPYSLIPWPHQHDVAAADGQPQQ

SEQ ID NO: 10309 - protein, 2136 aa, Oryza sativa (indica cultivar-group)
MTTGSSRGTGNETNYVMQKFARAVLNTNNVDCCARVCHGPSVAGLQETLGNGAMSNSINDIENSKCLLVFGYNCADSHPIVARRVLKARENGAKIIVCDPRRIETARIADQHLQLKNGSNMALVNAFGYVLLEEELYDKNYVARFTEGLEAYRQTVKEYAPERVEHLTGISASDVRQAMRTFAAAPSATVMWGMGVTQFGQAVDVVKGLSSLALLTGNLGRPAVGVGPVRGQNNVQGACDMGVLPNMFPGYQDVTDPAVRQKFADAWGIDVNKMDDRVGTRITEVPHLALEGKVKAYYIMGEDPLQTEADLGLVRSGFDALDFVVVQDIFMTKTAEVADVLLPATSWGEHGGVFTCADRGFQRFGQAIQASGNVKRDWEIISLLATEMGYPMHYDDNQQIWDEMRALCPLFYGVTYEKMGEMGHVQWPCPTLDHPGTPYLYKDNQFDTPTGKGQLFAAPWRAPAETPDDDYPLVLCTVREVGHYSCRSMTGNCAALQSLADEPGRVQMHPADADKLGIRDGQLVWVRSRRGKVITRASISERINAGAVYMTYQWWIGACNELTQDNLDPVSKTPETKYCAVTLEAIEDQRWAEDFAASSYQTMKTRLINAVNVLSEARTRSFQHACRGLTHRNRNVRGRTAVHVIIRSRIRIGSAEYLNISGVGAKSDSEAPGTSAEDQSSQDPIKELELGMLQEDIITQGLFRLKYLSIGGFTLYSEQGIARMVDLLTLPNFNVRLQDDGRCSNILILQQILDVTHRQLNIKCLENVVFSEEAKQLELDRMRQFHSLGFEWSLSGMVSSVKQRAVLGNLRPHRNLQSLSIKGYICTEFPDWINKINDTLPDLVKLVFSDINGCNYIPISQLPNLKELEINNMPRLNKIYGTLPNLVKLILSHIERCDHIPVLGNLPNLQELEIYNMPQLHDARIGPCNKLRRLTLVGLPNEATVHLFYDICTHTEVQMVESSHGCDEEMTETVQEFNTLPGCSFRKNEVRRSEELSRGPSTEKGKVKNWFDALLLSIGGARAKKTLASALSHISLVPEESQLSPKLSHGCLEVTSAALPELDYLQIGSCHDLKLHPTPPKSKEYFVKDSSLSLPVDKEDTSSFPSRPYDQYTEGCSHSGQGTAIPPHEHAMQKSIPRLKSKLHIEGSRDQLRQWTELLSTHLDELTITDPLFYDSKYLEEESTVSEHDSLESIYGLPQSCIANLEKINLPPSHQYGLEECSNYDNIVDFVGRIDSQVPYINIGKRDGMDTVCSHRQQLPSGRRSGDQAEERVRRGLATAGGRTAREQACDKKAEEWLTLANEQAGRGAARAPSRRAASAAEERKHAGDKQAEECSRVGGEQAKERQPAAGFHPVYQVHCIMVGTFSVKPIEEGGIFCSSNIPLLYKHYDGQSSSLVIKNLENLKGSLGEVQELAKYQQVRLVWSRSNFIEDSSMAEDKAVLQKLRPHHDLETIEIEGYRGDEFCYWMMNINSSLPNLVTVKLSNIANCQCLPPLGQLANLEVLRISDMPSVRKVDGHVYGTEKPFRKLRELELSTMKNLEEWSTTTLLLTGHNDHQLSRSEEVFPNLQVLLIANCPRMRFVPGFPRSRECTLEKSCSILLSFEQFIGSSNLALIALKINDSGSSSDIVKFLQGCVNLLYLTIDSCIDLITLPEPIKNCHCLRKLEITNCWNFSVLPEWLGEVTFLQKLDIQASKLEYLPQSIQRLTALERLVLNKCNYKLRERCTSGEDKEKIKHIKTIDMNENLIELSLSGLKFGHLHIDQLQNLRELKVSGVEFQHLHLERLQNITELKLSEKRFERLHIDQLQNLKELKFSSVEFGHLHLERLQSITKLELCKKQFEHLHLVQLENLRQLYLFTVKFECVVLHQLQNLEELHLSQIESQKSNKPVCIECSQPLRKLQKIVMTKIINKGLQISVQGGEGDKNLFPGLQHLEMELCENLRFQPSIPRSTHYIISGEIYFDKFNYRRILGSFLFPSFKQVMGTSIPGSTSRMEIKNTSGLSSERWKSIPHLELLNITELTIDKCVDSCPVPKCILGWKSLQKLEIRRCEDIELLPEWLGEMSCLTELIVETYWMEALHPCIRRLTNLQSLTLITCLNRFKERCKSGDDWINIKHIPHIQITDRNGRTEIISPSCT

SEQ ID NO: 10310 - protein, 346 aa, Crocosphaera watsonii WH 8501
MSRYAEELRTTAKAMVARGKGILAMDESNGTCNKRFDKLGIPTTEEYRQIYRSLILQTPELSNYISGPILYDETIRQTTPDGVPLLKIITDAGMIPGIKVDTGAKDLAGCPNEKVTEGLDGLRDRIAEYYSMGARFAKWRAVITIGNGIPSRGCIKANAHGLARYAALCQEGGLVPIVEPEVLIDGDHTLERCWNVTDETLHEVFNQLYTQNVAFDQMVLKPSMVISGKDCPQQASVEEVAKATISCLLKNVPATVAGIAFLSGGQSKEQSSAHLNAMNQMFGDQCPWPVTFSYARAIQQPALDYWAGDSSRISGAQTRLLKRAQCNGAASLGEYSSEMEKTLATV

SEQ ID NO: 10311 - protein, 960 aa, Magnaporthe grisea 70-15
MAPHGPRSMAVPPTGPARSSAMPPVNNGAGPTPPTPGRDDERHPPARGPHPGKITLPKQYCNEQRLRGMQLAIGCDPSRETSYRLQGIQLIDSVRLALRLPIKTFDTACTYYHMFRLFFRDAEYNFQDAALTALFVACKVEDTMKKSKEILCAAYNLKNPDHPTTPDDKMFEQPTKIVIGLERHILQTVGFDFRVRHPQKYLIKVVRKLFPAELGKQILDVAYPMCTDMYKTFAPIKQATFTMVMAIVELTARLTGHQNFVNDVDLSKYHTDRGSVVETMLDLLDLYAQFLRQTKVGMRFDLDTFIQVKIKINQEVEADPSLERFMDVCTKCSAEEGRDGTLNNHILSITPGSATSPATTGSGGAPASGGKVTSASRGIKSQEGTLRYAFDSEQVRAEKRIVDKFFEEKFEEYEVEVEEEIPETSHQNSNHRHNHHHHPRPPTGPAGPQRGHGSRRDRGGHHDGGWPYPSGRHSGGGHDRHKGRKGRVVFPNNIGKMTTASTLLAQKAKLATGQTIPRIQLGLYMMSRSEASRSVCWALEAGYRGFDCAQMYRNEAEAGAAIREAIDGSGGSSSSSSSSSSSKLTREDVFYTTKLASNSESYDAVRKSIRKSVDACGLGYVDLFLLHSPYGGREARLTSWRAVEDAIDAGEVKMGGVSNYGVQHIEELMASKPRHHPVINQIEVHPFNTQISIREACARHNIVIEAYAPLARAMRMRDPTMVSLSKKYGCTVAQLFVKWSLQQGFVTLPKSSKRERIVENVDVGGFEISQEDMEKMNGLDEKLVTDCLPSSGWRMVRVVAESRVSLRQLHGTGVLRLTLLFTDTRPLHRFVDVCSSTTTAERIWRSGSGRRRRRRRAAAATPERKRPPDLVKGRRNLAQAGSTGLVAATLVPPVLIGGAPHVHGASLPRRGVPLCLLLLLLPLLLLPYAGGRGGGGAGAGAPAGRVRSATILHGKITRCR

SEQ ID NO: 10312 - protein, 183 aa, Oryza sativa
  misc_feature (130)..(130): Xaa can be any naturally occurring amino acid
  misc_feature (137)..(137): Xaa can be any naturally occurring amino acid
  misc_feature (152)..(152): Xaa can be any naturally occurring amino acid
  misc_feature (178)..(178): Xaa can be any naturally occurring amino acid
MSLSRTPAGGGAAAWGEAAAGRRPAAVGRRAAERCWSPNPSPKRPIQPPASTHRTTNHRPPRRRGERKEEREMEAAAAAGVQLGTSKPQIATQAEMSEARLPLPYRDQCAHLLIPLNKCRVAEYYLPWKXEPERHAXYEKCQYELVMERMMXQCRRCREAQEAKSKGAATIGVPLIPXTAKLS

SEQ ID NO: 10313 - protein, 126 aa, Vibrio angustum S14
MTKVITSKSAPDAIGPYSHGNAFGELIFTSGQLPVCKEKGGIVDGGIAEQSRQSLVNLRSVLEAGGGDMDTVLKTTCYLANIEDFAAFNAVYADFFKTECPARSCFAVKDLPMGALVEIEAIAHRK

SEQ ID NO: 10314 - protein, 228 aa, Zea mays
  misc_feature (100)..(100): Xaa can be any naturally occurring amino acid
MMWSHEPAAEQKAAASAPPTRQRSSVAKLTTASSSLANLLSAFVSANNSSPDPRQPPPRRSFDERGAVGLGIVAAMGPRRSAMTPRAIMQRNVKHFNRAXFIYFYSCCYTCVIKHVAGAGGASVRKRVYFGFGDGGGGWLVEADDAAPAPAPDFLSRCCLCDKRLDGLDIYMYRGDKAFCSSECRCQQMLLDDRAAKCGSSEALIRSGDYSVSPHSAPMAFSPSVAAA

SEQ ID NO: 10315 - protein, 225 aa, Streptococcus mutans UA159
MEELKKIAGVRAAQYVEDGMIVGLGTGSTAYYFVEEVGRRVQEEGLQVIGVTTSSRTTAQAQALGIPLKSIDEVDSVDVTVDGADEVDPNFNGIKGGGGALLMEKIVGTLTKDYIWVVDESKMVDTLGAFRLPVEVVQYGAERLFREFEKKGYKPSFREYDGVRFVTDMKNFIIDLDLGSIPDPIAFGNMLDHQVGVVEHGLFNGMVNRVIVAGKDGVRILEANK

SEQ ID NO: 10316 - protein, 306 aa, Synechococcus sp. WH 7805
MGWTIEDMPDQQGRVALVTGANSGLGLETTRALIGRGCTVLMGCRSARKGEAARALLLEAGGSGLDLFELDLSDLTSVARCARDVADRYGRLDLLINNAGLMAPPRMLSQQGHEMQFAVNHLGHFALTQALLPLMNNRPQARVVTVTSGAQYFGAMAWDDLQGEQRYDRWKAYSQSKLANVMFALELNQRLQASGSAVRSLAAHPGLARTNLQPVSVAATGAWQEALAYRLMDPLFQSAAQGALPQLYAATASAAGGGEHYGPGQLGGMRGAPKQQPVARAAKDQHQRQRLWTVSESLTEHHSAAV

SEQ ID NO: 10317 - protein, 624 aa, Bordetella parapertussis 12822
MCGVAGLIHLDGAAVDPAVLQGMTDAIAHRGPDGEGHWIDGNVGLGHRRLAIIDLSPAGHQPMISADSRYVLSYNGEIYNFRELRAELETAGYRFKSRTDSEVLLYAVIAWGLKALKRFNGMFAFALWDCHERRLILARDRYGIKPLYYAEQGGTLAFGSEQKAILALPGFRRKLDKAALLEYFTFQNIFTSKVLLEDIQILPAGHYAIVEPDRCASISLTQYWDFCFREPDVAATDQEYREELDRLFVQAVKRQLVTDVELGSYLSGGMDSGSIAAVAAAEHPYIKTFTCGFDLNSASGIELGFDERSKAEYMSYCFKTEHYEMVLKAGDMERILPHVACHLEEPRVGQSYPNFFAAKLASRFVKVVLSGAGGDELFAGYPWRYYRAVVNDDFEHYVDKYYNFWQRLLPNSELKRVFAPIAGEVEHVWTRDIFRNVFRHHADQLYRPEDYINHSLYFEAKTFLHGLLVVEDKLSMAHGLETRVPFLDNDLVEFAMRCPIRLKLNNLAEVVKINENETGNKVRKFFEKNRDGKTILREVMNHRLPADISKAEKQGFSAPDASWFKGESLEFVRRKLLDGHSPLYEIMDAATVRELVNEHLGGIRNRRLLIWSLLSVDAWMRQTF

SEQ ID NO: 10318 - protein, 434 aa, Salmonella typhimurium LT2
MTTPLKKIVIVGGGAGGLEMATQLGHKLGRKKKAKITLVDRNHSHLWKPLLHEVATGSLDEGVDALSYLAHARNHGFQFQLGSVMDIDREAKTITIAELRDEKGELLVPERKIAYDTLVMALGSTSNDFNTPGVKEHCIFLDNPHQARRFHQEMLNLFLKYSANLGANGKVNIAIVGGGATGVELSAELHNAVKQLHSYGYKGLTNDALNVTLVEAGERILPALPPRISSAAHNELTKLGVRVLTQTMVTSADEGGLHTKEGEYIQADLMVWAAGIKAPDFMKEIGGLETNRINQLVVEPTLQTTRDPDIYAIGDCASCARPEGGFVPPRAQAAHQMATCAMKNILAQMNGKPLKAYQYKDHGSLVSLSNFSTVGSLMGNLTRGSMMIEGRIARFVYISLYRMHQIALHGYFKTGLMMLVGSINRVIRPRLKLH

SEQ ID NO: 10319 - protein, 461 aa, Triticum aestivum
LKGMSALTLSALIPYLQPPQCIGSFCPQPALHQYLIYFVGLYMIALGAGGIKPCVSSFGADQFDDTDPVERTKKGAFFNWFYFSINIGSLISGTVLIWVQEKYGYGIGFAIPTFFIALAIGSFFLGSEVYRFQIPGGSPLTRACQVVVAAIYKRNVDLPVDSSLLYECRGKRSAIEGSRKLEHSSEFSFLDKSAVVLRSECGGFHNPWRLCTVTQIEELKILMRMFPIWATGIVFFTVCAQNSSMFIEQGMALNNQVGSFKIPPATLSSLDVISIVVWVPIYERFIVPIARRLTGKERGFSELQRMGIGLFVSTIAMAVAALVEVKRLESARSEGLVHQKVPVSMSILWQAPRYLLIGVGEVFTSIGQAEFFYNQSPDSMRSLCSAFALVTVSLGSYLSSFILTLVSYLTTRGEQMGWIPDNLNEGHLDRFFWLIAGLSSLNFLAFLYFAQQYKCKKASVL

SEQ ID NO: 10320 - protein, 427 aa, Clostridium thermocellum ATCC 27405
MTLSKSKLLFERAKKVIPGGVNSPVRAFGAVGGYPPFIKKAKGARIYDADGNEYIDYVGSWGPMILGHSHPRVLEAVSKTMVDGLSFGAATELEVQMAELITELVPSVEMVRMVNSGTEAVMSAIRVARGYTKREKIIKFAGCYHGHADSMLVKVGSGAMTNGIPNSGGVTAGAAKDTLIARYNDIDSVKLLFEQNKGNIAAVIVEPVAANMGVVPPKDNFLEELRKLCDKEEALLIFDEVITGFRLAIGGAQQYFGVNADLVTYGKIIGGGMPVGAYGGRREIMECVAPVGDVYQAGTLSGNPIAMSAGIATLRELYENPGIFENINRLGQRLSEGLGKITKYTVKAVGSLVCVFMTEEEVNDYDSAVKSDTGLFGRYFNHLLNNGIYIAPSQFEAMFVSNAHTDKDIDETLEKVSLFFARKSPPA

SEQ ID NO: 10321 - protein, 454 aa, Prochlorococcus marinus str. NATL2A
MHESKAYEPNVDIDSPNRNIAPISSEINESKKLVVGGCQLSELAKKYGTPLYVLDELSLRTACKTYISSLNKHYPGKSLPLFASKANSSLAICAVISSEGFGLDAVSEGELLTAINGGVKEKDIVFHGNNKSQDELNFAYSNNVTIVLDNYHDIELLKNIASDNKPAKLMLRFTPGIECHTHEYIRTGHLDSKFGFDPDELKSILEELKTYKWANLTGLHAHIGSQIFEVQPHIDLAGVMADALKLAKEIGHPVVDLNLGGGLGIKYVQEDNPPSIEKWVEIISKAVVNACRERNLDLPRLMCEPGRSLVANSGLTIYKIGAKKVVPGVRTYLSVDGGMSDNPRPITYQSLYSACLVDKPMNTNFEKVTIAGKHCESGDVLLKDFLLPSCESGDFLAVFGTGAYNYSMSSNYNRIPRPATIIVGKGLAELTQRRELPEDLLQLDVLPDRFIPKN

SEQ ID NO: 10322 - protein, 113 aa, Brassica napus
  misc_feature (109)..(109): Xaa can be any naturally occurring amino acid
MKESSRKQGAASPCAACKLLRRRCAQDCVFSPYFPADEPQKFANVHRVFGASNVNKMLQELPLHQRGDAVSSMVYEANARVRDPVYGCVGSISSLQQQIDVLQGQLALXQAEV

SEQ ID NO: 10323 - protein, 397 aa, Bacteroides fragilis NCTC 9343
MNQVSSHVTRLSPSATLLMSQKSAELKAKGVDVINMSVGEPDFNTPGHIKKAAIEAIEQNYSYYSPVMGFLSLREAIANKLNNENGVNYSASQIICSNGAKQSVCNAILAVVNPGDEVIIPAPYWVSYPEMVKLAEGVPVVVPTEIEQDFKITPSQLEAVITSKTRAIILSSPNNPTGTVYSRQELQELANVLSKHEHVLILSDEIYEHVNYVDKHESIAQFPTIKERVIIINGVSKAYAMTGWRIGFVAGPEWVVKGCSKLQGQYTSGPCSISQKAAEAAYRGLQNCVEEMRLAFERRRDLVVRLGKEIAGLEVNIPEGAFYLFPKCSSFFGKRYKDWVINNSTDLVMYLLEVGHVAAVSGDAFGAPGYFRISYATSDENIVEAMKRIKSALELLV

SEQ ID NO: 10324 - protein, 1003 aa, Desulfovibrio desulfuricans G20
METMPDEKIVSRGKEFFTSISGEAPSIFNKGWWTGKVMDWAMKNEDFKVQLFRFVDVFPYLNTSESLSRHIREYFAEGGDVPAVLKWGAGKAGIGGKLTAMLMEKTIRSNIENMGRQFIIGQNAKEAVKSIAKLRKDGFAFTVDLLGEATVNEEEADAYRDGYLEVLDALAREQDKWSPLKGPGPDTDTDWGCTPRVNVSIKPSALYSQAKPVDIEGSVQGIMKRLVPVYRKVVEMNGFLCIDMEALKYKEMTLELYRRLRSEPEFRHYPHLSIVLQAYLRESEKDLADLLHWARTEKLPIAIRLVKGAYWDAETVIAKQNGWDIPVWVHKPQSDMCFERMARTILENSDICYFACGSHNIRTIAATMETARQLGVPETRYEFQVLYGMAEPVRKGLLNVAGRVRLYCPYGELIPGMAYLVRRLLENTANESFLRQSFADGTDMERLLENPELTLQRELAARPAPVEPSGTGGIPPFRNDPMIDFTIPEQRAAFPRAIAEVRAAAGGTVPLFIGGKEVFTQDTMPTTNPADPDEKLADVCQAGIAEIDAAIEAAGRAFLIWRDVSPEDRANYLFKAADAARRSAYRLSAWQILEVGKQWDQAYHDVGEGIDFMEYYAREMLRLGRPRRMGRAPGEHNHLFYQPKGIAAVISPWNFPFAISIGMASAAIVTGNPVIYKPSGIAARIGYNLTEVFREAGLPDGVFNYCPGRSSVMGDYLVEHPAINMICFTGSMEVGLRIQEKAAVVQPGQHHCKRVIAEMGGKNAIIIDDDADLDEAVLQVIYSAFGFQGQKCSACSRVIVLDPIYDRFVKRLVEACNDLKIGPAEDPANYMGPLADASLQKNVGRYIEIAREEGTILVSRDDIPARGCYVPLTVVADITPDSRIAQEEIFGPVLGVMRASTFEEALEIANGTRFALTGGVFSRSPEHLEKARKEFRVGNLYLNKGSTGALVERQAFGGFKLSGVGSKTGGPDYLLQFMDPRVVTENTMRRGFTPIEEDDDWIV

SEQ ID NO: 10325 - protein, 319 aa, Leptospira interrogans serovar Lai str. 56601
MKVSVLKDSLIRKFDKKLETIIREDLKILSEIKTYTIQSGGKRIRPILHYCLCQLLGYSGKHWLDVGAIAELIHAASLLHDDVVDEAETRRGLQSVGSKFGNKTAILAGDYLLACGIDHLNGLGYPELMEVFTQVIKDLSVSELIQMEWEKNPKITLDIYNKIIYGKTASLFAVVCVSAGILSDKNEKEKKKLRQFGIDLGSFFQKKDDAIDYFTSASKSGKIPLKDFYNGLYTYPILLLLDRADRNDKKLIHSLFAKPERSQGDGIVILSLLSRYQIRERMDAEFQTIADNLLKFLNGFLESTIRNLLKEQILKLLDE

SEQ ID NO: 10326 - protein, 687 aa, Ustilago maydis 521
MSFTKAASDEKAIAAIRVLAADVVAKSNSGHPGAPMGMAPMAHTLFSRFMNVNPAHSKWINRDRFVLSNGHACALIYILNHLLGYKDLPMEQLKQFRQLDSKTPGHPEHGHTEGIEVTTGPLGQGFANSVGLAIAQANLAATFNKDGFPLFTNHTYMFTGDGCLQEGISSEAASLAGHLKLGNLIALYDDNHISIDGDTACSFTEDVEQRFLAYGWHVSHVLDGDKDLEGLFKAITEARNVTDKPSIIRVKTTIGFGSKLQGLAATHGAPLKADDIEAVKTKFGMDPKQSFVVPDDVYAAYKEIADRGAKADKEWTELFKAYGEKYPNEHAEIARRIAGKLPEGWEKSLPTYQPSDAAVASRKLSETVLAKVADAVPELLGGSADLTGSNLTRWGNAVDFQHPSTQLGDYSGKYIRYGVREHAMGAIMNGLAAYGMHIPTAGTFLNFVSYAIGAVRLSALSQHRVIWVATHDSIGLGEDGPTHQPIETAIALRAIPNLMFWRPADGNETSGAYLVAIESKSTPSVLALTRQNLPQLEGSSIEKAAKGGYVVVENESADITLVASGSEVALCVEAVAKLGEKGIKARVVSIPCFSVFDAQPIEYRLSVLPSGKPILSVEAYSTLGWSKYSHAQHGINTFGASAPANQLFKKFKMTGDDVVAKAEHVTKVFQGQTLVSPIELEAKLLQY

SEQ ID NO: 10327 - protein, 298 aa, Bacteroides fragilis NCTC 9343
MTRTRLTGMGVALITPFKEDGSVDYDALILLVDYLLQNGTDFLCVLGTTAETLTLTEEEKKRIRHTVIERVNGRIPILLGVGGNNTLTVVETLKNEDFTGVDAILSVVPYYNKPSQEGIYQHFKAIAESTELPIVLYNVPGRTGTNMKAETTLRIARDFKNVIAVKESSGDITQVDDIIKNKPDGFDVISGDDGITFPLLTLGATGVISVIGNAFPREFSRMVRLALHGDYANALTIHHQFTELFKLLFVDGNPAGVKAMLNAMGMIENRLRLPLVPTRITTMEAMRKILSELNIKSV

SEQ ID NO: 10328 - protein, 101 aa, Oryza sativa (japonica cultivar-group)
MAAAAEGEKKMITLKSSDGEEFEVEAVGMESQTIRHMIEDKCADNGIPLPNVNSKILSKVIEYCNKHVHASADDSTSSADLKNWTPTSSRSTRPPSSTSSW

SEQ ID NO: 10329 - protein, 209 aa, Zea mays
MDPSGPGPSSVVGAGGGEAPAVAPQRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRTQQAAAEASTSSSAAAAAGGSGSGSGRAAAASSAAQAGGSSAAPSTT

SEQ ID NO: 10330 - protein, 247 aa, Amaranthus hypochondriacus
MLIKFSFLLPHSSTILLLFSLIFFFSPSSQGSCSDFESEPSMATLGGLRESQGAANDAEIESLARFAVDEHNKKENALLEFARVVKAKEQVVAGTLHHFTIEAIDAGKKKLYDAKVWVKPWMNFKELQEFKHTEDSPSFTSSDLGAIREGHAPGWKEVPVHDPEVQNAAEHAVKTIQQRSNSLFPYELQEIAHAKAEVVEDTAKFNLHLKVKRGNKDEIFNVEVHKSSDGNYNLNKMGNIQPEIENQ

SEQ ID NO: 10331 - protein, 608 aa, Coprinopsis cinerea okayama7#130
MAFRNSGFDFSDGKVTGPNATIAQHPDLADKLSTGSNQPVHLQRNKTERRRLQGLQRTNTFTAAPRTTQGEMGWKQRWDVWMINEGGRQLFFGTWIFLHLLVAVFGFMHYQLKDNSEGARSVFGITFPIARTAALVLHVDVIFILLPVCRNFISLLRRTPLNDIIPFDKNITFHKATAWSIVIGSAVHTLAHMVNFTKLALSIPNMTTGQRIGAFMAANFATGPGLTGWIMWLALGIMVWFAIEKRRRAHFERFWYSHHLFIVFFINWQLHGMFCMIKPDRPPYCSFNTIGVFWRYWLVGGVIWIWERILREIRSRHRTHIHKVIQHPSSVMEVQIKKEKTTTRAGQYIFLSCPEISYFQWHPFTLTSAPEEDFISVHIRVAGDWTTAFSKALGCDFERKKKGDDGAVAKPAAVPPPINRPLPRVMVDGPFGSASEDFLKYETVLLVGGGIGVTPFASILKHIWYRMNNLTDAKPTRLSKVYFTWVIKDFGTAEWFHSLLHAIEEEDTQNRIEINIYLTAKLKEDEVNNIIVQDVGAEKDAITSLRAPTHFGRPNWDRVFGSLCEKHPETDVGVFFCGPAPLSKTLHSMCNKYSTPKGTRFFYGKENF

SEQ ID NO: 10332 - protein, 115 aa, Glycine max
IKSFSKFILPSWQVDRVYLSSPNIIAVLDHERKRTFVIRKDGLPDVAVWNPWEKKSKSMSDFGDEEYKQMLCVDGAVIEKPVNLKPGEEWTGRLQLSIVPSSFCSDHLGLDRSDL

SEQ ID NO: 10333 - protein, 432 aa, Streptococcus mutans UA159
MSIITDVYAREVLDSRGNPTLEVEVYTESGAFGRGMVPSGASTGEHEAVELRDGDKSRYGGLGTQKAVDNVNNIIAEALIGYDVRDQQAIDKAMIALDGTPNKGKLGANAILGVSIAVARAAADFLEIPLYSYLGGFNTKVLPTPMMNIINGGSHSDAPIAFQEFMIVPAGAPTFKEALRWGAEIFHALKKILKERGLETAVGDEGGFAPKFDGTEDAVETIIKAIETAGYKPGEEVFLGFDCASSEFYDNGVYDYTKFEGEKGAKRSAAEQIDYIEELVNKYPIITIEDAMDENDWDGWKALTARLGDRVQLVGDDFFVTNTDYLARGIKEGAANSILIKVNQIGTLTETFEAIEMAKEAGYTAVVSHRSGETEDSTIADISVATNAGQIKTGSLSRTDRIAKYNQLLRIEDQLGEVAEYRGLKSFYNLKK

SEQ ID NO: 10334 - protein, 419 aa, Zea mays
MEAAAASAAAVGGSGAGLTRWQAAALAALAGWVWAASFYDLTRRARALVQPWVTRRVHAETPAILRFQKLEHKLLDNFFSVLSCVVSVPFYTGFLPLLFWSGHGRLARQMTLLMAFCDYLGNSVKDMVSAPRPCSPPIRRVTATEDEKENAMEYGLPSSHALNTVCLTGYLLHYVLTYGEHGSLTVAAGLSLALLLVMLVGIARIYLGMHSLTDVVAGIGFGIVILAFWLAVHDHVDAFVVSGQNVATFWAGLALLMCFAYPKPEFPTPSFEFHTAFNGVAFGIVYGIQQTYFHFHAPDAPIVFSAELPFLAFAGRVLVGIPTILAVKSCSKALSRWLLPVMCSTLGIPIVSSCYVPALKIDGGSSKSRQAAGGHLQRLLSHFPQKAYDVDTGIRFVQYASLAWSVVDLVPAIFAHLDL

SEQ ID NO: 10335 - protein, 456 aa, Oryza sativa (japonica cultivar-group)
MSMLMLSTAVAVCGSFEFGTCVGYSAPTQSGIVDEVGLSISQFALFGSVLTIGAMIGAVTSGRLADFLGRKMVCHIFRLSQTMRISATICIFGWLSLHLAKGVIMLYFGRILLGFSTGILSYVVPVFIAEIAPKNLRGGLATSNQLLICSGSSATYIIGALVAWRNLVLVGIVPCVLLLTGLLFIPESPRWLANVGREKEFHASLQMLRGEDADVSEEAVEIKEYIESLHRFPKARVQDLFLRKNIYAVTVGVGLMIFQQLGGINGVGFYASSIFTSAGFSGKLGTILIGIIQIPITLFGAILMDKSGRRVLLMVSASGTFLGCFLTGISFYLKAQGLFSEWVPELALTGILVYIGAYSIGMGPVPWVVMSEIFSIDMKAIGGSLVTLVSWLGSFAISYSFSFLMDWSSAGTFFMFSAASLITILFVVMVVPETKGRTLEEIQDSLIDSRSRLRDP

SEQ ID NO: 10336 - protein, 816 aa, Candida glabrata CBS 138
MSSDLKCSYKSTSLSPIYASTGSVATISADGSLLACPVLDEINIIQLIPNRKLLHSIDNADEQEITGISLTPDGKYLIYVSQSQLVKIVNVETGVITRSLKVSSPSYVMTCDPTSTLVAIGGTDGSITVIDIENGYIAHSFKGHGGTISSLKFYGELGTNIWLLGSGDTNGMAKVWDLVTRKCKFTVQEHSSAIRGIDFTKNDDKDVLNLITGGRDNVLNLWRFNIKGKSSKLVKTIPAHLQIEACGFITHNDETFAYTAGGDAVFQIIDLNESSVVKCTKKPIEELFITGVIPINQGNQFYAVLSDQTIQLLQPNSEIFSSKSEFIQIQEYIAGNHGTVADLCLVTKNKDCIALATNSPSLRIIPLPKIDADTQDTDLPIEVNLYEGHSDLLNSLACTEDGQWLATASKDKTAILWHWNNTSKRFYIYATFVGHAASVSAVCLPNVMEKNYPKYIITASNDLTVKKWEIPPMKNDLNEVPFIVKSSIYTRHAHEKDINAISMAPNDSIFATASYDKTCKLWNVDTGEPVATLANHKRGLWDVSFCESEKWIATCSGDKTVKIWSLESFTVLKTLEGHTNAVQRCSFMNKQKQLVSAGADGLIKVWDIASGDCIKNLDGHSNRIWALSVLEDGDLIISADADSVFQFWKDCTEAEIQGALEENKVRVEQEQSLTNYMNNGEWSNAFLLALQLDHPMRLFNVLRSSMGSQPEQANGKVIFNQELDSLIGTLNKDQLIQLMKRCRDWNTNARTHMVAQKTISCIFLNHDMTEFGEIPGMVRIVETILPYSKRHYSRVDNLVKESYLLDYALHDMDKLL

SEQ ID NO: 10337 - protein, 636 aa, Bordetella parapertussis 12822
MCGIFGALWHQGKSVSAIEQQLQVGIARQQHRGPDGHGTWIDPQGRLGLAHVRLSIIDLVSGAQPMRGNSGNVITYNGEIYNYIELRRELGEDSFETTSDTEVILRAYEKWGERCVDRLEGMFAFAIWDAKRGEMFVARDRFGIKPFYYACVQGGFYFGSEVKALTPFLNRVETDANALHDYFAFQFCLGEKTLFAGVRQLKPAHCGYVGRDLELKQRQYWEVQYDLDWDHTEKYFVEQVREKLQHSVDMHMRSDVEVGAYISGGVDSSLVAAMARHGRRSSRFQGFTGKFALGDAFDESRYAQALADEHDILLHQVDITEDDFVNDIAKVIYHLDQPVAGPGSFPQYAVSRLAKDHVKVVLGGQGSDEMFGGYARYLIAYWEQCIKGALDGTMHDGNYIVTYESIIPNLRTLRNYKPLIQEFMAEGIFDSRDKRYYRLINRSNTFGNVVNWGMFEGIASSFDDFKQIFWGKNVGKESYFDSITHFDFKTLLPALLQVEDRMSMAHGIESRVPFLDHKLIELVATVPANVKFQNGELKRLLRVAFQDMLPQAIRERKDKMGFPVPLQVWMRKGGKAREFILDTFRSQNARSRAYLAPGFDIEKMMEQEGLFSRNIWAFLSLELWQQQFHDVHRQTI

SEQ ID NO: 10338 - protein, 120 aa, Leucaena leucocephala
GQGYGMTEAGPVLSMCLGFAEEAFPTKSGSCGTVVRNAGLKVVDPETGRSLSYNQPGEICIRGHQIMKGYLNDENATATTIDAEGWLHTGDIGYIDDDEELFIVDRVKELIKYKGFQVAP

SEQ ID NO: 10339 - protein, 762 aa, Ustilago maydis 521
MLRTGVSAALTATTLSIPHTGRTCLHVTRASRLPWGAALSHPRMSCQSRSFGITTRLYASPQDPRSSTSQDAASSSQKKTKHYDSRPFKKQYPPVRPQPKPINFDQPAIPNPHETAAAHAAFRRNSRRFGAAALIAVIIGLAAYKFRDVVHLDGPQAHIKGLQLPHDEMERQVREAQKSQANGANFALLALTRSTTIAKAVALCVWDYRSTLSKTHASTADEAEELRQCHLRSAHRILAALQANGGLYVKLGQHLSAVILLPVEWTSTLRPLQDQNTPTPLPELEAMFRTETGMSFDEAFSEIDPKPIGVASLAQVHRAVDRKTGQMLAIKMMHPDVERFSDVDMKTVTVLVKWVKRLLPEFSFEWLADEMNENMPLEMDFRHEAQNAKRADDDFAEYRTTSVYIPKVKYVFKRVMAMEFIDGRRPDDLRYLAEHNIDRNRVSQELSRVFSQMLYLHGFFHADPHGGNVLIRPAQPGSRSRYNFEVVLLDHGLYFDIDPELRANYARFWLSLLRRASPEVTAERRRYAKLIANIDDDLYPILESAITGRAGLEGSDPNNPRGVKNRHRAGSLLEMDGGSNLTDDEQEHIRKTVMEKEGLFVSILELLRRLPRRMLMVLKLNDLTRSLDASLHTTHGPTRPFLIAARLCALAVYRDDLKQLKERRDSGRASLLTSLSLWKDYVRAWWSYVYFYRGLAMIEIASDIRARWKKIVQFGSNRVGRGGSAEKAKSAAAGLHDQAERDLKEDEDRKRAQLALEKEPRL

SEQ ID NO: 10340 - protein, 446 aa, Candida albicans SC5314
MNQPNPNKQPIVQSTLEQTSNEEVDTVLGRFTLFVKDLSNGLNGSQEIPPSQESVSEEAEVISRKIIVLGQTFDNFDNANDYIESKLWLSYRCGFEPIPKSIDGPQPIQFFPSIIFNRSTIYSNFANLKSLFDKENFTSDAGWGCMIRTSQNLLANTLLKLYPKNEPEIVKLFQDGTSSPFSIHNFIRVASLSPLHVKPGEWFGPNAASLSIKRLTNELLQDQELDGIRIPRVFISENSDLFDDEIRDVFAKEKSASVLILFPIRLGIDKVNSYYYNSIFHLLASKYSCGIAGGKPSSSFYFLGYEDTDLIYFDPHLPQVVETPINMDSYHTTNYNRLNISLLDPSMMIGILVTNIDEYIDFKSSCIDNNNKIVHFHPHTLPVQQDSIINQSWEEVQDEEEEFINLNVSKIENEQQQEQGQSTDAPDEFIDIGNQSSSVVSVPSNV

SEQ ID NO: 10341 - protein, 170 aa, Glycine max
  misc_feature (80)..(80): Xaa can be any naturally occurring amino acid
  misc_feature (83)..(83): Xaa can be any naturally occurring amino acid
  misc_feature (95)..(95): Xaa can be any naturally occurring amino acid
  misc_feature (107)..(107): Xaa can be any naturally occurring amino acid
  misc_feature (113)..(113): Xaa can be any naturally occurring amino acid
  misc_feature (168)..(168): Xaa can be any naturally occurring amino acid
MNALAATNRNFKLASRLLGLDSKLEKSLLIPFREIKVECTIPKDDGTLQSYVGFRVQHDNARGPHEKEESRYHPLRLDPXDEXLNALAQLMTWKXTAVANIPYGGAXGGIGCXDPAELSIPEFERLTRVFTQKIHDLIGTHTDVPAPDMGTGPQTMAWILDEYSKFHXYS

SEQ ID NO: 10342 - protein, 378 aa, Rubrobacter xylanophilus DSM 9941
MMNASLLGFLEGCPPGAEIWGVLDGFRGLVEGDLARLPPGCVDRRLYLSPGAWLGAGRRPLGEGDPERCVERLAARGVRGLAMVGGNGTMWACARIEEAARRAGYGLAVVGIPKTVDNDLAGTDHAPGFPSAARYVAAVVRDIGADLEAMRGFESVRVLETMGRNAGWLALSAGYLRREPSDPPHLIYVPERPFDPDAFLGDVEAAVRAHGFVVAVVSEGLVRRPREEGLRRPVIGGVAPELARRVEEALGLPSRGELLGMGQRSFSLAASPLDREEARALGNRAARMLLEGRSGLMPALRRLPGRRYRVAVEEVPFGRVAGAERPLPPRWVVPPQEVPQGFRGWLAPLVGEDLAPHPPPLVRRLRGAAAGREGRSES

SEQ ID NO: 10343 - protein, 363 aa, Buchnera aphidicola str. APS (Acyrthosiphon pisum)
MNNHIDIFNIPISKINLLDLNRQNLKYFLISLGAKNFCTEQVMSWIYNYYCDDFNKMLNISIKTRKKLYEKSYIFASEFIEEKISYDGTIKWITDINNQKIETVYMPEKKRSTLCVSSQIGCSLKCHFCATGQEGFQRNLKVSEIIAQIWQANKRLKEKNIKKNITNIVFMGMGEPLLNLKNVVSALTIILDEYGFGLSKRRVTLSTSGIVPALDKLRNMIDVSLAISLHAPNDFIRNIIMPINRKYNISSVLSSALKYFKYSNANRGGITIEYVMLDRINDSNENARQLSVLLSKIPSKINLIPWNSFSGPSFLCSNTDRINMFANILRKKGFTTTIRKNRGEDINAACGQLTGIITNYFKK

SEQ ID NO: 10344 - protein, 174 aa, Crocosphaera watsonii WH 8501
MANAYPLVTKKVFMDISIGGEKAERIVIGLFGEVVPKTVDNFYQLCTHEKGFGYRQSSFHRVIKDFMMQGGDFTRGNGTGGKSIYGEKFPDENFTVKHNGRGWLSMANAGPNTNGSQFFITFTQTPWLDGKHTVFGKVLEGLEVLDKVENCDTDGRDRPQQDIKIEDSGSLPVE

SEQ ID NO: 10345 - protein, 294 aa, Magnetospirillum magnetotacticum MS-1
MTVTLSTLNAAPSAVFVETLGAVFEHAPWVAEGAAAGRPYPTVEALFAAMRATVQRAEEGRRLALLAGHPELAGRAARAGRIAPDSIAEQAAAGLDRLSEAEFARFAALNAAYREKFGIPFILCVKRHGRASLLATFERRLGSSPEIERRVAEDEVMRIAAIRLDALVTGEGPLQTKGRISTHVLDTALGRPAAGVALELYEIVSATEAALVARAVTNADGRTDAPLVHGRPVPVATYELRVRLGDYHRRLGLDLPDPPFLDIVPLRFGVSEPEGHYHVPLVATPWSFQTYRGS

SEQ ID NO: 10346 - protein, 347 aa, Magnetospirillum magnetotacticum MS-1
MPGTKIRPSALGLLGLQHVLVMYAGAVAVPLIVGRALKLSPEEVAILVSADLFACGIATLIQSWGLPGIGIRMPVMMGVTFASVTPMIAIGTNPALGLTTIYGSVIVAGLFGLLAAPLVGRLLPLFPPVVTGTIILVIGISLMRVGVNWAAGGVGSPHYGAPLNLGISAFVLLTILALTRFTTGFVSSASVLIGIVLGMLVAAMAGLVDPAKVVAAPWLDVVKPFHFGWPTFDPVSAATLCIVMIVVMIESTGMFLALSAITGDPVGEERLTRGLRADGLGTLLGGVFNTFPYTSFSQNVGLVGVTGVRSRLVTVVGGVIMLGLGLIPKLAALVERSRPACSAAPGS

SEQ ID NO: 10347 - protein, 319 aa, Rubrobacter xylanophilus DSM 9941
MTRIVSLGEVVADIYRQEATSPVELPFVARPGGAPANVAVAACRLGAEAAFVGSVGDDLFGSFILRALRAEGVDTSQVVLQRPPTRTSLAFVEISADGDREFTFYRSSPAADELLGERDVRPEALSGAAFANFGSIPLIREPVRSATLRFARLAREAGVPVAFDVNFREHLWESVEAAREVVAPLLGLAAVVKLSDDELRPLLGVEEPEEAARLLLGRGASLVFVSLGPRGAFYAGEGFSGRVPAFRVEAVDATGAGDAFLAAALVHLAGRGWGEGEVREAARRGAAAGALACTGYGAMSALPTREELERLVSASGAPG

SEQ ID NO: 10348 - protein, 518 aa, Oryza sativa (japonica cultivar-group)
MLPRSRTLPPRIHDGVVVVERDVRRYQQLPQQVEMEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMDAVKANLGGAKVKVCGCIQYLNLLGVAIGYTIAASISMMAIQRSNCFHARGEQDPCHASSNVYMIMFGIVQVFFSQIPDFDQVWWLSILAAVMSFTYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 10349 - protein, 435 aa, Chlamydophila pneumoniae TW-183
MKRAIIIGAGISGLAAGWWLHKKFPQAEILVLDKEAYAGGFVRTESPQGFSFDLGPKGFLTRGDGEYTLKLIHELGLQNSLIFSDRAAKNRFVYYRGKAHKISTWTLLRKGLLPSLIKDFRAPCYTQDSSVQDFLKRHSSQNFTSYILDPLITAIRAGHSSILSTHMAFPELAKREASSGSLLRSYLKNRSPKKSKTDRYLASLSPSMGTLITTIQEKLPATWKFSTSVTHIDCSPKEACVTTPSETFFADMVIYTGPLQQLPVLLPNYGIENLSKRVLPWNLSSISLGWHHANFSLPKGYGMLFADELPLLGIVWNSQIFPQATPGKTVLSLLIEGKWRESEAHAFAIAALSEYLNINQKPDAFALFSSQDGIPQHAVGFLERKERILPHLPGNLKIVGQNIAGPGLNRCIASAYHAICDLHTEETLAQPQSSL

SEQ ID NO: 10350 - protein, 683 aa, Chlamydophila pneumoniae TW-183
MGISYSCCFYIEGLQGLLMINKELDIGILGKIAGAIKQISIESIQKASSGHPGLPLGCAELAAYLYGYVLRQNPRDPHWINRDRFVLSAGHGSVLLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 10351 - protein, 628 aa, Bordetella parapertussis 12822
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIDAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGRAGEPMAWDDPASQECRPIGFQEAAEELRARFLDNVRLHLRSDVPIGAALSGGIDSSAIVCAMRWLEPDLPIQTFSFISDDAHRSEERWVDLVNQHCGATGHKIHIAPHELLDDLDDLIRVQGEPVGSTSIYAQYRVFKLAREHGVVVTLDGQGADELLGGYGGYPTERLASLLETSRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDSGQTKHIFRKAMRGIVPDLILDRDDKIGFATPEQQWMQATAPQMRQWLVDAADIPFLRNAEVTAQFDAMIAGATPFSWQAWRWVNFQRWMQHATVLP

SEQ ID NO: 10352 - protein, 832 aa, Coprinopsis cinerea okayama7#130
MSGQEDRLKAFITRQKQLLQSERDAEIERSSLLLSNCGPKLLEQKGLALNGLGVASINIGLGGKTLVELERPTAYHTSPIFPPHTFRNGDLARIEAHVASSSSNGPPKKTKKTATSSSASTGDVTSNSAEGVVYKSEFDVTKSQGVSDTRIVIAIDPANTSDSGLDLPERCRVVKLANSVTYDRMDKAIERLERTVLPSADGKPPPPDYVLTPLMQVLMCMKPLGPPAQRGGVEFFDPNLNDSQKEAVRFCLAAPEIANRLIPPGTGKTHTLIELIRQLTKPTPTHPNGRRLLVCGASNLSVDNILERLLDLPSTSSSKPLKVTRIGHPARVMAHEGILDSTLDAKSTRTDQAALVKDIKQELEGYLNVLTGKGGGKAAKGTAAAANASKGGRPRGAERKKMWEEVKALRKEFRQRESTIVHSVLAESQVVLATCHSAGGRQMRNEEFDVVIIDEATQAMEAVCWVPIFKAKKLILAGDPMQLPPTVLSLDEERKKSKKADGEKVPVVKKGKDASAKVKKGGKKEQAVVKEDDEGSAEGPPDSEDEEEGSEIGDDSEIDDEEEDTPKQASKDPKRKRQERKVELTPPRSLEVTLFERLEKMYGRKVKRMLTVQYRMHKQICDFPSTTLYRSKLISHDSVKEHLLKDLVTSTSEDEEEVLQHPVVFFDTSGCEYFERLDTGGEDINLKGKAAKVEEGSRCNENEASVVRSWVEKLVENGVEPGQMAIITPYQAQVTLLTSMLRPVYGPSLEIGTVDGMQGREKEAVVISLVRSNDKREVGFLKEKRRMNVAMTRARRHLCVVGDSSTVTHGGKYLKKWVAWLEANADVRFPDV

SEQ ID NO: 10353 - protein, 233 aa, Spinacia oleracea
MASKVLPQALLVIPSNHSLQCPPLKKQLGFPIDSNRRFSLSSNCRSNLMVSRASSNLFSSNFSSIFSFPARNSFVVRSEAEDSSDAPAESVAVVAEEELPVESEAEAEERPPRQQRVKLGDIMGILNKKAVHAAEELRPVPGIRTGDIVQIRLEVPENKRRLSVYKGIVISRQNAGIHTTIRIRRIIAGVGVEIVFPLYSPNIKEIKVVSHRKVRKARLYYLRDKLPRLSTFK

SEQ ID NO: 10354 - protein, 350 aa, Arabidopsis thaliana
SPEMEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 10355 - protein, 309 aa, Aspergillus nidulans FGSC A4
MANRPLVPGVYVPTVAFFAENEDVDVATVEKHAAYLAKSGVAGIVVQGSNGEAVHLDREERNLITSATRHALDSVGATSMPVIVGTGAPSTRETINLCKDAAAAGGDYVLVLPPSYYKSLVSSAALLDHFRAVADASPIPVLIYNFPGASAGLDLSSDDILALSSHPNIIGTKLTCGNTGKLTRIVAQAGPSFLTFGGSCDFTLQTLIGGGAGVIAGTANIIPRACVRIMELYRAGRVEEAQKVQAIVARADWLAIKGGFVAVKSALQSYRGYGQQPRRPCVAPSSEEAAALKEAFSESIELERQLESQ

SEQ ID NO: 10356 - protein, 109 aa, Streptococcus mutans UA159
MTDLSLDFKKQGGLLPVIVTDFQTGQVLMLAYMNEEAYQKTLDSKEMYYWSRSRNELWHKGDTSGHYQYVKSIKTDCDQDTLLIAVEQVGAACHTGAYSCFFNEIYNPE

SEQ ID NO: 10357 - protein, 474 aa, Legionella pneumophila str. Paris
MANKIKTDVVVLGSGPGGYTAAFRAADLDKKVVLVERFDSLGGVCLNVGCIPSKALLHIAKVVDEAHEMSEQGVAFGKPKFDNKKLVAWKNSVVAKLTGGLKALAKQRKVEVITGTGKFSGTHQILVETKEGTVEIEFDNAIIAVGSESIKLPFIPEDKRIFSSTGALELADIKGDLLVLGGGIIGLEMATVYSSLGVNVTVVEFMDQLIPNADTDLVNILQKRMTKKGIKFLLKTKVTAVEAKKDGIYVSMEGEHATDKPLCFQQVLVAVGRKPNGGAINAEKAGIKVDERGFIPVDNQLRTNVPHIFAIGDVNGQPMLAHKAIPEGKVAAEVIAGKKHYFEPKCIPSVAYTDPELAWAGLTEKEAKEKGINYEKASFPWAASGRALSMGREEGMTKLLFCPETNRILGAGIVGVNAGDLIAETALAIEMCCDVEDIALTIHPHPTLSETIAQSAEAFEGTITDLYLPKKKKK

SEQ ID NO: 10358 - protein, 540 aa, uncultured bacterium 581
MSSIMNIDPELQSLANQIATRRVTECFEDDANRASDFRCTSNGLVLDYSKHHIDAPSRQRLLEIAQQSALAADFEALTRGDAINITEERAALHTLLRGTRKEESPELYAEVHATNSKLAQLVAKIHSGAWSGFGANRFTDVVNIGIGGSDFGPKMVCRALRTETDLMKSHFVANVDPQDLDETLASLDPQSTLFIICSKSFTTEETLTNALRARAWLLAAGAKDTDVNKHMVAVTTNLEGASRFGISPENCFPMWDWVGGRYSLWSAVGLSIALQSGWETFLRLLTGAHEMDIHTLGSHDKNNLPLMMALLEFWNTVYLKTDTHVVLPYAQALEKLPDFLQQLSMESNGKRVDLSGSALTLPSAPVLWGSAGTIGQHSYYQLLHQGNRRFTADIILPLSHKEKDLDAQRKLAANALAQSRALLVGRDKSAAQRLAAERGQPESFAPHYEMPGNHSHSLIYFESLTPEILGALIAAYEHKTFFLSRLLGINAFDQWGVELGKVIGRQILTMLEHGEGLEVIDPATAIAVEAWRSANAKNTS

SEQ ID NO: 10359 - protein, 887 aa, Legionella pneumophila str. Paris
MTNETNLDLDPIETREWLDALQAVLFNDGPERTAFLLQQLLNKANAEGVKLTSSINTPYRNTIKPHEEKQMPPDEGIGKRINALIRWNAVAMVLRAGKYAPELGGHIASYASASTLYETGFNYFFKGQKGENGGDLLYIQGHSAPGIYARAFLEGRLTEKQLEKFRQEVEVDGLSSYPHPWLMNDFWQFPTVSMGLGPLQAIYQARFLKYLENRGLIKAEGRKVWAFLGDGEMDEPESVGALSIAAREKLDNLIFVVNCNLQRLDGPVRGNGKIIQELEGLFRGAGWNVIKVIWGGRWDPLFARDNQGWLQKRMEECLDGDYQSYKANDGSYVRQHFFIQYPELKKMVENMSDEEIWRLNRGGHDPQKVYAAYARAVEHKGTPTVILAKTIKGYGMGAAGEGQNITHQQKKMTIDQLKAFRDRFNIPISDDKIADIPFYKPDDDSPEIKYIKKQREALGGYLPHRSTEVEQLKIPDLGEFSSITKGLGDREISTTMAFVRILSALLKNKDINSRIVPIVPDECRTFGMEGLFRQIGIYSPVGQLYTPVDHEQVMYYREAVDGQILEEGINEAGAFCSWIAAATSYSSNKLAMIPFYIYYSMFGFQRIGDLAWAAGDMQARGFLLGGTAGRTTLAGEGLQHQDGHSHVLASTIPNCISYDPTYAYELAVIIQNGLHRMYEKQENVFYYITIMNENYSHPDMPAGVEEGIIKGMYLLKENKKKSKNHVQLMGCGTILREVIKAAEMLEEDFSITSDIWSVTSFNELRKEGLAVERYNNMHPQNKPQESYVTSQLKGRRGPVIASTDYMRIYADQIRPFVPNRYITLGTDGYGRSDTRTQLRHFFEVDAKFIVLAALNALVAEGSLDKAKIVDAMKRYNINQDKLDPMTH

SEQ ID NO: 10360 - protein, 194 aa, Streptococcus mutans UA159
MRQAKIERNTFETKIKLSLNLDTQEPVDIQTGVGFFDHMLTLFARHGRMSLVVKADGDLHVDSHHTVEDVGIALGQALRQALGDKVGINRYGTSFVPMDETLGMASLDLSGRSYLVFDAEFDNPKLGNFDTELVEEFFQALAFNVQMNLHLKILHGKNNHHKAESLFKATGRALREAVTINPEIKGVNSTKGML

SEQ ID NO: 10361 - protein, 656 aa, Pyrococcus horikoshii OT3
MNIKSFINRLKELVEIEKEAEIEAMRLEMKRLSGVERERLGRAILNLNGKIAGEELGYFLVKYGRNREIKTEISVGDLVVISKRDPLKSDLLGTVVEKGKRFIVVALETVPEWALRDVRIDLYANDITFRRWLENLDRVKKAGKRALEFYLGLDEPSQGEEVSFEPFDKSLNSSQRKAIAKGLGSEDFFLIHGPFGTGKTRTLVELIRQEVKRGNKVLATAESNVAVDNLVERLAKDGVKIVRVGHPSRVSRHLHETTLAYLITQHELYGELRELRVIGQSLAEKRDTYTKPTPKFRRGLSDAEIIKLAERRRGIRGLSARLIKEMAEWIKLNRQVQKAFEDARKLEERIARDIIREADVILTTNSSAALEVVDATDYDVAIIDEATQATIPSILIPLNKVDRFILAGDHKQLPPTILSLEAQELSHTLFEGLIERYPWKSEMLTIQYRMNERIMEFPSKEFYDGRIVADERVKNITLGDLGIKVNATGIWRDILDPSNVLVFIDTCMLDNRFERQRRGSESRENPLEAKIVSKIVEKLLESGVKAEMIGVITPYDDQRDLISLNVPEEVEVKTVDGYQGREKEVIILSFVRSNKVGEIGFLKDLRRLNVSLTRAKRKLIMIGDSSTLSSHETYKRLIEHVREKGLYVVLTKDGIR

SEQ ID NO: 10362 - protein, 697 aa, Ustilago maydis 521
MSRFLGRLSRTPSVHSISSQASAAEPLPPKTSDILIKPAPGCTPKPTEPLSAEQQRKLADLEKYVRQIAKEQPPKDDYKTWEDKWLNEPNLYQRYLRAAKGDLDNAKKRIKSTLDWRRDFRPEIIAPGSVAKEAETGKQIVSGFDNDGRPLIYLRPARENTTPSDAQVRYLVWTLERAIDLMPPGVENYAIIIDYHKATTQSNPSLSTARAVANILQNHYVERLGRAFIVNVPWFINAFFSAIVPFLDPVTKDKIRFNANLVDFVPADQLDAEFTGGRYNYEWDFEKYWNTLIKVGDIAEDGTRKTNSAADAQSAQQPKPDETEADAVQKHADAIAASQLTEQGSAIGLGAAAGATTALAVVAGGAAAAATDAYASDTKTSSSAYKYLQSTSDYEELLSKYDTFLFDCDGVLWSGDETIPHVVSVLQKLRQRGKSVIFVTNNASKSRQTYLKKFASMNIQASLDEVFSSSYASAVYLKKVLNFPADRKVYVIGMHGIEEELDAENILHCGGTDAQDNKFLPALDFGSLQTDEAIDPKVGAVVCGFDMHMSYLKLAKAFKHLTRPGFDGPVEAEGMGGGCHFILTNDDSTFPAKGGPWPGAGSLSAPLIFSTKRTPTIVGKPHKPMLDCIIATKQFDPKRAIMVGDRLNTDIEFAKAGGIASMLVLTGISKRDEIEGPHAKTIPDYLIDSLGDLDAVP

SEQ ID NO: 10363 - protein, 328 aa, Cytophaga hutchinsonii ATCC 33406
MKKIAVYTSGGDAPGMNACIRAAVRAGHYHNLEVYGIVRGYDGMINGNFIELDNRAVSNIIQKGGTILKSARSEEFRSPEGRRKAFDQIQKFGIDGLVAIGGNGTFTGAELFYNEYQIPCVGAPGTIDNDLYGSDFTIGYDTAVNTCLAAIDKIRDTADAHERVFFIEVMGRDTGYIAVRSAISGGAEMAIIPEFPYDKNVVINRLKHGTSDTKASHIIIVAEGHQEGRASMIARDIKEALPQLDCRVTTLGHVQRGGGPSAADRVLASRLGLATVEGLLEGRANVMAGIIDHKVVYTPFIDTITKRKPINEDLLSLAEKLNGRSYKV

SEQ ID NO: 10364 - protein, 342 aa, Xanthomonas campestris pv. vesicatoria str. 85-10
MTSIINRRIVLASRPHGEPSADNFRIEEVAVEPTGHDQILVRNRFLSLDPYMRGRMDEGPSYAAPVAIDAVMEGGTVGEVIASNHADYQPGDLLVLPGGWQTHSLLTPTTPLRKLPKDDSLPLSTALGVYGMPGFTAYAGLHEIGKPQPGETLVVAAASGPVGATVAQLARLQGLRVVAIAGGEEKVRYLRDTLQVEVALDHRADDFAEQLRAATPDGIDIYFENVGGKVFDAVLPQLNDFARIPVCGVIATYNSRGQAHPGPDRLPDFMGQVLRKRLTVRGFIQHDFIRLMPAFLREMGQWLREDKIQYREHVLHGLDSAPQGLIDVLRGKNFGKAVVALD

SEQ ID NO: 10365 - protein, 119 aa, Xanthomonas campestris pv. vesicatoria str. 85-10
MAATHPGSGMSTLSTHVLDTASGRPAAGVPLRLFAGETLHFEGVTNPDGRCPDLAALALQPGRYRLEFDLARYWQATGMALADPPFLDCIPIAFGIADDGHYHVPLLLSPYGYSTYRGS

SEQ ID NO: 10366 - protein, 261 aa, Erwinia carotovora subsp. atroseptica SCRI1043
MTAKNNAWVLITGASGGFGEEFARQYAAQGKSLILVARRLNKLELLAAELRERFNIDVMVEQADLSVMTAISDLHSRLREQNIVVDILINNAGHGLQGSFLDQPLDDALDMINLDIASLTAMTRLFAEDMRVRRKGHILMVASLLSYQGVKNFAVYSAAKAYVLRFSDALHRELKDDGIIVTALCPGMSDTGFATVANQKITPLLKGAMMQPKPVVQAGIRALQAGRMSVVPGMGNKAITLLTWATPRWLHQAIMARVMGV

SEQ ID NO: 10367 - protein, 328 aa, uncultured bacterium 581
METKWHLLGDIGGTNARFGICDDQKAPYQLIGSYEVAAFPTFSNVLEQLQSDLIKAGLSMADAGESCLAVAGPPDVQPVSFTNSAWRFDRELVMSTLGLQSVSIINDFAAAARALPLLSENHLEKVGGGRAEPGSPCVALGPGTGLGVATLATTHSGEPLVISGEGGHVDFAPVTNVEAAVLDFLRARYGRVSIERLCCGEGINNIYQALADYRNLKIKYSSAAEIGAAALSADDALSKETMAMFFAVLGAAAGNFALTLGAKGGIYIAGGIVPRYLDLLRRSDFRARFLAKGRFADYLSDIPTFVVTHSQLGLLGASASLNDPHIRG

SEQ ID NO: 10368 - protein, 377 aa, Nicotiana tabacum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDCLMKILTERGYSFTTSAEREIVRDVKEKLAYVALDYEQELETAKSSSSVEKSYELPDGQVITIGSERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWITKGEYDESGPSIVHRKCF

SEQ ID NO: 10369 - protein, 391 aa, Nephroselmis olivacea
MIEAKTDPMIVSMGPHHPSMHGVLRLIVTLDGENVLDCEPVVGYLHRGMEKIAENRTIVQYLPYVTRWDYLATMFTEAITVNAPERLANIEVPRRASYLRVIMLELSRIASHLLWLGPFMADLGAQTPFFYILREREMIYDLFEAATGMRMMHNYFRVGGVAADVPYGWIDKCLDFCEYFLPKVDEYEALITRNPIFLKRVKGVGTISPQQAINWGLSGPMLRASGVSWDLRKVDRYECYEDFHWSVESEETGDCLARYLVRIREMRTSTKIVQQALKSIPGGPTENLEARQLSQGRTSPWNEFDYQFLGKKASPTFKMPRQEHYVRVEAPKGELGVFLIGDDHVFPWRWKIRPPGFINVQILPNLVQGMKLADIMTILGSIDIIMGEVDR

SEQ ID NO: 10370 - protein, 165 aa, Bdellovibrio bacteriovorus HD100
MDLKSLIRDVPDFPKPGIIFRDMSPLLQNAEALSFVSHNLLKHVDLTHVDYFAGIESRGFILAAHMAATHKKGFLPIRKAGKLPPPTRKVSYALEYGTAEIELPPGRGNVVIVDDVLATGGTLQAAIDLCLLAGYSVESVAVLVNLTFLNKMTYNDQKVASLVQY

SEQ ID NO: 10371 - protein, 323 aa, Mesoplasma florum L1
MKRIGVLTSGGDAPGMNNAIAGVVKAAEAQGIEVYGVRDGYKGLINGWFEKLDSKFALEIISKGGTVLGSARLPEFKEESVRQKAVDQLKAHDIEALVVIGGDGSYMGAQRLTEMGINCIGLPGTIDNDIVSSDYTIGFDTALNTVIESVEKVRDTMQSHNRAAVIEVMGNGCGDLVTYAAIATQAEIFSPSESKLTVEQICEQAKKFAEANHRSLIILISEKQLDANELAKKVEEASGYVTRATILGHVQRGGRPSGMDRYLAFTAAIYAVEKLIEGKGGLYIGLSENKLVARDIESTLNMPKPDKTEFIEKIRLLNAKISK

SEQ ID NO: 10372 - protein, 485 aa, Arabidopsis thaliana
MRSFVAFVLLLSWFGSCCSLKDQAVDFLKSEDSLKKDLSSDEDSTYLKAFGFHRKTLVRNPYKDLPSRKDRKNRVVAATTTPSSSPEPAPKHVSTKASTVSEPQKRSSTQDVSPSPSAPLANSPIPRNSHSSVPLVVGCVGGAFFLLLVATGLYFFTSKAGKTVNPWRTGLSGQLQKVFVTGIPVLKRSEIEAACEDFSNVIGSCPIGKLFKGTLSSGVEIAVASFATTTAKDWKDSTEIHFRKKIEMLSKINHKNFANLLGYCEEKEPFTRILIFEYAPNGSLFEHLHYKESEHLDWGMRLRIAMGLAYCLDHMHQLNPPIAHTNLVSSSLQLTEDYAVKVSDFSFGSSETETNINNNTVIDTHISALNPEDNIYSFGLLLFEMITGKLIESVNKPDSVDSSLVDFLRGETLAKMVDPTLESYDAKIENIGEVIKSCLRTDPKERPTMQEVTGWLREITGLSPNDATPKLSPLWWAELEVLSTA

SEQ ID NO: 10373 - protein, 125 aa, Brassica oleracea
DLPQTLQDEYEGFLNRQVIEDFRDFADLCFKEFGGKVKNWLTINQLYSVPTRGYSTGADAPGRCSPKVDARCYGGNSSTEPYIVAHNQLLAHAAVVNLYRTKYRFQRGRIGPVMITRWFLPFDET

SEQ ID NO: 10374 - protein, 389 aa, Arabidopsis thaliana
MADNTDNRRSLWGVPEKLQLHIAMLTLQFGYAGFHVVSRAALNMGISKLVFPVYRNIIALLLLLPFAYFLEKKERPAITLNFLIQFFFLALIGITANQGFYLLGLDNTSPTFASSMQNSVPAITFLMAALLRIEKVRINRRDGISKILGTALCVAGASVITLYKGPTIYTPASHLHAHLLTTNSAVLAPLGNAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRNSIKSSITTPLLHQSTDNV

SEQ ID NO: 10375 - protein, 520 aa, Isatis tinctoria
MESSISQTLSQVLDPTTAILTVVSLFIFIGLIVRRRRPPYPPGQRGWPIIGNMLMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNIGKPINVGEQIFALTRNITYRAAFGSACEKGQDEFIRILQEFSKLFGAFNVADFIPYFGWIDPQGINKRLVKARNDLDGFIDDIIDEHMKKKESQNTVDDGDVVDTDMVDDLLAFYSEEAKLVSDATDLQSSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKKSRVMVNAFAIGRDPDSWVDPETFRPSRFLEPGVPDFKGSNFEFIPFGSGRRSCPGMQLGLYALELAVAHILHCFTWKLPDGMKPSELDMSDVFGLTAPKATRLFAVPSTRLICAV

SEQ ID NO: 10376 - protein, 131 aa, Zea mays
  misc_feature (14)..(14): Xaa can be any naturally occurring amino acid
  misc_feature (123)..(123): Xaa can be any naturally occurring amino acid
MSGSMESTYLRATXTETLPQAQEAQDASKYITILYRGIHDPSLCDDALGTKEAALSNVTDYLTKKNTAEELRNHSTQLRPCVAAIPRAQTAHTGRAISDAAAKIPVTSDLQISLCTDMAEWTXRAEKRAFL

SEQ ID NO: 10377 - protein, 452 aa, Oceanospirillum sp. MED92
MAEYDFDLFVIGAGSGGVRAARMAAGMGVKVAIAEDRHLGGTCVNVGCVPKKLFVYASHYAESFEEAAGFGLTHNGVNFDWPTLRDNKTKEIERLNGIYQNLLVNSGCELINGRAVLVDPHTVAVGDKQYTAERILVAVGGWPNIPDIPGKEHIISSNEVFYLEEFPKRALVVGGGYIAVEFAGIFAGLGAETKLAYRGDLFLRGFDREIREFTAQEVAKKGVDLLFNNNIESIEKQSDGSYLAKMTDGSTIETDLIMYATGRNPKVEGLGLEAVGIEQGKNGAIVVNDDFQTNVPSVYAVGDVIDRVQLTPVALAEGMALVRNLYAGMNQKVDYDLIPTAVFCQPNIGTVGLSEEQAREQYENIEVYKSEFRAMKHTISGSEERTFMKMLVDADSRKVLGVHMVGPDAGEIIQGIGIALKAGATKEVFDSTIGIHPTAAEEFVTMREPSSN

SEQ ID NO: 10378 - protein, 709 aa, Solibacter usitatus Ellin6076
MLEPHTTKAVEPGSPFPLGATLVDGGVNFAIYSKQAAGVFLLLFDSADGAATDVIPLTARDKLVWHACVKGVRAGQLYGYKVSGEYRPDLGLRFNEAKLLLDPYARAVTGKFRNVDNLLLAYAAQPASADLTQDTRDNSAVVPKGIVIDDGFDWQGVGAPKSALEQLVIYEVHVKGFTAHPSSGVSAPGTYLGFIEKIPHLTRLGVNAVELMPVHEHYVDDFLVDRGLTNYWGYNTIGFFAPEVSYGSQREAGCQVAEFKTLVRELHRAGIQVILDVVYNHTAEGNEMGPSMSFRGLDNVSYYCLTGPAEAPRRYYMNYTGCGNSMNFDSPAVIRLVMDSLRYWVEAMHVDGFRFDLASVLGRGADGSFRSTSGFFDAVAQDPVLSRAILIAEPWDTGTYQLGNFPIDWSEWNGKFRDTVRCFAKSDSGQLSQMGWRLTGSADLYGSEGRSAYNSVNFVTCHDGFTLHDLVSYNGKHNEGNGENNQDGTNDNNSWNCGAEGDTTDSGILSLRRQLMRNHACYLMFACGTPMMLGGDEFARSQQGNNNAYCQDNAIGWFDWSLVERNGDLVEFFRKAIAFTRRFPVLQRRKFLLGDDLDADGVADLTWFSPDLGTPAWSDANARVLCYQLDTSDCGDTCDADRLFFILNSDFDSQWVKLPPLAAGHTWFRAIDTSLAAGEDFAENGTEVRVEPDDHYIANARSTVVLLAR

SEQ ID NO: 10379 - protein, 504 aa, Novosphingobium aromaticivorans DSM 12444
MNDMTTISRTQREYSEAAKAFLARKPQLFINNEWVDSSHDAVIEVEDPSNGRIVGHVVDASDKDVDRAVAAARAAFDDGRWSNLPPMVRDRTMNRLADLLEANADLFAELEAIDNGKPKGMAGAVDIPGAISQLRFMAGWASKVAGETTQPYTMPNGTVFSYTVKEPVGVCAQIVPWNFPLLMASLKIAPALAAGCTLVLKPAEQTSLTALKLADLVVEAGFPAGVINIITGNGHTAGDRMVKHPDVDKVAFTGSTEIGKLINRNATTTLKRVTLELGGKSPVVVMPDVDVAQTAPGVAGAIFFNAGQVCVAGSRLYAHRSVFDSVLEGMTQTAPFWAPRPSLDPEAHMGPLVSKEQHDRVMGYIEAGKRDGASVVMGGDCPSADGGYYVNPTILADVNPQMSVVREEIFGPVVVAQRFDDLDEVAKMANDTCFGLGAGVWTRDVAVMHKLASKIKSGTVWGNCHALIDTALPFGGYKESGLGREQGRAGIDAYLETKTVIIQM

SEQ ID NO: 10380 - protein, 247 aa, Triticum aestivum
MAPRKFFVGGNWKCNGTGDDVKKIVTVLNEAEVPSEDAVEVVVSPPFVFLQQATGLLRPDFAVAAQNCWVRKGGAFTGEISAEMLVNLQVPWVILGHSERRALLNESSDFVADKVAYALAQGLKVIACIGETLEQREAGTTMEVVAAQTKAIAEKISDWTNVVLTYEPVWAIGTGKVHDGLRKWLQANVGPAVAESTRIIYGGSVNGANCKELAAQPDLDGFLVGGASLKPEFVDIIKSATVKSASA

SEQ ID NO: 10381 - protein, 173 aa, Nephroselmis olivacea
MFDFLTSLQTYRQEAAQAAQYIGQGFGVTFDHMSRRPITIHYPYEKLIPSERFRGRIHFEFDKCIACEVCVRVCPINLPVVDWDYQKSVKKKQLRSYSIDFGVCIFCGNCVEYCPTNCLSMTEEYELSVYDRHELNFDHVALGRVPTSVVQDTLVTPVLGLGYLPKGELSSLP

SEQ ID NO: 10382 - protein, 223 aa, Oryza sativa (japonica cultivar-group)
MEKAAANQAGKVLKKGKKKQAKDELDRQKQAEKKRRRLEKALANSAAIISELEKKKQKKREEQQRLDEEGAAIAEAVALHVLIGEDSDEPCHLMLNKHRRCNHWDHSAGFDFAVDAQGADIYPPDGLIQCADHVYAPKGRCIDWGIGQPLPSWGEVKDLQLQAPCYQGMFHQSVACPGFIAAQAVSSLQIGGDSSDITSPSQGATVVNRMLGATNRLNLYREI

SEQ ID NO: 10383 - protein, 465 aa, Oryza sativa
MGKAARWFRSLWGGGGGKKEQGREHGRTAAAPPPPDRKRWSFAKSSRDSTEGEAAAAVGGNAAIAKAAEAAWLKSMYSDTEREQSKHAIAVAAATAAAADAAVAAAQAAVEVVRLTSQGPPTSSVFVCGGVLDPRGRAAAVKIQTAFRGFLAKKALRALKALVKLQALVRGYLVRRQAAATLQSMQALVRAQAAVRAARSSRGAALPPLHLHHHPPVRPRYSLQERYMDDTRSEHGVAAYSRRLSASIESSSYGYDRSPKIVEMDTGRPKSRSSSVRTSPPVVDAGAAEEWCANSVSSPLLPFHQLPGAPPRISAPSARHFPEYDWCPLEKPRPATAQSTPRLAHMPVTPTKSVCGGGGYGASPNCRGYMSSTQSSEAKVRSQSAPKQRPEPGVAGGTGGGARKRVPLSEVTLEARASLSGVGMQRSCNRVQEAFNFKTAVLSRFDRSSEPAAERDRDLFLQRRR

SEQ ID NO: 10384 - protein, 125 aa, Brassica rapa
DLPQTLQDEYDGFLNRQVIEDFRDFADLCFKEFGGKVKNWLTINQLYSVPTRGYSTGADAPGRCSPKVDERCYGGNSSTEPYIVAHNQLLAHAAVVNLYRTKYRFQRGRIGPVMITRWFLPFDET

SEQ ID NO: 10385 - protein, 48 aa, Glycine max
SPFYTLYPLTTDISPCYYRITSAICAFNIGSLFTTSLCYVTSKEHLFF

SEQ ID NO: 10386 - protein, 168 aa, Magnaporthe grisea 70-15
MSEGQLQKVNLQSNDGQSIEVDRAVACRSRLIKDLIGDLGEEMVASTPIPIPNVSEAVLRKVLEWCEHHRNDPVQTSDEDSESRKKTTDIDEWDQKFMQVDQEMLFEIILASNYLDIKPLLDVGCKTVANMIKGKSPEEIRKTFNITNDFTPEEEEQIRRENEWAEDR

SEQ ID NO: 10387 - protein, 116 aa, Brassica oleracea
DLPQVLQDEYEGFLDPQIIHDFKDYANLCFQEFGHKVKNWLTINQLYTVPTRGYGAGSDAPGRCSPMVDPTCYAGNSSTEPYIVAHNQLLAHATVVDLYRKNYSIGPVMITRWFLP

SEQ ID NO: 10388 - protein, 495 aa, Mycobacterium leprae
MPGQSSGYCQRAGDPRSQCSGADVNVHTAGPRHAEKTRHTATPQRVQPSDDLLRLASNVWPRNITRDETGVACIAGNKLTDLAGEYGTPLFVIDEDDFRFRCREIAAAFGGGENVHYAAKAFLCTEIARWIDEEGLSLDVCSGGELAVALHASFPPERISLHGNNKSVAELKDAVKAGVGYIVLDSTTEIERLDAIAGEAGIVQDVLVRLTVGVEAHTHEFIATAHEDQKFGLSVASGAAMAAVRRVFATDNLRLVGLHSHIGSQIFDVAGFELAAHRVIGLLCDIVGEFDPEKTAQLSIVDLGGGLGISYLPDDDPPPIFELAAKLGAIVSNESAAVGLPVPKLMVEPGRAIAGPGTITLYEVGTIKDVDVSATAHRRYVSIDGGMSDNIRTALYDAQYDVRLVSRTSDAPAAPASIVGKHCESGDIVVRDTWVPDDLKPGDLVGVAATGAYCYSLSSRYNMLGRPAVVAVCAGQARLILRRETVDDLLSLEVR

SEQ ID NO: 10389 - protein, 321 aa, Brassica napus
VRLHALRQRQPGKHFSEYAARFYAAEVLLALEYLHMLGVVYRDLKPENVLVRDDGHIMLSDFDLSLRCTVSPTLIKTFDSDPSKRGAFCVQPSCMMEPTTSCFSPRSIFSNKSKKNNKTRSKTQTDVSRSHSGSLPELVAEPNTRSMSFVGTHEYLAPEIIKGEGHGSAVDWWTFGIFVHELLYGKTPFKGSGNRATLFNVVGEQLKFPESPATSYAGRDLVQALLVKDPKNRLGTKRGATEIKQHPFFEGVNWALIRCGTPPEVPRQMEVEPPPKYGPIDPVGFGSNSKRMMGPPPVSAASVGAGGDTKAGGKFLDFEFF

SEQ ID NO: 10390 - protein, 449 aa, Desulfovibrio desulfuricans G20
MSTNYPVFNCKNGDDVIRAVKDYNVSFVQFWFVDILGNLKSFQVTPDELEAAFEEGMGFDGSSILGFTRIEESDMIAFPDASSFQICSWRPMDRPVARMFCDIRTPDGNPYEGDPRYVLRRLVDKAAQKGYTYYVGPELEFFLFADSTCPRPLDSGGYFDAPPLDLGNEVRRDIIFALQKMGIDVEYSHHEVAPSQHEIDLRYNEALKMADIAMTYKVVVKEIARKHGVYATFMPKPIFGENGSGMHVHQSLFKNGKNAFFDANDPHHLSAEARHYIAGLLTHASEITCITNQWVNSYKRLVPGYEAPVYIAWAQRNRSSLIRVPMYKPGKEAATRIELRNPDPACNPYLAFAAMLGAGLEGIEKGYEVPRAVEENIFAMEAEDLSAKGIDSLPGSLYEAAVALRDSALMKEVLGEHTHQNLVGNKLIEWDAYRTHVSEFELKRYLPVL

SEQ ID NO: 10391 - protein, 383 aa, Pyrococcus horikoshii OT3
MKFPRIGLPKEKVIELINEKTKKDLTFSSGKILGSMCTMPHDLAIEVYTKYIDRNLGDPGLHPGTRKIEEEVIEMISDLLHLEKGHGHIVSGGTEANILAVRAFRNLSDVEKPELILPKSAHFSFIKAGEMLGVKLVWAELNPDYTVDVRDVEAKISDNTIGIVGIAGTTGLGVVDDIPALSDLARDYGIPLHVDAAFGGFVIPFAKELGYELPDFDFKLKGVQSITIDPHKMGMAPIPAGGIVFRRKKYLKAISVLAPYLAGGKVWQATITGTRPGASVIAVWALIKHLGFEGYMRIVERAMKLSRWFAEEIKKINNAWLVREPMLNIVSFQTKNLKKVERELKSRGWGISAHRGYIRIVFMPHVTREMIEEFLKDLKEVLS

SEQ ID NO: 10392 - protein, 434 aa, Saccharomyces cerevisiae
MSLPGSKLEEARRLVNEKQYNEAEQVYLSLLDKDSSQSSAAAGASVDDKRRNEQETSILELGQLYVTMGAKDKLREFIPHSTEYMMQFAKSKTVKVLKTLIEKFEQVPDSLDDQIFVCEKSIEFAKREKRVFLKHSLSIKLATLHYQKKQYKDSLALINDLLREFKKLDDKPSLVDVHLLESKVYHKLRNLAKSKASLTAARTAANSIYCPTQTVAELDLMSGILHCEDKDYKTAFSYFFESFESYHNLTTHNSYEKACQVLKYMLLSKIMLNLIDDVKNILNAKYTKETYQSRGIDAMKAVAEAYNNRSLLDFNTALKQYEKELMGDELTRSHFNALYDTLLESNLCKIIEPFECVEISHISKIIGLDTQQVEGKLSQMILDKIFYGVLDQGNGWLYVYETPNQDATYDSALELVGQLNKVVDQLFEKASVLY

SEQ ID NO: 10393 - protein, 311 aa, Haemophilus influenzae R2866
MNYLKIAQDSLSVESNALLQLSQRLGEDFNQVIDLILACEGRLVIGGIGKSGLIGKKMVATFASTGTPSFFLHPTEAFHGDLGMLKPIDIVMLISYSGETDDVNKLIPSLKNFGNKIIAVTSNKNSTLARHADYVLDITVEREVCPNNLAPTTSALVTLALGDALAVSLITARNFQPADFAKFHPGGSLGRRLLCKVKDQMQTRLPTILPTTNFTDCLTVMNEGRMGVALVMENEQLKGIITDGDIRRALTANGVETLNKTAKDFMTSSPKTIHQEEFLSKAEDFMKAKKIHSLVVVNDENHVVGLVEFSS

SEQ ID NO: 10394 - protein, 344 aa, Nocardia farcinica IFM 10152
MPDINRRLVLARRPEGRVRPTDLELRTVALPDPGPGQALVRNTWLSIDPSVRIRFAATTPRGYLPPLREGEPLAGLALGEVVASRHPGFAVGDLVSHTLGYRDYAVVGADSATIGGYGAPTRIDTDGLPPQWFLGPLGSAGLTAYVGLTAILELRPADTLWVSAAAGAVGGLAAQLARLRGATVIGSAGGPAKVAFLRDELGIAAFDYRACPPAAALAELAPAGLDAYFDNVGGEHLTAALDAMRAEGRIALCGAVAEYDGAGAAGPGNLFQMVSKQLRMRGFRAGSFTDLEPAMRAEVAAHLRAGRLVHRETVFDGLERAADALCAMLAGETVGKTLCRLIPA

SEQ ID NO: 10395 - protein, 310 aa, Solibacter usitatus Ellin6076
MATRSLLGVVPALVTPFREDERIDCSAWQVLIDMLVASGVDGLFVGGSSGEFCTMDMEERVVALRFCKQAVAGRVSLIANVGCITTRDTIALAQQAESIGADAIAVITPYYIRPTQQELTDHLVDVCRAVRMPVLAYNFPFHGGVELAPETLAAVAAKAPNLAGVKDSSGHIELAVAYRNAVTDRDFAVFTGGDHIMLAALEAGCAGTITAAANFSPKAFVDLYRKHRENSRGEALRLQALVTEMGAALGLHTFPAVVKEALAMAGFPMGPCRKPVGKLPDEARRKLAVMMDHLRNEGVLPEIAGRVSAS

SEQ ID NO: 10396 - protein, 128 aa, Coccidioides immitis
MSAKQVVLTDKAPAPLPVLSQGIIHNGIVYCSGQVGIDPASKQMVEGTVQDRTAQIFRNLSAVLEKAGSSLEKVIKVNVFLANMDDFSAMNEIYSQFLNQEPKPVRTCVAVKSLPLGTDVEIECSAYI

SEQ ID NO: 10397 - protein, 170 aa, Triticum aestivum
  misc_feature (26)..(26): Xaa can be any naturally occurring amino acid
  misc_feature (122)..(122): Xaa can be any naturally occurring amino acid
RRWPHRLALVAALLCAGAAAAAAQQXASNVRATYHYYRPAQNGWDLGAPAVSAYCSTWDAGKPFSWRSKYGWTAFCGPAGPRGQASCGRCIRVTNTGTGAQITARIVDQCANGGLDLDWDTXVFVKIDTDGMGYQRGHLIVNYQFVDCGDNHINFHGKNETLPASTGAVE

SEQ ID NO: 10398 - protein, 372 aa, Legionella pneumophila str. Paris
MSSKSGGLAGVVAGQSAIATVGLAGKGLNYRGYSINDLAEYASFEEVAYLLHYGELPTQKELNVYIKKLVNLRHMPDVLKTVLKLIPKNTHPMDVLRTACSFLGTIEPEENFKQQYEIADRLLALFPGIMCYWYTYHFKNKEISGLSEEDTTGGHFLALLHGRKPSKIEADMMNVSLILYAEHEFNASTFAARVTAATLADFYSAITSAIGTLRGPLHGGANEAAMELIERFKTPDEAAIGIKQMLASKELIMGFGHRVYTTCDPRSDIIKKWSFRLGEEKGNLLLYHISERIEEIMWQEKKLFPNLDFYSASAYHYCNIPTHLFTPIFVMSRITGWSAHVFEQRANNKLIRPTSEYIGPDSRPFPAIETRG

SEQ ID NO: 10399 - protein, 1064 aa, Bdellovibrio bacteriovorus HD100
MPRKSSIKRVLIIGSGPIVIGQACEFDYSGTQACKALMKEGLEVILVNSNPATIMTDPEIATRVYVEPLKVDYLEKIIAKEMPDAVIPTLGGQTALNLALDLHAKGILQKYKVQLLGATPQVIKAGEDREIFRGLLDKIGAKYPKSHLIRTYEHGLQIADELGYPMILRPNYTLGGGGGGIAYSPEEYKKMLVTALHESPTSEVLVEESILGWKEYELEVMRDHKGTFVVVCSIENLDPCGVHTGDSITVAPQQTLSDREYQSMRDEACKIINEVGIETGGANIQFAVHPTTKERVVIEMNPRVSRSSALASKATGFPIAKIAALLAIGYSLDELQNDITKVTPSCYEPALDYIVTKIPRFAFEKFAGSKDSLTTQMKSVGEVMGIGRTLQESLMKALASLEKDPQAIPEVELETGKISYPNSRRIYHLFQAFRDGKTVAEIEELTRINPYFLEHIEALIKFERMFRADFTENNVDLLLKAKRKGFTDARLAALIGKKEADIRALREKHQMFPRYQQVDTCAGEFESSTPYFYSSYWPMASAKVDAPDAVVVIGSGPNRIGQGIEFDYSCVRGVKGFQKNGRKVIMVNSNPETVSTDYDTSDVLFFEPLTVESLSEIMRFMKPYGFVAQLGGQTPIGVAPDLVKAGYRLLGSSLETIDLAEDRGLFSKICRELNFEIPNSGMAGSLEEALRIEKNVGYPMICRPSYVLGGRRMEVIENTEELLSYFQRHKDYISPEKPCLMDQFLAGALEVDVDLVRGEDWVVVGGIVEHIEAAGVHSGDSMGVLPPHRLKPETCERIEDLSKQLANRIGVIGHLNLQLAVKNDVVYMLEANPRSSRSVPFVAKATGIPLIDLGVAAMLGKKKKDLKLENLNWRKTESVSVKGVVFPFKKFPESDSILGPEMKSTGESMGRGKNYSEALAKAFLSSNIRLPKIGQVFFSLRDKDKEVMLPLARELQRMGYGVSATTGTANFFNEKGVNCLSLRKVDEGRPHCVDKIRSGDVAFVINTTSGRRAIEASFDIRRACTDYNIPCLTESDAAEAFILALKNERNESSSVEALGAMEEF

SEQ ID NO: 10400 - protein, 428 aa, Legionella pneumophila str. Paris
MSRSSDLFHKAQTIIPGGVNSPVRAFKGVGGEPVFFKSGKGAYLTDVDDKQYIDYVGSWGPLILGHCHPKVIEAVDNVLHSGMSFGAPTELEIQLAEKIASLMPSIEKIRMVNSGTEATMTAIRLARGFTNKNKFIKFNGCYHGHSDSLLVKAGSGLLTLGIPSTPGIPKSITEHTLTADFNNLEQVAQLFEKYPNDIATVILEPVPGNMGFILPKIEFLKGLRELCDQYNALLIFDEVMTGFRVGLHGAQGLFGIKPDITTLGKIIGGGMPVGALGGKREIMSFLAPEGPVYQAGTLSGNPLAMAAGLATLKEIEKINFFEDLSNTTNKLTEALADAAENANIPFFAASLGGMFGFCFTDKNSVENYFDVASSDEVLFKKFFHAMLAQGVYFAPSMYEAGFVSSMHGDLEIQKTYDAAELVLNQLSA

SEQ ID NO: 10401 - protein, 424 aa, Rhizobium leguminosarum bv. viciae 3841
MTAITDIIAREILDSRGNPTVEVDVYLEDGSMGRAAVPSGASTGAHEAVELRDGGKRYLGKGVEKAVEAANTEIFDAIGGIDAENQIQIDNIMIELDGTPNKSRLGANAILGVSLAVAKAAAQASGLPLYRYVGGASACLLPVPMMNIINGGAHADNPIDFQEFMILPVGADSIAEAVRMGSEVFHTLRKELAAQGHNTNVGDEGGFAPGLKSAPEALDFIMKSIEKAGYKPGDDMCLGLDCASTEFFKDGKYVLEGEGRTLESGAMAEYLAELAANYPIISIEDGMAEDDWDGWKTLTDLAGKKTQLVGDDLFVTNSARLRDGIRMGVANSILVKVNQIGTLTETLDAVNTAHKAAYTAVMSHRSGETEDSTIADLAVATNCGQIKTGSLSRSDRLAKYNQLIRIEEGLGPQAQYAGRSIIRG

SEQ ID NO: 10402 - protein, 463 aa, Rhizobium leguminosarum bv. viciae 3841
MPIDILMPALSPTMEEGTLSKWLKQEGDKVTSGDVIAEIETDKATMEVEAVDEGVIGKLLVPAGTEGVKVNAKIAVLLQDGESASDMSASAPAAAPAAAPQAAQEEKPAAATPASAPVPAEPKAQVQNDPEIPAGTEMVSTTVREALRDAMAEEMRADENVFVMGEEVAEYQGAYKVTQGLLQEFGPRRVVDTPITEHGFAGVGVGAAMAGLRPIVEFMTFNFAMQAIDQIINSAAKTLYMSGGQMGAPIVFRGPNGAAARVGAQHSQDYAAWYSAIPGLKVVMPYTASDAKGLLKAAIRDPNPVIFLENEILYGQHFDVPKLDNFVLPIGKARIHRPGKDVTVVSFGIGMTYAIKAVAELEKLGIDVELIDLRTIRPMDLPAVIESVKKTGRLVTVEEGYPQSSVGTEIATRVMQQAFDYLDAPILTIAGKDVPMPYAANLEKLALPNVGEVVDAVKAVCYK

SEQ ID NO: 10403 - protein, 451 aa, Rhizobium leguminosarum bv. viciae 3841
MPINITMPALSPTMEEGNLSKWLVKEGDKVKSGDVIAEIETDKATMEVEAVDEGTVAKLVVAAGTEGVKVNALIAVLAADGEDVAAAASAAGSAAPAPKADGAAAPKAEAAPAPAQSTPAAAPAPAAAPASVSADGNRTFSSPLARRLAKEAGIDLSAVAGTGPHGRVVKSDIEAAVAGGAAKAAAPAAAASAPQASAAPAAAPKGASEEAVLKLFEPGSYELVPHDGMRKTIARRLVESKQTIPHFYVSVDCELDALLALRAQLNDAAPRKDNAPAYKLSVNDMVIKAMALSLRDVPDANVSWTDSNMVKHKHADVGVAVSIPGGLITPIIRKAEEKTLSTISNEMRDLGKRAKDRKLKPEEYQGGTSSVSNMGMMGVKNFAAVVNPPHATILAVGAGEQRVVVKKGEMAIATVMSVTLSTDHRCVDGALGAELLQAFKGYIENPMGMLV

SEQ ID NO: 10404 - protein, 324 aa, Lactobacillus reuteri
MAKKTYIKAITEGIDIALAEDPKTLVFGEDVGKNGGVFRATNGLQEKYGKDRVFSTPLAESGILGLSIGLAATGWRPVSEIQFMGFTFEAMDSIAGQMSRVRFPIGWSKNMPITIRLHTVVVSTAELHGDDLENFFVGIPGLRVVTPSSAYDAKGLVISAIENNDPVLFLENLRLYRSVKGEVPDDKYTVPLDKANVVEEGNDVTIIAYGGEVSEAQKAAKKLAKKNISAEIIDLRSLYPLDTDTIFESIKKTHRVVIVQEAQKMAGVGAQVASAISEGAIMYLDAPVIRVAAPNSVYPFPQAENVWLPGADDIEDAATQAVNY

SEQ ID NO: 10405 - protein, 527 aa, Nocardioides sp. JS614
MTQPAEHDLVLVVDFGAQYAQLIARRVREARVYSEIVPHTTPVAEILAREPKAIILSGGPSSVYEPDAPSIDPAIFTSGTPVFGMCYGFQLMAQGLGGEVAHTGAREYGRTAVAVARPGTLLADIPAHHTVWMSHGDSVAAAPSGFDVLASTATTPVAAFEDVDRGLAGVQWHPEVLHTEHGQKVLEHFLVQIAHCRQTWTMVNIVEEQIEAIRAQIGDRGQAICGLSGGVDSAVAAAIVQRAIGDRLTCVYVDHGLMRQGETEQVERDFVAATGVDLKVVDAEKQFLDALAGVTDPEEKRKIIGREFIRVFEAAEADILGGSLPDDGGSKVAFLVQGTLYPDVVESGGGAGTSNIKSHHNVGGLPDDLEFELVEPLRTLFKDEVRLVGEQLGLPAEIVWRQPFPGPGLGIRIIGEVTRERLDILREADAIAREELTRAGLDRDIWQFPVVLLADVRSVGVQGDHRTYGHPVVLRPVTSEDAMTADWARLPYDVLERISTRITNEVREINRVTVDITSKPPGTIEWE

SEQ ID NO: 10406 - protein, 733 aa, Brachypodium sylvaticum
MSLSLPAGQKLLLLVATTLTLQHSTTADVSGSSGSISMARPGCPEKCGNISIPYPFGTGKGCFREPFNVTCNENRAYLASTGVRLLDINLNLGEVRVQNPHIAWQCNYTNGTNSSSSVGLSLDPFHKVSNTKNKLVSIGCSTLALIVGVTMGKNQLEYPIVNSCFSFCTDASTVGDSTGCLGMGCCQTSFPGNISSFYTTSLPLPGISNSTIMSFSPCSYSFVAEEDWFKFDPSYVSSTNFTSKYTDGVPLVLDWVIGNGSCSEASKMGSQYACQVMNSVCIDVSNGPGYHCNCSQGYEGNPYIQGGCQDINECDPPNQSLYPCKGNCWNTDGSYTCISISVVFLMVCIFALRAEYQKRKLAKEKEIFFDQNGGQILYHQIMSKQVDTLRIFTQDDLKKATNNFDKSRELGTGGHGTVYKGILKDSRVVAVKRSKIINLAQADEFVQEIIILSQTNHRNVVRLLGCCLEVEVPILVYEFIPNGTLFEFIHRNCRSPPPSLDTRLRVAQESAEALAYLHLSANRPIVHGDVKSMNILLDDNYMAKVTDFGASRMLPKDTVQFMTMVQGTLGYLDPEYLQERQLTEKSDVYSFGVVLLELITKKTAIYHDGPKEGKSLASSFLLAMKEENLEGILDPSIVGAGTEVLLAEVAELGRMCLGPRGEDRPSMTQVADKLKFVRTTWREKLASDHGKTERLVVHLSPAATAPWDPRLSNKSSNCSTAPYMSGIGIETPR

SEQ ID NO: 10407 - protein, 249 aa, Pyrococcus horikoshii OT3
MMAEVARVLASSKNVIAFTGAGISAESGIPTFRGKDGLWKKYRPEELATPEAFERNPKLVWDFYKWRIKKILKAKPNPAHYALVELEKMGILKAVITQNVDDLHREAGTKNLIELHGNIFRVRCTSCEFREHLKESGRIDEILSEDLPKCPKCGSLLRPDVVWFGEPLPSKELNEAFKLAKEADVVIVVGTSGLVYPAAYIPYIVKDSGGVVIEINVQKSGITPIADFFLRGKAGEILPKLVQEVRRIL

SEQ ID NO: 10408 - protein, 480 aa, Nocardioides sp. JS614
MTLDRSAFFIDGGWAAPATSATLQVVSPHTEQVVATVPEGSAADIDAAVAAARRAFDDGPWPRMSPQERIEVVQAFSNLYAGKLAEMAELITIEMGSPTSFANLAQSPAPWMQIESFLAVARAFPWEEARPGALGADVIVRREPVGVVAAIPPWNVPQFTTMSKVVPALLAGCTVVVKPAPETPLDTYLMAELLAEAGVPAGVVNIVAAGREVGEHLVAHPGVDKVAFTGSTAAGRKIAAVCGEQLKRVSLELGGKSAAIVLDDADLAATMEGLKFTALMNSGQACVAQTRILASRSRYDEVVDALAATVSGMQVGDPMDPATEIGPLVAQRQQERVEKYIALGQEEGARVVVGGNGRPDGLDAGWYVRPTVFADVDNRMRIAREEIFGPVLSVIPFDDVDDAVRIANDSDYGLAGTVWTGDVEAGLDVARRVRTGTYGVNTYTMDFAAPFGGYKSSGIGREFGPEGLAQYTELKAIYTP

SEQ ID NO: 10409 - protein, 707 aa, Zea mays
GYYLADEPDVHFVWQPNQESSVLVMSRAFDDYCIEDCGVILAPEVTQRRIDNSDQFVILATVRPPVLLSSRHIPYLDGLLSGSHATREAKETTRTSSTISMFCQLEVSWMEINAEVEIVDAHAIEVELRRDTYADENVDVGDNEGGIASERRPPLLSCSSHLPSSSTLMDMVHLEGFKFSSSNIYHNSTRELVDYLLKSFSCRCTEAVALSTILLVTVASYQFIDMRGFELATPQANVLVATTTPHEVLALASLIDDEKKLGDCQLDLWKQSYVAAYAAVFGKLQRSRRLDAVQSGCTTLSIIKRGPHGRRQRRRLSGCSRHRIRRWRHYVVQLIIHLKPNLPRSSLKPGRRANFFLTHFFSKAKGGGCKCKRNETKRPWQKMGSQGKGNRSKESQQMAFPTTICSESGGGGSSYVVYGAAAASHGSSTSDVEIQLPWGSSSVLQQQQKASSPRSSSRTTATTTSPGSNMLEFSNNSSSSPRECISTVSGSAFKKARTQEPSPAQSTVKVRKEKLGDRITALHQLVSPFGKTDTASVLLEAIGYIRFLHSQIEVVFFGLIVNTPSLVFNSTLEPNMCASFMKYFGFTELALSSPYVGGSNGGGGGSKQNQQLHEASAQRESRHSIFPEDPGQLLHDSSAIKKRAGLQPADGEQDEESCDEEKKKDLRSRGLCLVPVSCTLDVGVDVVAGPADYWAAAAPAFGMGFGA

SEQ ID NO: 10410 - protein, 545 aa, Saccharomyces cerevisiae
MLPRLGFARTARSIHRFKMTQISKPFFHSTEVGKPGPQQKLSKSYTAVFKKWFVRGLKLTFYTTLAGTLYVSYELYKESNPPKQVPQSTAFANGLKKKELVILGTGWGAISLLKKLDTSLYNVTVVSPRSFFLFTPLLPSTPVGTIEMKSIVEPVRSIARRTPGEVHYIEAEALDVDPKAKKVMVQSVSEDEYFVSSLSYDYLVVSVGAKTTTFNIPGVYGNANFLKEIEDAQNIRMKLMKTIEQASSFPVNDPERKRLLTFVVVGGGPTGVEFAAELQDYINQDLRKWMPDLSKEMKVILIEALPNILNMFDKTLIKYAEDLFARDEIDLQVNTAVKVVEPTYIRTLQNGQTNTDIEYGMLVWATGNEPIDFSKTLMSRIPEQTNRRGLLINDKLELLGSENSIYAIGDCTAHTGFFPTAQVAHQEGEYLAKILDKKLQIEQLEWDMLNSTDETEVSRLQKEVNLRKSKLDKFNYKHMGALAYIGSETAIADLHMGDSSYQLKGMFAFLFWKSAYLAMCLSIRNRILIAMDWTKVYFLGRDSSV

SEQ ID NO: 10411 - protein, 429 aa, Desulfovibrio desulfuricans G20
MAESPQARSFRVVCPAGQESLVEALLHSQGYEFEPEPVSPWTRRLTKEPRPLGSSLAAFFGLIYIQDRSSMLPPLALAPQNGDAVLDMCASPGSKTGFLAQLAGPDGFVMGNEPNAQRLATLRQNLFNLNLPHTATCGYAGESLPLPDASWQKIQLDPPCSGWGTVDKNPNVMKLWQGDKVKPLVGIQRLLLREAARLLAPGGVVVYSTCTTNVQENEEQVRWATQELGLIPEPLAPFEGFVFEDPLLPGCEGTLRVDASRSSAQGFYIARFRKEGDSPPPEPVSAMRVQGIHRQALRGPCADPDMLPDGEVALFGSAAMFLPQQALNLLPESFRWRGYPLGKASRGEVRVSPRMRCMMPPADQCAAGALNVEEPELISGLLSGQSIDLARGAYAGSVDASLPEAGLYFRGLPLGRLRIKGRRALWAER

SEQ ID NO: 10412 - protein, 289 aa, Arabidopsis thaliana
MNLLKTIHYQSTITRFYRFAPTRSFASSVSLSPQRHIISLVSISNRGRCFAFSSVSGASLYNNQEDGKKEESERNYASTKEGDEVVYQKTLRLVECAMFAAVTGLVYFLSNSLAIENYFGCFFSLPIVISSIRWNIAGGRKTMVATVMLLFILSGPVKALTYFLTHGLVGLALGSLWSMGASWRLSIFLCTMVRALGLIGYVLTSSFLIRENILAVITINIHASLSYVFTAMGLNIMPSMSLIYMIFGTVLLLNSGFFVLLLHLLYSIFLTRLGMKSSLRLPAWLDKAI

SEQ ID NO: 10413 - protein, 180 aa, Oceanospirillum sp. MED92
MSYDECYVKSVIRTIPDWPEPGVQFRDITPLFKDPKALRMISDAFIQRYIDSEITHIASIDARGFLISSIMAYHLNIPLVLVRKKGKLPGETIHQEYKLEYGTAAVEMQLDAVTEGDKVLVFDDLIATGGTILAACSLIKELGAEVYEAAALIDLPDLQGSSKIQDAGVPVHSLLAFEGI

SEQ ID NO: 10414 - protein, 545 aa, Eutrema wasabi
MKLHGLALVFLLAVATCKAVEDITCQEKEPFTCSNTDSLNSKSFGKDFIFGVASSAYQIEGGRGRGPNTWDAFTHRYPEKGGPDLANGDTTCESYTNWQKDIDIMDELNATGYRFSFAWSRIIPKGKVSRGVNQGGLDYYHQLIDGLIAKKITPFVTLYHWDLPQTLQDEYEGFLNRTIIDDFRDYADLCFKEFGGKVKHWITINQLYTVPTRGYGIATDAPGRCSPAIDKRCYGGNSSTEPYIVAHNQLLAHAAVVNLYRTKYKFQGGKIGTVMITRWFLPFDENDKDCIDATERMKEFFFGWFMEPLTKGRYPDIMRKIVGSKLPNFTEAEARQVAGSYDFLGLNYYVTQYAQPTKTIVPPENHTAMMDANVTLTYVNSRGELIGPLFAKDDDPKKNSYYYPKGIYFVMDHFRTRYFNPLIYVTENGISSPGTEPREVAIADSKRIDYLCSHLCFLRKVIKETGVNVKGYFAWSLGDNYEFCKGFTVRFGLSYVNWTDVTDRNLKDSGKWYQRFINVTTNNPPAKQDFLRSSLSFHNKNLADA

SEQ ID NO: 10415 - protein, 257 aa, Nocardia farcinica IFM 10152
MSESAFLDTMFGLHGRVAVVTGASSGLGLGFARTLAGAGATVYAAARRLDRLDALAAENPRIVPVRCDVTADADRRALVDRCHAEHGRLDVLVNNAGRPGPPHAEEETAAGFAAILEVNLLAGFHLATYAATRLPAGERASYINIASVVGLVSTAPIGGASYAASKAGTLGLTRELAGQWGRRGIRVNAVVPGWFDTEMTDGLFDNEKSAGWVRRNTMLGRGGAPGEVDGAVLFLASDASSYVTGQTLVVDGGWTAR

SEQ ID NO: 10416 - protein, 660 aa, Oryza sativa (japonica cultivar-group)
MSRDLDCPVQTQMAVAVLDRSFSSEYPASSRTEGRSCSWKRVFVQTENGYVLGIELERGENAHTVKKKLQVALKVPTEESSLTFGDLVLNNDLSSIRNDSPLLLRKNQMHRSSSTPCLSPTAHDVQEQDHSEPIEILGCLSPSSRMKQLAKDVVEAIRNGVDPVPVNSGMGGAYYFKNIYGERVAIVKPTDEEPFAPNNPKGFVGKTLGLPGLKRSVPVGETGLREVAAYLLDHDNFANVPPTMLVKITHSVFNVNDTVSCKSKVFHNKLQAVSKLASLQQFIAHDYDASDHGTSSFPVSAVHRIGILDIRIFNTDRHAGNLLVRKLGPGPDNFGVQTELIPIDHGLCLPESLEDPYFEWIHWPQASIPFTEEELEYIANLDPVKDAEMLRLELPFIRGACLRVLVLSTIFLKEAAAFGLCLSEIGEMMSRQFTGKEEEPSELELLCMEARKWVKKRELFLPEAGVEDDNDGITQFSIDSEDGSDASELPSFSKFGLMNASHRNPLSKLDECDEEDGEEEEDDDGDEEDDDEDMFKDDAGNLKNPFSKHIPSVSKLSASFKGLGFIGKARAYHKGVPKNKVTAKTNYSGKGSEHQSGSRSANELLPPSASFVKLSDMGSDEWSAFLDKFQELLPSAFRARKHAAADGPRPLQRLGTSCQF

SEQ ID NO: 10417 - protein, 375 aa, Glycine max
APPRKIFKTPPPKKGENWGPGAPPPGDRAPPRVSYVGPPPPFFYKPCNYELFVKQSLNMEMAIVMARDSGMNWILHLDTDELMHPAGAREYSLRQLLLDVPGHVDMVIFPNYESSIERDDIKEPFSEVSMFKKNYDHLPKDTYFGMYKDSIRGNPNYFLTYGNGKSAARIQDHLRPNGAHRWHNYMKTPNEIKLEEAAVLHYTYAKFSDLTSRRDRCGCKPTKEDVKRCFMLEFDRTAFIIASTATEEEMMKWYNEHVVWGDKDLKMKLLRKGVLTRIYSPMVIIQSLRESGVFSSVIASAPSLSKENFLLSIDSSNSSRVSASVTLPSRKVGRTKESQAATRKALSVESAAFHEVAVPPLSPPVVDDNDLISHN

SEQ ID NO: 10418 - protein, 358 aa, Cytophaga hutchinsonii ATCC 33406
MSASKAVNFPIERTQHSRLSETDFSNLEFGTVNSDHMFVVDYKKGEWVDPKIIPFQNISVSPACSSLHYGQTVFEGMKAFRAPNGDLLVFRPEKHLERMNNSNRRLCIPEIPAEYFYDAIDALVKLDQDWIPNQEGCSLYLRPFIFANDPFIGVKPSSAYKFMIFTCPVAGYYKGTVKVIIESDFVRASPGGIGAAKTGGNYAASLLPAKLAADKGYQQILWTDSKEHKYFEESGTMNLMFVINDVLITPSLDGSILPGITRDTILTIAKDWGVKVEERRVSVEEVITAFNNGTLQDAFGTGTAATITQIAEIHHNGKDMVLPPVAGRTLSNKLNQTIVDLKNGIGEDKYNWVHRIKK

SEQ ID NO: 10419 - protein, 501 aa, Saccharomyces cerevisiae
MTDVLRSLVRKISFNNSDNLQLKHKTSIQSNTALEKKKRKPDTIKKVSDVQVHHTVPNFNNSSEYINDIENLIISKLIDGGKEGIAVDHIEHANISDSKTDGKVANKHENISSKLSKEKVEKMINFDYRYIKTKERTIHKRVYKHDRKTDVDRKNHGGTIDISYPTTEVVGHGSFGVVVTTVIIETNQKVAIKKVLQDRRYKNRELETMKMLCHPNTVGLQYYFYEKDEEDEVYLNLVLDYMPQSLYQRLRHFVNLKMQMPRVEIKFYAYQLFKALNYLHNVPRICHRDIKPQNLLVDPTTFSFKICDFGSAKCLKPDQPNVSYICSRYYRAPELMFGATNYSNQVDVWSSACVIAELLLGKPLFSGESGIDQLVEIIKIMGIPTKDEISGMNPNYEDHVFPNIKPITLAEIFKAEDPDTLDLLTKTLKYHPCERLVPLQCLLSSYFDETKRCDTDTYVKAQNLRIFDFDVETELGHVPLVERPAIEERLKHFVSAPSSSL

SEQ ID NO: 10420 - protein, 435 aa, Nicotiana tabacum
MLINGFIYLKDWANAFAIFEDVIRDGLKPDVVLYNNIIRAFCGMGNMDRALRIVEQMKKERHRPTSRTFMPIIHAFAKAGAIRKALDVFDMMRRSGCIPTVQTYNALILGLVEKRQMDKAVEVVDEMLLAGIRPNERTYTTIMDGYASLGDTGKAFEYFSRIKDEGLELDVYTYEALLKACCKSGRIESALAVTKEMNAKNIPRNTFVYNILIDGWARRSDVWEAADLMQQMRQEGVQPDIHTYTSFVNACCKAGDMQKAMNTIQEMKRVGLNPMLKPIPLSYTVGHASLPEKALKCFEEMKKSGLKPDKAVYHCLMTSLLSRATVAEDYIITGIHRVCEEMVESGLTVDMGTAVHWSRCLRKIERTGGDITEALQKTFPPDWNSHRNLNAASYDTGNNEGLNDRVTTMVLCMRLTVTATVTMIQMPPRCNQKVA

SEQ ID NO: 10421 - protein, 80 aa, Zea mays
QDDAGTSSRVMKLSAFQKKALSHALSFPSVERVVYSTCSIHQAENEDCINSVLPLATSLGFELGSPFPQWHPRGLPVSKD

SEQ ID NO: 10422 - protein, 408 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 10423 - protein, 914 aa, Solibacter usitatus Ellin6076
MTKYVYSFGNGTADGDGKMKDTLGGKGAGLAEMCRAKLPVPPGFTISTQVCNIYFDNKFSVPKEIHQEMLGSLAILEERMGQKLGDTDNPLLVSVRSGAKFSMPGMMDTILNLGLNDKTVKALEAKSNNARFAYDCYRRFIQMYGAVVLEVPKHDFDEVFEGQKKKAKAKLDTELTAKDLQEVIEGYKKLVQKKTGKPFPQDPLEQLAGARDAVFRSWFNDRAKYYRKMNQIPDDLGTAVNVQGMVFGNLGETSATGVGFTRNPATGENVFYGEFLENAQGEDVVAGIRTPHPISELEKWNKAVYDQLREITTMLENHYRDIQDFEYTIQDGKLYMLQTRNGKRTGPAAVRIAVEMVEQGLIDKKEAILRVDPQQLDQLLHPVLDPKQIKTLTTLAKGLPASPGAAVGTIVFSAEDAVEQSTKAPVILVRKETVPDDIHGMEVAKGILTARGGMTSHAAVVCRGMGTPCVAGAETVTVNEHKKEVSVTVNGKVMTLKEGDWVSLDGSTGMVYAGKANTLEADPKSGVLAKFMGWADEFRGKFGVRANADIPRDAKVARKFGAEGIGLCRTEHMFFAEDRIEHMQAMILAREEKARRKALLKLLPMQRKDFAGLFTAMDGFPVVIRTLDPPLHEFLPKREDLMVDVAILPYADIKKKKELAAKYVKFGAEVKNLKTIIPDLLKRVEELHEFNPMLGHRGCRLGVTYPEITEMQARAIFEAAVQVAKKGIKVIPEVMIPLIGGVKELENQKKIVVEVAEEVLAKAGMKKLKYMVGTMIEIPRAALTAGEVAKEAEFFSFGTNDLTQTTMGLSRDDYTKFQQDYQDRKIFANDPFAVLDQEGVGQLVKLAVVNGRKTRPDLEVGICGEHGGEPSSVQFCYRVGMDYVSCSPFRVPIARLAAAQAAISGDKNEMSRTA

SEQ ID NO: 10424 - protein, 141 aa, Legionella pneumophila str. Paris
MAKELTLSIIKPDAVAKSVIGEIYTRFEKAGLDIVAAKMIQLSREQAESFYDIHRARPFFKDLVDFMISGPVMIQVLKGDNAVAKNREIMGATNPKEAAPGTIRADFADSIDANAVHGSDSLENAAREIAFFFEPHELCNR

SEQ ID NO: 10425 - protein, 208 aa, Rhodococcus sp. RHA1
MPNSNPVSAWKALRQGNDRFVSGTSLHPSQGIADRAKLVGGQHPTAVLFGCGDSRVAAEIIFDQGLGDMFVVRTAGHVIDDAVLGSIEYAVGVLNVPLIVVLGHDSCGAVKATLDALDDGNVPPGFIRSIVERVAPSILMGRREGLSTVDELEGRHVVETGALLMQRSRIIAEKVESGACAIAGVTYKLSDGRTHLQGAVGDIGELTD

SEQ ID NO: 10426 - protein, 132 aa, Triticum aestivum
MAATATTRPAAHTHTSQAKGRSPEREAWKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 10427 - protein, 776 aa, Hordeum vulgare
MDSAASTNRSPLRPAAAATATATARRSSSSALPNRVAASRLGVAPGCGGGHFGKAQRFGSVRTTTARAQAGNAGRIATEEKESAMAGTEMPLKYSSGKASPLGVSQVESGINFAIFSQHASSVTLCIKLAERGTKDEESEKLVEFALDCQKNKTGDIWHVLVEGLPTSGVLYGYRVNGPQGWEQGHRFDSNIILLDPYAKLVSGRNYFGVDKGKPSQPFGTYDFDSSPFDWGADYQLPNLPETDLVIYEMNVRAFTADESSGLDPAVRGSYLGFIDKIPHLLELGVNAVELLPVFEFDELEFKRYPNPRDHMVNTWGYSTINFFAPMTRYASAGGGPLAASRELKQMVKALHKAGIEVILDVVYNHTNEADDAHPYVTSFRGIDNKVYYMLDPNNNSQLLNFSGCGNTLNCNHPVVMELVLDSLRHWVKEYHIDGFRFDLASVLCRGPDGSPLDAPPLIREIAKDSVLSRCKIIAEPWDCGGLYLVGRFPNWDRWAEWNGKYRDDLRRFIKGDPGMKGVLATRISGSADLYQVNQRKPHHGVNFIIAHDGFTLCDLVSYNLKHNDANGEGGRDGCNDNFSWNCGVEGETNDSNVLALRSRQMKNFHVALMISQGTPMMLMGDEYGHTRYGNNNSYGHDTCINNFQWEQLAERRYGHFRFFSEMIKFRQNHPILKRDRFLSKNDVTWHEDCWDNLESKFLAFTIHDHNSGGDIYLAFNAHDYFVDAVIPPAPHHKSWNRVVDTNLESPNDITPEGVPLTGSGYRIASYSSILLKAKP

SEQ ID NO: 10428 - protein, 614 aa, Triticum aestivum
MASISGAAAPPSSSSACRLRLRRQLLMRPSHLRLRAPHSIADLSRSSGSPHAPAPPLASRAPGQGGGAAVEKDPIKLWDRYVEWLYQHKQLGLFVDVSRMGFTDDFLLQMEPLMQRAFVAMGELEKGAIANPDEGRMVGHYWLRDPGLAPNSFLRTKIEKTVDHILAFSQDVVSGKIKPPSSQAGRFTQILSIGIGGSSLGPQFVSEALAPDNPPLKIRFIDNTDPAGIDHQIAQLGEELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEPIADRCHCPKDIEMIYKIIQHMAANDRALIAEGSCGSPRSVKVYLGECNVDDL

SEQ ID NO: 10429 - protein, 1136 aa, Gibberella zeae PH-1
MATLDALRIALRQQIPSEASTKALSDIEYQHGFDLFLHHNGWGNYRDFVIPKLSQLLHSQFSSRKEVSVLEVGSGPKSVFGYLPNFMRQKITSYSAYEPNHLFAEKLKTWLHPTKETSPFPSLCTSYINIEPFTQETVVHEKQQIILFCHSLYGVSSKDQVVRHALDMLSEESEEGILVVCHRDTALFLNDLVCQRSAIFPDGTFRIANSNDTINRFASFVAGCSIQSDTMRNAIHDNWRNVCRSLARYDNNHPDTLTFASPEVIMTFTRHSTALPELTAIVPLASKDYKVKNKEAQSHVPAAVVRPADVGQVQRCVTWALKHRFCLTVVGGGHSGHCRWRNVVSVDMGAFNQVHIVRKTGGSNEGHPLVVAGTGCKTGDIIQAAQSEGLTVPLGARPSVGSGLWLQGGIGHLLRPHGLACDAIVGAVLVSVESGQVLCVGEVPCEHQPIDAIRPNNEDDLLWSLKGAGNNFGIIISVTFNAYPARSFLVKDWSIRLKDDEHAKYILQKFATTLARPLDRESSVDAYLYYVNTQLMLGVTLFESMETTTGKCPLPETPESFIQVIGESDCTKTVDAVGLFDTEMYMSLMHGGHGGGKTSSFKRCVFLKDIEHINITNILLTAIDSRPSAMCYFHLLHGGWPVQEVASDVTAFGCRDWDFACVVTGVWPREDDDSATARATVRWVYDVVEALLPVSQGVYGADLGPDPRDAILATKAFGPNLRKLVKMKQIFEPHGVLTYACPLSKDMLSQKMVVLVTGEHGAGKDYCANVWAAAVKGHGYSTTVIGIGDVTKREYASQRGADSERLLGDRVYKEQHREALAAFFNQQLEHRPHLAEEHFVESVRSANVDVLFITGMREEAPVANLWHLVSDVRLVDIHVNASHKTRGLRRQIFTNGHSISRGSFNCTETLVSNYRPNFVFDNDIASDDQVKAFAKYSLFPFLGNDLRRLAGMVPSVPEFPRPGIKFRHVLEICQQKGGYKLCASLFKQHFADDWRKVDAIVSCGVGGHISAASLVLEVNVRSSLVHLTGKLPPPTISAEKSPSHVSSHVNGVKVEGIEMRADTLRKGARVVVIDDVLATGNTLLSMLELINRAGINMEDISVMVVAEFPIHRGRQRLRQGGFGRVGIQSLLVFDGE

SEQ ID NO: 10430 - protein, 318 aa, Burkholderia thailandensis E264
MIEPILHHDTPETPVMDAAASTSPGLAADPGSAPRRGRLRTADGLELASYRWPAAGLSPAAPRATVALVHGLAEHAGRYQALAERLNAAGIEVVAIDLRGHGHSPGERAWVERFDQYLEDADALVASVARDDTPLFLMGHSMGGAVAALYAVERAAVRRPGLTGLILSSPALAPGRDVPRWMLAMSRFISRVWPRFPAIKIDAALLSRDPAVVAANRADPLVHHGPVPARTGAEILDAMRRIEAGRAALRVPVLVYHGTADKLTEPDGSRDFGRHVGSPDRTLTLYEGNYHETMNDLERERVIGAQIDWIAARAPARG

SEQ ID NO: 10431 - protein, 208 aa, Oryza sativa
  misc_feature (120)..(120): Xaa can be any naturally occurring amino acid
  misc_feature (200)..(200): Xaa can be any naturally occurring amino acid
RAEFGTRGKGGKDWETHAAEQPTTNEPTKRQFTWDEVRQHSTKKDRWFVIDNRVYDVSKWMKHPGGQMVLNHYAGQDATEAFNAFHPDIKRVEKYLKPFYVGDLRKDQDKSTENDDQQLXADFEKIRQKAISQKLFQSSRLFFVLTCLHILAFEFAAYFLLFKFGTGWLPYISALVCYVIAEAQCGWVQHDFGHLSVFRXSQWDHLLH

SEQ ID NO: 10432 - protein, 251 aa, Archaeoglobus fulgidus DSM 4304
MLTFVGLGLWDVKDISVKGLEAVREADEVYVEYYTSKLLSSIEEMEEFFGKRVVELERSDLEENSFRLIERAKSKSVVLLVPGDPMVATTHSAIKLEAERKGVKTRIIHGASISTAVCGLTGLHNYRFGKSATVSWHRSQTPVNVIKANRSIDAHTLLFLDLHPEPMTIGHAVENLIAEDAQMKDLYAVGIARAGSGEEVVKCDRLENLKKIDFGKPLHVMVVLAKTLHFMEFECLREFADAPAELERLVA

SEQ ID NO: 10433 - protein, 201 aa, Oryza sativa
  misc_feature (100)..(100): Xaa can be any naturally occurring amino acid
MGGGSPCASCKLLRRRCTKDCIFAPFFPADDPHKFAIVHKVFGASNVSKMLQELPAQQRGDAVSSLVYEANARMRDPVYGCVGAISFLQNQVSQLQMQLXAVAQAEILCIQMQHRDDGAAHQLDAAADHHPLLDQQQQQQMVVDAADAAASFLVQNGGGGGGPAAQLISGYGSPAAGGGGGHGVVHYAAAQEHLKRESLWT

SEQ ID NO: 10434 - protein, 1508 aa, Yarrowia lipolytica CLIB122
MDNGPIDPNRDVEQEHPVQVDHTEKHESSSSGAPLTQMSETSEDNTYTATPVPLTDVENMDPDSRDVNDLQRVLSNPESLHKLQSYTEQISRRMTQDERESLKNNEDTFDLARILDGFVQKSHEQGVHMRSAGVGWRNLTTDGIDQSTVFVPSVDELLRALATLPVQIAKAFKKKQTRHIIQNNNGVLKAGEMCLVLGRPGSGCSTFLKTITGQVGGYTGVEGDISYDGLSQKDMLEYFKSDIIYNGELDVHFPHLTVEETLNFAVGCRTPRQRLDGLTRDQYIKNYVQLLATVFGLRHTYNTKVGNDFVRGVSGGERKRVSIAEALATRASIFAWDNATRGLDASTALEYSQAIRATTNILNNASFVAIYQAGEHIYNLFDKVTVLYSGRQIYYGPADHAKDYFQRMGYECPPRQTTAEFLTAVTDPLGREPYPEMVGKVPTTADEFEKYWLASPEFRVVQAEYDDYVGSHNAEETFQNMQDSLSKDKMKRQRKKSPYLISFAMQMRLLTQRGFERLKGDMAYQTINVCANIIQALVIGSLFYNITESTAGAFSRGGVLFFTLLFNALASMAEISHSFSQRPIIVKQKSYSFYHPAGEALQALLTDIPGKLVTMICFTLIVYFLTHLNRTAGQFFAHLFILFVTTQCMTAFFQVLASATPSVEVANSLAGIGILIIVVYSGYMIPTPTMHVWFKWLNRANPVAYGFEALMANEFHNRVMTCEQIVPAGPDYSGMPESNKVCSFSGSTPGSLVVTGDNYIKNSYNYSFSHMWRNLGILFAFWMGFVFFNVTFSEYIQYHSSSGDVLLFKRGHIPEELQKEGADIDEVIADKAQADDSEKKMDRLLSLDEERDVFTWQNVDYVIPIAGGTRKLLDNVQGYVKPGTITALMGESGAGKTTLLNVLSQRINFGVITGDMLVNGRPLDRTFQRRTGYVQQQDLHLAESTVRESLIFSARLRQPSFVPDQEKIDYCDKIIKLLGMEAYAESLVGETGRGLNVEQRKKLSIGVELVAKPSLLLFLDEPTSGLDSQSAWAIVQFLKNLAAAGQAILCTIHQPSATLFEEFDRLLLLKKGGQTVYFGDIGKNSNTLVSYFERQGGRKCAPDENPAEYILECIGAGATATADGDWHDKWKNSEEYRQTTDEIAKLQQELAQRPQKELDPSLQRKYAAPYMTQLRWVLRRTQIQFWRSPGYIMAKFMLLIVGGLFIGFSFWDIKFTLSGMQNAIFAVFMITTLSVPLINQIQSFAFQSRELFEVRESSSNTFHWSCLLFSQFISELPYALIGGTIFYCCVYFPTKLGTSARVAGYFYFIYAILFNLYYLSFGLWILYFSPDVPSASIITSLMFSFVIAFCGVMQPASLMPGFWTFMYKLSPFTYIIQAYVGDVMHDRKITCLPREFSRFNPPSGQTCQEYAGKFLSQATGYLEDPNATTQCGYCPYSVADEFIATVGIKYHYRWRNVGFICAYIIFNICAMVLCYYLARVRVWRTGAAIADWKAKRANKKKAASSEKA

SEQ ID NO: 10435 - protein, 365 aa, Nocardioides sp. JS614
MQQVKAVIARGKGQPVEVTTINVPDPGPGEALVQVQACGVCHTDLHYREGGINDDFPFLLGHEAAGVVEAVGPDVTAIAPGDFVILNWRAVCGECRACERGEPWYCFATHNATQRMTLAEGPDAGTELAPALGIGAFAEKTLVAAGQCTKVDPSARPAAVGLLGCGVMAGIGAAINTGAVTRGKSVAVIGCGGVGVAAIAGSALAGASPIIAVDIDAQKLEAARRMGATHVVDSSRTDPVAAIQELTGGFGADVVIEAVGRPETWKQAFYARDLAGTVVLVGVPTPEMKVPDLPLIDVFGRGGSLKSSWYGDCLPSRDFPMLVDLYQQGRLDLDAFVSEEIGIGDVEAAFERMHEGGVLRSVVIL

SEQ ID NO: 10436 - protein, 755 aa, Neurospora crassa
MAVSRPKRSLARRAVAFVKRLIHKHPVPDLSLPVPTATQAASRPDKKTILKHPAKKDFLKQIVPEAVNDCPLPSFDPGIFHSELLDLKLYPEVDPNDPRKIREPEGNVREGTYLGTQLALTQAYERVEQTFNSLFDVLGIEPTFPRYVSLEQQRNLYQFTPYPNNADGTPADYPPHLQHIPVDKNHTVFGVFNNAGLLETAVILQKLIPDEDGFIGRTKQWLLEKARAAAYGGEPEKGITIQDVEDYNRFHRKVGTDIAGGGNIGLLDDWYSDRRFAEQQFTGTNPTTITQAGKQWIGEFLTAARIGGYNAWISALEAADPASLFVQDGSYFRDAVGVTDPTAALHHKQPGSDDNWCVGAVSLFQLHDDGKLHPVAICIDYRGSMEQSVTIFNKRLTPRDSTKTEKTDWPWRYAKTCAQVTDWMRHELTVHLTLAHLVEEAIIVGTNRSLPMEHPVYRLLSPHWYKTLSVNAAARATLVPQVIVDIVGISPEQCHSFIRHAYDTYDFVAHYVPNDLARRGFPNTAEGLSSSTRYRNYAYAKDVLALWTVLRSYVAEMLALSYPSDESVAQDRYIQSWCKEMRQGGAHMSSFPEIRDLESLTDAITMCIHTATSFHSAVNYLQNFYLAFVIAKPPMLCTAPPTSLSALQQMKEHDLVASLPINRQRQWLLSAQVPWLLSFRTPQDRSLLNYAASMWRVYKTKKGRREKMVAEASERLYARLRETQRVVWENSRAMEKGSLPYMVLDPGNTAVSILI

SEQ ID NO: 10437 - protein, 510 aa, Zea mays
  misc_feature (40)..(40): Xaa can be any naturally occurring amino acid
MAGGTFTEKGKQYPGKMTVFVFLTCLVASSGGLIFGYDIXISGGVTSMDPFLKRFFPSVYAKEQEVVETNQYCKFDSVLLTLFTSSLYLAALVASLFAGYVTKKCGRRMSMLGGGAIFLVGAVLNGFAQNVAMLIVGRIFLGIGVGFSNQSVPLYLSEMAPARMRGMLNISFQLMTTVGILVANLINYFTAKIPGGWGWRIGLGLAAVPAVIMVGGSIFLPDTPNSLVSRGKVESARAMLRRIRGTDDVSLEFDDMVAASEATKAIQNPWGTLLQRRYRPQLVMAVLIPTLQQLTGINVVMFYAPVLFKTIGFGGTASLMSAVITGLVNMFSTFVSIATVDRLGRRKLLLEGGIQMIIAQFVLGTLIAVKFGTTGVAAISRPYAIGVVFCICVFVSAFAWSWGPLGWLVPSEIFPLEIRSAAQSVVVVFNMIFTFIIAQIFLMLLCHLKFGLFYFFGAWEIAMTLFVYFFLPETKGIPIEEMDRIWANHWYWKRFAVDGGRKVELTSTAV

SEQ ID NO: 10438 - protein, 257 aa, Glycine max
LYHSQSTCTCHSLLSCCVSGQSSLTGLAPLEAVLFDIDGTLCDSDPLHYYAFREMLLEIGFNGGVPITEEFFIETVAGKHNDDIALVLFPGDLERGLKFVDDKEAMFRRLAAEQLKPLNGLDKVRKWIENHGLKRAAVTNAPRKNAELMISILGLSDFFDAVIIGGECEHAKPHPDPYLKGLEALKASKDHTFVFEDSVSGIKAGVAAGMPVIGLATRNPENLLMEAKPAFLIKDYEDPKLWAALEELDKATSARSV

SEQ ID NO: 10439 - protein, 784 aa, Bacillus thuringiensis serovar konkukian str. 97-27
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSKGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGAKIGAGAVIEPYSIIGKNSIVSSYSHLQKSIVFANAHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQVENEKEVIIKLYGQDGAQLTYKQQKAIEQVYMSESFYYVCEKEMGRNKLVHVSLHDYIEAVLERIDIEKIQKQKFHLLINKRNDMLQHLLMLFLQRLGCTVTWIYAGEQKDHVKALMKSSKANMALMFSEQGNYFELYDNHSNIYQGTDFEEVDIPDLLLESAGNIYPMSLKLGECYLLFYTQDEKKSFQARWKRDILYRIGKLFELIALQGKTFLSIVEQSPPLYLLCDEVVCPWNEKGKVMRKLLADMERKEEGIFEGVQFKYTEKEWSYIVSDTKQPKFLVYSHARNPVIARENMKNLIEKIRQYQKV

SEQ ID NO: 10440 - protein, 385 aa, Arabidopsis thaliana
MEQQKQKKRKVVSKSKRTQSKSASSLPLDLTSEILLRLPEKSIARFRCVSKLWLSITTDPYFINLFETRSPRPSLLVCFIENDKLFVSSIPQHLHSLQNSKRSYSSSQLFIVIIWNYQKDVGLICFKTSKMPIVWNPSKRQLITLPIPRLSWNNIIVFLGYDPVEGKHKVMCLPFRRSSDVCQVLTLGPAQEFSWITVKTYHKHCSDYQSSGRCIKGVVYYIAQVYHTHAWVLMCFDVRSEKFDMIKLHADIYREILITYEGRIACVEKRTTKDDYIALCILEDAKKDKWSSKDILAPFGHFDERLRTFFQLKGCTHDGEFIFVSSTFRKMDYILFFDPVKKTFRRFELKEIADDQARVNNGDPYGPIFAFCAFLDHVESQMSLQ

SEQ ID NO: 10441 - protein, 659 aa, Yarrowia lipolytica CLIB122
MSSYPSEKGGTEGIDRVPSETNDASDNTSDNNGLHEKPSNEHAEGLPPGNALNADLDPENPLSRYTRDELLEIASGFAKENGMGDKEDIFRKGALVAQDPANFDNIDILDDNDRYWLRREITHKWDHPMKVYYIVICCSLAAAVQGMDETVINGANIIFPAQFGIKEEAGVVSQKTWLLGLVNSAPYLCCAVVSCWLTDPINRLLGRKWTIFWTCFWSGATCFWSGFVNNWWHLFIARFFLGFGIGPKSATVPVYAAECAPPTIRGAMVMMWQMWTAFGIMMGYVMDLAFYYVPDHGIEGLNWRLMLGSALIPALLVCVQVIWCPESPRWHLARGEISKAYECMRVIRNSEVQAARDLFYAHVLLLEEEELKRGKNRFFELFTVPRNRRASWASFIVMFMQQFCGINVIAYYSSNIFMESGFGEIQALLASFGFGAINFVFALPAVYTIDTFGRRALLLVTFPLMAIFLLFAGFCFWIDQDDPTNSPARVGCIALGIYLFSAVYSCGEGPVPFTYSAEAFPLYIRDLGMSFATATCWLFNFVLAVTWPSLLAAFTPQGAFGWYAAWNVVGFFLVLCFLPETKNLTLEELDKVFGVPTRVHMKYQFNAFKVNIQRHLFRQDIPKPPPLYAHEVGVGGTSHYQHKPHHTANLTPLHTAELA

SEQ ID NO: 10442 - protein, 148 aa, Ralstonia eutropha JMP134
MKVSDILQIKGNTLYTVTPDTALLVAVHTMAEHDIGSLVVMEYGDLVGMLTFREIIETLAKNGGSVGTTSIRKVMDDAPLTCTMETDVNEVRRMMLERHTRYLPILDNRTLMGVISFYDVAKAVVEDQSFENKMLKAYIRDWPEERAD

SEQ ID NO: 10443 - protein, 308 aa, Burkholderia vietnamiensis G4
MSAAVPEILALGEAMIEFNQSQPGRPEFLQGFGGDTSNFCIAAARQGASTGFVSAIGDDPFGRLLAGMWADEHVDTRYVRVDRSAPTGVYFVTHGPDGHQFDYLRAGSAASRYTAADLPLDALAAAKAVHLSGISVAISTAACDAAFAAIVHARSNGALISFDTNLRLKLWPLARARAVIREALCHTDICLPSWDDVAALTGANDRDAIVDAMLELGPQIVALKLGREGAYVATPSERRVVPGFAVEAVDATGAGDCFGGAFVARIVAGDDPFAAARYANAAAALSTTGYGAVAPIPHRDAVERLLRG

SEQ ID NO: 10444 - protein, 257 aa, Zea mays
  misc_feature (232)..(232): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGETXTQIPNALEAVETLRAEPKPNDQYLP

SEQ ID NO: 10445 - protein, 714 aa, Legionella pneumophila str. Paris
MIKKIHRWLPLLVLIGLSVLFFSLHLDKYLSFNALRENHALLIAWTQTHYFIAPLIFIVFYTAAVAISIPGAVLFTLTGGFLFGVFWGVLFVVISATLGATILFFAVRTALGDWFAKKASGWIERMRRGFQHNAFSYLVTLRLIPLFPFWVVNIVPALLNIRAKIFITATFLGIIPGTTVYVMVGNGLSQIFAANQTPNLGIIFEPQILGPLLALAVLSLMPVLYQFSTRKHQNHHSFSDIGRVINCDLAIIGGGAGGLSLASGCSQLGLKVVLVESGEMGGDCLNYGCIPSKSLLAAAKTFYYAKHATHFGVQTEAIKINFQKVMQHVHQIIDNISEHDSVQRFESLGVQVIKQVGKFLNPDTLQAGDSIIKAKRFVIATGSSPFIPPIRGLEAISYFTNETIFDLKEQPEHLIVIGGGPIGCELAQAFAMLGSKVTLLEGLNLLPKDDPDCVAVLRTQMKSMNILIYEQIEITQINSHPDTGISVCFEFQNTQFTITASHLLIATGRRANVKPLDLEKAGVKLTSKGVEVNKYLQTSNKKIYALGDVTGLYQFTHMASYQAGIVLRNIVFKLPSKVDYRAIPWVTYTDPELAHVGIGVSDALKHPDTQIIEWPFVDNDRAQTEHTLNGKIKIITDKKARILGVTIVGPHAGELILPWVMAIREKKTLRSFTDVIVPYPTLSEISKRVAGSFYAPKLFSNKTRMLVRWLQKIG

SEQ ID NO: 10446 - protein, 319 aa, Arabidopsis thaliana
MALAVGTIRGYKKNLFEFVKTCAIADDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGSRSWNTKDTSRNVWWLSLFTMGESWHNNHHAFESSARQGLEWWQIDITWYLIRLFEVLGIATDVKLPSELQKQKMALVR

SEQ ID NO: 10447 - protein, 429 aa, marine gamma proteobacterium HTCC2080
MSEIVDVRAFEVLDSRGNPTVMAEVTLDNDVVGVACAPSGASTGSREALELRDNDPKRYLGKGVLNAVGNINGPIRELLLGYDACDQRGVDQRMIEADGTENKGEFGANAILAVSLATAKVASAARGIPLYEHIANLSGNEQMTMPVPMMNILNGGEHADNNVDIQEFMIQPVSAGTFSDALRMGAEIFHHLKKVLSARGLATAVGDEGGFAPNLPSNAAALDIIAEAVEVAGYKLDSDITLALDCAASEFYKDGLYDLKGEGRKFNSSEFADYLGDLCSQHPIISIEDGLDESDWEGWATLTQKLGDRIQLVGDDLFVTNTKILERGIRENIGNSILIKFNQIGSLSETLDAIAMARSAGYTAVISHRSGETEDATIADLAVGTGAGQIKTGSLCRSDRVAKYNRLLRIEAALGLTAPYRGRDEFSRS

SEQ ID NO: 10448 - protein, 259 aa, Burkholderia thailandensis E264
MNAPPPLKVFITGASSGLGLALAAEYARRGATLGLVARRADALAEFAQRFPKATISIHPADVRDADALALAASRFVAAHGCPDVVIANAGISKGAITGEGDLDAFREIMDVNYYGMIATFEPFIAPMTAARRGTLVGIASVAGVRGLPGSGAYSASKAAAIKYLEALRVELRPAQVAVVTIAPGYIRTPMTEHNPYPMPFLMDADRFAKRAALAISQKAAFRVIPWQMGVVAKLLHVMPRWLYDRLFEKAPRKPRAKAG

SEQ ID NO: 10449 - protein, 369 aa, Bdellovibrio bacteriovorus HD100
MKIKAAVAWKAGAPLSIEEVDLEGPKKGEVLIRVVATGVCHTDAFTLSGADPEGLFPVILGHEGGGIVEEVGEGVTTLKKGDHVIPLYTPECKECKFCLSGKTNLCVRIRATQGKGLMPDGTSRFSKDGKMIHHYMGCSTFAEYTVVPEIALAKVNPAAPLDKVCLLGCGVTTGIGAVLNTAKVEKGATVAVFGLGGIGLSVIQGAKMAGASRIIAIDINDAKWEMAQKFGATDFVNPKKHDKPIQQVIVEMTEWGVDYSFECVGNTQLMRAALECAHRGWGQSIVIGVAGAGQEISTRPFQLVTGRVWKGSAFGGVKGRTELPGYVEQYMSGEINIDDMVTFTMPLEDINKAFDYMHEGKSIRSVIKM

SEQ ID NO: 10450 - protein, 177 aa, Alkaliphilus metalliredigenes QYMF
MHKEEIRMNLDSKIRVIEDFPKKGISFKDITTLLKDKEAFRSMVDQLSDQLIDLDIDIVVGPEARGFLVGAPVAYKIGAGFVPIRKPGKLPGETISYEYELEYGTDSLEIHTDAIQPGQRVAILDDLLATGGTVVATAKLIEELGGEVVSINFLIELGFLNGGEVLKGYSVKSLLKY

SEQ ID NO: 10451 - protein, 513 aa, Bacillus licheniformis ATCC 14580
MTKLVNEMILVLDFGSQYNQLITRRIREFGVYSELHPHTLTAEEIKKMNPKGIILSGGPNSVYDEGSFRCDEKIFELDIPVLGICYGMQLMTHYLGGKVEAASQREYGKANIHIEGEPDLFKDLPNEQVVWMSHGDLVVEVPEGFTVDATSHHCPNSAMSKKDKKWYGVQFHPEVRHSEYGNDLLKNFVFGVCECVGEWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDEAEKLKGIDFLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIAKADLEKDIWQYFTVLPDIRSVGVMGDARTYDYTIGIRAVTSIDGMTSDWARIPWDVLEKISTRIVNEVKHINRVVYDITSKPPATIEWE

SEQ ID NO: 10452 - protein, 357 aa, Triticum aestivum
PGLSHDSVSMEDDMLTCNSVESPGPPFLDNAASSVATSLRRCANDKLPVSDNRDTTVSRWRKHCPTPIENDNIFEIETHCKDPELCSTLACDIYKHLREAEAKKRPSPDFLETTQKDIDTSMRAVLIDWLVEVTEEYRLVPETLYLTVSYIDRYLSSKEINRDKLQLLGIACLLIAAKYEEICPPQVEELCYITDNTYIKDEVLRMEASILGCLMFEMTAPTEKCFLRRFLHAAQLCHEGPALHLEFLASYITELSLLEYSLLCHVPSLIAASSIFLANFILKPTKNPWNTTLSYHTQYKPSTLRDCVKVLHRLFRVGLGSNLPAIREKYSQHKYKFVAKKYCRPSIPADFFQDASS

SEQ ID NO: 10453 - protein, 463 aa, Enterococcus faecalis V583
MSIFRKKEITVPVNDSGGMKKNLKTMDLIFLGIGAVVGTGIFVVTGVAAERYAGPGLVLSFLVAAAAIILSGLCYAEFASRIPVIGGPYAYMYVVFGEIVAWMTGWMIICEFFLAVSSVASGWSGYVHGFLDSLGFSLPQALSGAYNPTNGTYIDLIAMLVVVAVTFWVSLEAKTALRLNNLMVFVKFGIILLFVLVGIFYVKPTNWQPFIPYGFSGVFSGAALVFFAFLGFDAVSMAAEEVKNPKKDIPKGIIGSIIISTLLYIVVTLVLTGIVPFTDLGVKDPVAFAMRFINHGAIATIISVGAILTLLTVTIAMMYSLARVIYAISKDGLLPQFMSKIDEKRHTPKNATYVAGFLAMVFAGIVPMEMLAELTNIVTLFYLMFLALGIIKLRTMKGEPQAGEFKVPLVPVLPLISIVVCAALMFQLSLATWQVFGVAVVIGLAIYFFYGRHHSIVRFETKE

SEQ ID NO: 10454 - protein, 669 aa, Enterococcus faecalis V583
MSQKETFYITTPIYYPSGKLHIGNSYTTIACDAMARYKRLMGFDVFYLTGVDEHGQKIEKKAAELNVTPKEYVDKMAADVQKLWKTLDISYDKFIRTTDDYHMAAVQQIFDRLVEQGDIYLGEYEGWYSVSDEEFFTETQLAEVYRDDEGNVIGGKAPSGHEVELVKEESYFFRMSKYADRLVQYYEEHPEFIQPESRKNEMLNNFIKPGLEDLAVSRTTFSWGIPLKNDPKHVVYVWIDALSNYITALGYGSEDDSLFQKYWPANVQMVGKEIVRFHTIYWPIMLMALDLPLPKKVFGHGWLLMKDGKMSKSKGNVVYPEMLVERYGLDALRYYLLRAIPFGSDGVFTPEDFVSRLNYDLANDLGNLLNRTIAMINKYCDGKVPAYASKVTPFDSELSTTAANVIGKYHEAMEKMEFNTAIAEIWTLVSRANKYIDETAPWVLAKEEEKRNELESVMIHLAESLRIVAILLQPVMTETPGKIFEQLGLDPETMNMENIHFGEFPTDVTVTSKGTPIFPRLEIETEVTYIQKKMSQSESATEEDIKWNPEETTLVSTKEKQIKYDDFDKVELKVAEVIDCKKVKGADKLLQFRLDAGDENHRQILSGIAEFYPDPAALIGKKVVIVANLKPRKMRGQISQGMILSAESPEGKLQIVEAPKEMPNGAGIA

SEQ ID NO: 10455 - protein, 559 aa, Magnaporthe grisea 70-15
MNRIALWTVASFLLVPFTAHACLQTWHILAGTSSPTGKWRSRATYILSGLLLKVQYDLFVKLTLELRARRLGCLPAKLYPHKDPVLGLDYFFKALRAAGAGQFFPFARENLKTIGHTHYAMALGTWVLHTDEPENIKSILATDFDSWEIAGPRLLPVLDVLGPKSIFTSNGEGWHQARSMLRPSFVRDQVADLACFDRHISHLLKKIRSSCQEGMVAFDLQKLFFLMTMDSSTDFLLGRSTDLLVKASPEAEDFLRAFDYVLFQGAKMARLGPIMMKLPHRKFDAEVQTVRSFVRKYVSKAMAEKGYQKERSYLFLHELVASGASVEYITDQVLSIILAGRDTTAAALAAAFYFLSKSPDIVDKLRQEMLEMGEENPDWETLRGMKYLQNVIKEGKFSQKIWSWDETTLLLTPSRVFPALRLAPPVATNSRTSCKETTLPRGGGPDGKSPVLIPKGTSCRWSNYSAYRRADIYGPDADEFRPERWEDLRVAWEYTPFSGGPRICIGQQFALTQMSLAIFRILQNFDKIKSKNEGPMGMRAGVTVSLADPGCLVSMTPIA

SEQ ID NO: 10456 - protein, 335 aa, Campylobacter upsaliensis RM3195
MKNCILAIESSCDDSSIAIIDKDNFNCLFHKKISQENAHANYGGVVPELAARLHSEALPKILEQCQNYFKKLCAIAVTNEPGLSVSLVGGIAMAKSLALTLDLPLIAVNHLKGHIYSLFLKQKEEYDMGILLVSGGHSMVLKVDEKGFLEILAKSNDDSFGESFDKVAKMMNLGYPGGLIIENLAKKAKEKKLHFSVPMLRSKELNFSFSGLKNQTRLEILKHQHLDESIKSEIAYAFEEAACSHIIHKCRQIFTKHHFKKFGVVGGASANLNLRGRLQTLCEEFDCELRLAPLEFCADNALMIARAAISVYERGEFVNINEDILSPKNTNLARL

SEQ ID NO: 10457 - protein, 456 aa, Glycine max
LHHLLLLPFPHSSTPHKPPSFQRSKTLLRASTVESPTPKRRGRKKKPETQTPSNNTPPPQNADNKTEEDELHDYDDGVDFPYSDPPLICCFGLARKEFVPAVRVQDYPMHPDIYSEWKMLQWKPPEFARAPGGPPSNVAVAHARLGGRAAFLGKVGDDEFGEEMVLMMNEERVQTRGVKIDSKCRTGCSYMKVKFEEEGRMKMETVREAAEDSLLANELNLAVLKEARIFHFNSEVLTCPSMESTLFRAIKWTKKFDGLVFFDLNLPLPLWRSHDETREIIKKAWNEADIIEVSRSELEFLLDEEYYERKRNYRPQYFAENYEQTKNRQEYYHYTAEEVSPLWHDRLKFLFVTDGTLGIHYYTPSFDGSVMGTEDVLITPYTCDRTGSGDAVVAAILRKLTTCPEMFENQDVLERQLRFAVAAGIISQWTIGAVRGFPTESATQNLKEQVYVPSLW

SEQ ID NO: 10458 - protein, 516 aa, Cucurbita maxima
MPTDMELSPSNVARHRLAVLAAHLSAASLEPPVMASSLEAHCVSAQTMVAPPELVKGTLTIVDERTGKRYQVQVSEEGTIKATDLKKITTGPNDKGLKLYDPGYLNTAPVRSSISYIDGDLGILRYRGYPIEELAESSTYVEVAYLLMYGNLPSQSQLADWEFAISQHSAVPQGLVDIIQAMPHDAHPMGVLVSAMSALSVFHPDANPALRGQDLYKSKQVRDKQIARIIGKAPTIAAAAYLRLAGRPPVLPSSNLSYSENFLYMLDSLGNRSYKPNPRLARVLDILFILHAEHEMNCSTSAARHLASSGVDVFTALSGAVGALYGPLHGGANEAVLKMLSEIGTVNNIPEFIEGVKNRKRKMSGFGHRVYKNYDPRAKVIRKLAEEVFSIVGRDPLIEVAVALEKAALSDEYFVKRKLYPNVDFYSGLIYRAMGFPPEFFTVLFAIPRMAGYLAHWRESLDDPDTKIIRPQQVYTGEWLRHYIPPNERLVPAKADRLGQVSVSNASKRRLSGSGI

SEQ ID NO: 10459 - protein, 462 aa, Rhodococcus sp. RHA1
MTTTVSQELLPTGQSLDAARVEGERAYALDRAHVFHSWSAQEQITPMTILASEGSYVWDGAGNRMLDFSSQLVNTNIGHQHPKVVAAIQDQAAKLCTIAPQYANDARSEAARLIAERTPGDLNKVFFTNGGADANEHAVRMARLHTGRYKVLSRYRSYHGGTDTAINLTGDPRRWPNDYGNSGVVHFHGPFLYRSQFHSENEQQETERALEHLDQLIRLEGPNSIAAIVLESVPGTAGIMVPPPGHMAGVREICDRYGIVFIADEVMSGFGRTGKWFAIDHVGVVPDLITFAKGVNSGYVPLGGVAISEKIAATFADRPYPGGLTYSGHPLATAAAVATINAMEDERIVENAARIGSEILGPGLRGLADRHPSIGEVRGLGVFWAIELVADRATKEPLAPYGASSPAMNEVIAACKAGGLLPFANFNRIHAVPPCTVTEAEAREGLAILDTVLDIADAHRNS

SEQ ID NO: 10460 - protein, 455 aa, Arabidopsis thaliana
MGSRDFISSLPDEVLGKKILSLLPTKLVVSTSVLSKRWRNLFHFVDSFDLEDSTPIRNADSFSDFMKDTVALLSNCPIKRLTLNSHYEKSSVNRWIRSALKRGCLELNLQSQYDHYLDIGIFFRNNTLVKLTLSSYRTFLRGNVPPEGRVFFPALKTLSLGAVVAKPALYNWLISGCPVLEELFILDVGSGDDQPTWTRSVVSASIKRLTIVFHFPHNTYPYEDDVEIKTPNLEFLDYSALRSDGSDVDYLDSLAEARLDLRLWELTNTFDFGEVTNLVSAIRNVKTLHLSSSSLEAFYYRCYTMPVFDKLIHLSIESDKENGWQALPRLLLKSPNLQTLAIKGLLHKVTYRCGNACACTSKPKKRYLYKRYEDDSPTSEVEGRCCLSTCRVKVLEISGYGGSLREVKQMEHFLRKLKYLETVKIGVEEDNDSEHLRTELMTLDIASSKCNIQFI

SEQ ID NO: 10461 - protein, 241 aa, Triticum aestivum
ARFLWFLLRLRAMTVVDAEARFHVLAVDDSVIDRKLIEMLLRTSSYQVTTVDSGSKALEVLGLRDEGDDASSSSPTSSSAPAHHQEVGVNLIITDYCMPGMTGYDLLRRVKGSSSLKDIPVVIMSSENVPARISRCLEDGAEEFFLKPVKLADMKKLKSHLVRRKQPQLQPPQPQEKPQQQQKAELAPTELVEEVAAEVTATGITSDCGGGSRKRKAAMMEQDGTTNASLSGGSGGLAVET

SEQ ID NO: 10462 - protein, 273 aa, Prochlorococcus marinus str. MIT 9301
MLIKFLQDAAGKGELDPWDIDVISVIDSFLEQYSHTFNQSSNSQLSYHKDLAETSEAFFAASVLVNLKAQVLESDVFKENSSDFEDEFDMEDQDWIDKEFDIPKFPEKYLRRRSIAQPILKRTTTLGELVSQLESIAEVIETQDLLLMKRKRNKKYSDKALISQVKSLAHREKLPETTKALGKFIDGWEKALQWTDFEYLVKKWQTVVKNDLDKDRLGVFWALLFLSSENRIEIKQINSLYGPIQIKRIIPDGGLAQLPIENLEVSNASSSAA

SEQ ID NO: 10463 - protein, 476 aa, Burkholderia thailandensis E264
MTYRNEGIAYVEPLHAQAHAHAHRTSAEYRALDAAHHIHPFSDMGSLNRAGSRVIVKAEGVHLWDSDGNKIIDGMAGLWCVNVGYGREELIAAGSRQLRELPFYNTFFKTTHPPVIELSALLAEIAPPAFNRFFYCNSGSEGNDTVLRIAHQYWRTQNRPQKKFVISRRNGYHGSTIAGATLGGMGYMHEQMPSKVEHIVHIDQPYYFGEASEGQTPEAFGLERARQLEAKILELGAQNVAAFIGEPFQGAGGVIFPPSTYWPEIERICRQYDVLLVADEVIGGFGRTGEWFAHQHFGFEPDLMTLAKGLTSGYVPMGAVALSDRIADALIAHGEFNHGMTYSGHPVAAAVAVANLKVLRDEKIVERVKTDTGPYFQQLLRETFANHPIVGDIAGAGLVAGIQLAREPGARKRFENGGEVGTICRDYCFNGNLIMRATGDRMLLSPPLVISRPEIDEIVEKAKRAIDATAQQLGLV

SEQ ID NO: 10464 - protein, 104 aa, Zea mays
  misc_feature (78)..(78): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHAXRKTVTAMDVVYALKRPGPNPLPGFGG

SEQ ID NO: 10465 - protein, 392 aa, Prochlorococcus marinus str. MIT 9301
MKAMILAAGKGTRVQPITHVIPKPMIPILQKPVMEFLLELLREHNFKEIMVNVSHLAEEIENYFRDGQRFGVEIAYSFEGRIEDGELIGDALGSAGGLKKIQDFQSFFDETFVVLCGDALVDLDLTQAVKKHKQKGAIASLITKKVTKDQVSSYGVVVSDENGRIKAFQEKPTVDQALSDSINTGIYLFEPEIFNYIPSAEKFDIGADLFPKLVEMDLPFFALPMDFEWVDIGKVPDYWSAIRNVLQGKVRQVQIPGKEIKPGVFTGLNVAANWEKINITGPVYIGGMTRIEDGATIIGPSMIGPSCCICEGATIDNSIIFDYSKIGKGVRLMDKLVFGKYCVGKNGDHFDLQDASLDWLIADSRRSDLTEPSPQQKAMAELLGTDLINIPD

SEQ ID NO: 10466 - protein, 574 aa, Magnaporthe grisea 70-15
MSRRPPNPAAERAAQNQATIKSLLKLETNKICADCKRNKHPRWASWNLGVFICIRCSGIHRGMGTHISRVKSVDLDSWTDEQLQSVLSWGNARANKYWESKLAAGHAPSEAKIENFIRTKYELKRWVMDGPMPDPATLDAEADDDIPLSLVKEKQSIDRKESVRKASLGQSSAPTSIRRAPAPPAPEQDLIGGDPIPVRANSAGPAMSKVASKGEPAPPKTTSTKDSLLGLDFLGTETAAPPRPSSTTGTGGAGGQSRPDLKQSILSLYATAPRPQQQAQQGSFGGMNSPPLQQQQQSQGAGAFGGMNDAFSSLSFNTTSSAPKSPPANDAFASLGGLSSSRSPPPQQTSNTSAFSGLGGGSFFDTKPAQTHQQKSSFGSSSGFGGLTSPTATTASAPQAKPAGTSMPASAALGDLFDFSTPAQTSTPKPSAAPAPSSDSVFNLSASTQVKSPPATSNPTSTMGTNNWSNSDVWGANDAWSTPEAAAAPAKSTATTMPSSSSDAFGGWGSSGGGGLASQSIVPGASGGFQPKVAADEEFGGWASSTGTGNASGGTAKPAAGFGGNDDLFSNVWQ

SEQ ID NO: 10467 - protein, 301 aa, Triticum aestivum
GVLILSGDHLYRMDYMDFVQSHRQRDAGISICCLPIDGSRASDFGLMKIDDTGRVISFSEKPRGADLKEMEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQEADRASEGFHIRSGITVVLKNSVIADGLVI

SEQ ID NO: 10468 - protein, 500 aa, Triticum aestivum
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEQPKGDDLEAMKVDTSFLNFAIDDPAKYPYIASMGVYVFKRDVLLNLLKSRYAELHDFGSEILPRALHDHNVQAYVFTDYWEDIGTIRSFFDANRALCEQPPKFEFYDPKTPFFTSPRYLPPTKSDKCRIKEAIILHGCFLRECKIEHTAFSRLNSGSELKNAMMMGADSYETEDEMSRLMSEGKVPIGVGENTKISNCIIDMNARIGRDVVISNKEGVQEADRPEEGYYIRSGIVVIQKNATIKDGTVV

SEQ ID NO: 10469 - protein, 801 aa, Bacillus thuringiensis serovar konkukian str. 97-27
MKKRLVMIGNGMAGIRCMEEILKHDCDSYEITIFGDEPHPNYNRIMLSHVLQGKTNIQDIIMNEYSWYEENEITLYTNERVQSIDREEKVIITEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYNVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLGFDHIKEILQDANMVTKLNERFQTARGTYKEAWGQALETKSLKAMYEVETVK

SEQ ID NO: 10470 - protein, 519 aa, Erythrobacter sp. NAP1
MTTPATHLFRLARWGITLARRRALVGVEDDPNAPSTVRRLARIARLATLTGKRGTRDYAGAFRAIGPAAIKLGQSLATRPDLVGEEAAHNLLSLQDSLPPVPFSKIEEQIAATFEQPLDALFADIDPVPVGAASIAQVHRATTIDGRKVAVKVLRPGIREKFARDIQTYEWAAAHVEAMGGEAARLRPRLTIANFKRWTNSELDLRREAASASELAEEMAGVGGYRIPAIDWDRTNGRVLTIEWVEGIKISKRDELLAAGHDLEALAEKLVISFLTQAISAGFFHADMHQGNLFVEEDGTIVAIDFGIMGRIDRRARQWLAEILYGLTTGNYQRVAEIHFEAQYVPSYHSVGEFATALRAVGEPMRGKPVKELSVGQMLDGLFAITRDFDMQTQPHLLLLQKTMVMVEGIATQLNPDINMWDTAAPYVRSWIRDELGPEAAVADRIKEDTETLFRLPGLIRRLEEKFPPKGGAPEPPPLPEIRLMTDRKERSGGGLLGYFVAVLAGAGAVYGAMLAGLL

SEQ ID NO: 10471 - protein, 460 aa, Nocardioides sp. JS614
MSRVVVIGAGIAGLTAARDLADAGQDVVVLESSPRAGGKLRRDQVAGVTVDVGAEAMLNRRPEGVGLAARLGLPLEHPTVASSRIWTRGELRPLPRSLMGIPLDLPQLEQSGVLSAEGLARVRAEPTLWPERFEPPDGDVSVGDLVDRRFGPEVTDRLVEPLLGGVYAGHARLISARASVPQLLDYASRGSVLEQAAAIPTTYDRPVFAGIPGGMGRLPEALADGLPAAGAVVRTGATVRGLARTPTGFALTVGPTTAPELVEADAVVLALPAAPAARLLADVAPAAATELAAVESASMVVVTFAFRGSDVPALAATDSSGFLVPPVDGRRVKAATFSFAKWGWVRAAGDGLLLLRTSLGRHREETALQATDEELVAWSLADLAEAVGPLAAPADTHVQRWGGGLPQYAVGHLDRVSRIRAAVAAVPGLAVCGAAYDGVGIPAVIGSARRAAAEVLALRP

SEQ ID NO: 10472 - protein, 473 aa, Synechococcus sp. WH 8102
MAKTPQDVLRQIKDEGIELIDLKFTDLHGKWQHLTVCTDLLEEDSFTEGLAFDGSSIRGWKSINASDMAMVPDASTAWIDPFYRHKTLSMICSIQEPRSGEAYDRCPRALAQRALNHLSSTGLADTAFFGPEPEFFLFDDVRYNSSEGGAFYSVDTIEASWNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMVMAGLDGIKNQIDPGDGEDRDLFELPAEELAKIATVPPSLNGALEALNADRGFLTTGGVFSDDFIDNWIDLKYEEVQQLRQRPHPHEFAMYYDA

SEQ ID NO: 10473 - protein, 741 aa, Ralstonia eutropha JMP134
MVTSTDLAGQVAGVPDADMVERALAYVREQAGDAVLPTGEPVLSHAEGMLRILDGLRVDDAARAACCLFPLAEFAPAVEPEIEARFGEDVCRMVKGVRQLLRIGAIAGGHDAQEASRNVAQARHEQVEALRKMLLAFAQDIRVVLVRLASRLQSLRWLAQNKREPLPGIARETLDIYAPLANRLGIWQMKWELEDLAFRFEQPDTYKRIAKLLDEKRIEREGYIASAIARLQSELADAGIRAEVSGRPKHIYSIWKKMRGKELDFADLYDVRAFRVIVDDIKDCYTVLGIVHHIWQPIPREFDDYISRPKSNGYKSLHTVVIGDDGRAFEVQIRTHEMHHFAEYGVAAHWRYKEAGSKGYSGQFAASDSYDEKIAWLRQLLAWKDDADHSVAHDESPSPWEQLKHAAIDDHIYVLTPQARVIALPQGATPLDFAYYLHSDLGHRCRGARVDGTMVPLNTPLKNGQTVEIIAVKQGGPSRDWLNIELGYLASSRARAKVRAWFNALDSQETIAQGRVLIDKTLQREGKTAVKLEDLATRLGFKSPDDLFAAVAKEEFSLRHVEQALRHPEGEVQAPFNEEDAVTKKSRATSVARGAKSGVLVVGVDSLMTQMSRCCKPAPPDEIVGFVTRGRGVSIHRRNCHTFQQLSARAPERVIQTEWGKKSDAVYPVDIHVEAIDRQGLLRDISEVLSREKINVTGVKTLSSKGVARMQFTAEVSEATQLQRALSIIEDVQGVLQARRK

SEQ ID NO: 10474 - protein, 344 aa, Triticum aestivum
KEGQNPAAWVLDISSHITEYVTGVDYAEIYRSSSLYRENMLLIEELGQPAPNTVDLHFPPGYWQNFRAQCMACLWKQRCAYWKNSEHNVVRFLNTFAVSIMFGIVFWKIGSTIPREREVFNILGVVYGSALFLGFMNGSILQPVVAMERVVLYREKAAGMYCTLAYAIAQMAIELPYMLVQVLIFASIVYPMIGFEMTAVKFFWFVLYMVLSFMYYTLYGMMTVALTPNLEIAAGLSFLIFIFWNVFSGFIIGRELIPIWWRWVYWANPAAWTVYGLMFSQLGDRTELIRVPGQPDQTVREFLEGYLGLENRYFNLVTCLHLAIIALFAFLFFIFIKHLKFQRR

SEQ ID NO: 10475 - protein, 643 aa, Nicotiana tabacum
MAVPTIALYASPPSSVCSTPYPCQINSHGSYDFDLNGRSSSSSSTSSSSGKSFVGGLSSLFSSPTVKANYSTGTEDLGSLWHDRGDELSSSFRCSSLSSSLKRDQSPVSVFQGPASTSSSGIGSCSRSPPRRIAGDVGSIRSGTGGLFNGFVRHALGSCVDHDPTTFRVLDVDSPSSGLLDELTFNMEEGFLESNSEPYAKDLLLNAQSRHKIFCDDFVIKAFYEAEKAHRGQVRASGDPYLQHCVETAVLLAMIGANSTVVAAGLLHDTLDDTFMTYDYIFRTLGAGVADLVEGVSKLSQLSKLARDFNTASKTVEADRLHTMFLAMADARAVLIKLADRLHNMMTLDALPLAKQQRFAKETLEIFAPLANRLGISTWKEQLENLCFKHLNPDQHNELSSKLVKSFDEAMITSSVGKLEQALKDDSVSYHVLSGRHKSLYSIYCKMLKKKLNMDEVHDIHGLRLIVENKEDCYKALRVVHQLWSEVPGRYKDYIANPKFNGYQSLHTVVLGEGMVPLEVQIRTKEMHLQAEYGFAAHWRYKEGACKHSSFVNQMVEWARWVVTWQCETMNRDQSSVGHTESIQPPCKFPAHSEDCPFSCKPNCGTDGPVFIIMIDNDKIVCARIPCKLNCQGSFGESWSRQF

SEQ ID NO: 10476 - protein, 324 aa, Arabidopsis thaliana
MTMRSSLPSSSSAYSLASTSLSNRLETIFKKASELCTLCDIEACVIYYGPDGELKTWPPEREKVRDIALRYSQLNEALRRKKSVNLHGFLNKKKKNKGLKNTDKKRKTSLKKVNVLKYPLADHYPPDQVSPLIQSLELHVSKFHERLEFLESRKQNETQPDHHSLASSSLNHQTQSLNPSQFSLFMYNHGDNTLSQIPVSASNFNQDYFSALLEQSELKNQLMKQEICGNDQNQNMWMGNITNNNFQLPCVSVQESVNNFGLMHKEFYGCDHNMSVGNINSNSCEHPCVSSTQHYSAVEESVNNPWLNQLMQNELYGYGYADFC

SEQ ID NO: 10477 - protein, 170 aa, Triticum aestivum
PIHRHVSRGSRPIQGLGVGSLIRATPAQTIDGAPPLHRRRHEALTGRSGRGRCAGSMSRRHGRFHHGAGGGDGDQGAGPAVVDHADCTAQSCRSCVAVSLADCIALGCCPCAVVSLLGLALVKAPLAVGRRCVQRLRRRHGKLQHKKRVRDMDLAGGRPGPSAAGAKCAG

SEQ ID NO: 10478 - protein, 208 aa, Prochlorococcus marinus str. MIT 9301
MKNFLQQINSYIKEAFNAGKYLYNGFSVTFDHLRRRPVTVQYPYEKLIPSERYRGRIHYEFDKCIACEVCVRVCPINLPVVDWVMNKETKKKELRNYSIDFGVCIFCGNCVEYCPTNCLSMTEEYELATFDRHNLNFDNVALGRLPTNVTTDPSVKPLRELAYLPKGVMDPHEVPSSDTRVGKLPEEVYDWMRSESNEKKDKASNPNN

SEQ ID NO: 10479 - protein, 381 aa, Prochlorococcus marinus str. MIT 9301
MDSNKLILKPGLEGVPVTNSSICDIDGNKGKLLYRGYSIEELSQKSSFLETAYLLIWGELPTAIQLRDFEQEVQMHRRLSFRVRDMMKCFPATGHPMDALQSSAASLGLFYSRRAIDDPNYIYNAVIRLIAKIPTMIAAFQLIRKGQDPIQPRDDLTYSSNFLYMLTEKEQDPIAAKVFDRCLILHAEHSLNASTFSARVTASTLTDPYAVIASAVGTLAGPLHGGANEDVIAMLEEIKTPENAASFLDNAIKNKSKIMGFGHREYKVKDPRAIILQKLAEELFIRFGADEMYEVAKSLEAEAIPRLGPKGIFPNVDFYSGLVYRKLGIPRDLFTPIFAISRVAGWLAHWREQLGANRIFRPSQIYTGSAPRDWISLENRK

SEQ ID NO: 10480 - protein, 398 aa, marine gamma proteobacterium HTCC2080
MSDSTPKIPRSAEDDYSEESLAARQAFIEAQTGVALNHTKQYSYDPHVMAGNIENIWGVAQIPIGVAGPLLVNGEHAQGEFYVPMATVEGTMLASYNRGMKVIRESGGVTTTVSAESMQRAPVFIFADARDARDFQVWLRANFDAIKAQAESTTSVGKLLEIENYHAHNFIATRFDYSTGDAAGQNMTSRATFFACEWIRENYPGNMRNYMLSGNFDTEKKTSSVNMLKGRGRRVTAEITIPRKVLMDNLRITPEQMQYGYQVSTLAAFMSNSSNNASHPANGLAALYLATGQDIANIGESNQCTVYQRATRDGDHYFSITLPSIIMASYGGGTNLPTQSECLKMMDCFGQDKALKLCEIAAGLVVAGELSLAAATRIDKATRTNEWVDAHERLGRNR

SEQ ID NO: 10481 - protein, 605 aa, Yarrowia lipolytica CLIB122
MSSTYSSIQRHRKDTSSSGSNTTPLARRRRFDEGPADPGSAPHLDSFVVPPTRHDDGTKRQPGRRKQRWSHGENKVADLLQMPTALTGHLTPEQAEAYAIYYRIEEISQQLRLGDIVPPEDERSPSPPPQYDSMGKRTNTRDARYTRQLEEERHRLIERAQRLIPNYRPPVDYHKPAKTQEVVYIPVNEYPDINFIGQLLGARGKTLKKMEQESGAKICIRGRGSVKQGKGRTDIPFQSTAEDDLHCLIISEDEEKIARAVQLVQQVIDTAASVPEGQNELKRSQLRELAALNGTLRDDENYGGAPQSSSGDEMDDRNKRRNNFMSSIVCHICGSKGHFARDCLEKGTNAGTSENADREYDALMRELQGEGVIDTASQQQSIAQNPNTNNVSKLPPAVTGSNAAPINMRKPMSERGGSFDRFDRGGFNQSNQREPQQQSHQQNMHNTNGNNYDRYDRNFNNSSNSSPELPPWHRPTPPSQPAAPPWLRRDNYKKHDKVSVQQSMQQSPWNRDTRQHQHQHQPPVHHQSMFNNNQSPIGPPGMSSSGFGGYGGAPAGVPGMSVPPGPPGLSKVPPPPPPPGVPGMDGDQPIRHPPPPPPGVIGPPK

SEQ ID NO: 10482 - protein, 569 aa, Arabidopsis thaliana
MDPIESVEYNGFETTNGNSHNDDHGWKKVVYPKRNRKQKPADQAAATKNGVTGNLIPNGTLSNGGGNVFRSLEEQAEGRHLQILAAKKASDTADVSDGGRSKWRSNGYGDEGYDFDDSDSEIAVGKENLKAEEVKKPKVKKVKKPKVTLAEAAAKIDVSNLAAFLVEASIPLSHIPEAVYKTSADWINQRPIEALGAFVLWGLDCILADLAVQQGGVKGGKKGAQQASSKSQVAIFVAVAMVLRKKPDALTNILPTLRENPKYQGQDKLPVTVWMMAQASQGDISVGLYSWAHNLLPVVSSKSCNPQSRDLILQLVERILSNPKARTILVNGAVRKGERLIPPPSFEILVRLTFPASSARVKATERFEAIYPLLKEVSLAGAPGSKAMKQVTQQIFTFALKAAGEENPLLAKEAAAITIWALTQNVDCCKHWENLYTDNLKASVAVLKKLIGEWKERSVKLTPAETLTLNQTMKSLRQKNEEALTEGGNGVSQSLYKDADKYCKVIAGKLSSGGCIKSIATTAALLAATGFAGAAALSANPEAIAYLKNLVESLDINKFTETVMTALKN

SEQ ID NO: 10483 - protein, 563 aa, Brassica oleracea
MAMLETKIIIIVILLLLMVLMLFLFSLVILFACKPWRYLPLFRSSTFKLGELQRPLVSDGDGEHLNQGQTGEEGSREYDLEGACYQNEGILQGRAYKQRLPSSSPHLNQGRTLKHPADKVSLGDVETDDLQDNTSQSLQHDLEKERLSELSPGLVIVNDQRSWLCLEVISGPSIGLQFAVHSVSTSKLPLGLGRVPPSGMLLKDPEVSGKHAQITWNSTKFKWELVDMGSLNGTLLNSRSVSHPDLGSRKWGQPVGLASEDIITLGTTTKVYVLISSQNEFKTPFRVGVASDPMAMRRGGRKLPMEDFCYYKWPLPGVNKFGLFCVCDGHGGAGAAQSAVKIIPEVLANILSDSLEKEKVLSQRDASDVLKDVLAKTEARLEDHLYEGCTATVLLVWKDDEENLFAQCANLGDSACVINLDGRYIQMTEDHRVASLTERRRIQEAGLSLRDNETRIFGINLARMLGDKFPKQHDGRFSAEPYISEPLRIDQSNKDVFAVLASDGLWDVVSPSKAVQLVLQMREKERGTEDSAEKIAKGLLDQANVMRTKDNTSIIYLDFDPSL

SEQ ID NO: 10484 - protein, 119 aa, Alternaria arborescens
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLAR

SEQ ID NO: 10485 - protein, 103 aa, Lactuca sativa
MSGSGKGGKGLGKGGAKRHRKVLRDNIQGITKPAIRRLARRGGVKRISGLIYEETRGVLKIFLENVIRDAVAYTEHARRKTVTAMDVVYALKRQGRTLYGFGG

SEQ ID NO: 10486 - protein, 141 aa, Burkholderia vietnamiensis G4
MAIERTLSIIKPDAVAKNVIGQIYSRFEGAGLKIVASRMAHLSRADAEKFYAVHAARPFFKDLVDFMISGPVMIQVLEGEGAILKNRDLMGATDPKKAEKGTIRADFADSIDANAVHGSDAAETAAVEIAFFFPEMNVYSR

SEQ ID NO: 10487 - protein, 424 aa, Methylobacter marinus
MYVIVPTGRADQTKLSSRSYEAGRLATRLFRSVVMKALCWHGKYDVRVDTVPDPIIVDPTDAIVKITATAICGSDLHLYDGYMPTMESGDILGHEPMGEVVEVGSEVTSLKTGDRVVVPFTISCGHCFFCEKTLYSCCDTSNPNADMARKAMGHSPAGIFGYSHMLGGFAGGQAEYLRVPYADVGPIKITSDLPDDKVLFLSDIFPTGYMAAENAQIEPGDTVAVWGCGPVAQFVIQSCWMLGAGRVIAIDRVPERLTMAQEHGKAEIIDFEEEDVYDRLMAMTNGRGPDCCIDAVGCEAHGAGSFDAVLDKAKAALYLGTDRPHVLREAIMCCRKGGTVSIPGVYVGLLDQLPMGAAMNKGLTLKMGQTHVQRYLEPLLEKIEEDQIDPSFVITHSLGLDEGPQAYKTFRDKEDGCIKVVLKP

SEQ ID NO: 10488 - protein, 365 aa, Rhodococcus sp. RHA1
MSTERFETIVIGAGQAGLATGYHLTRCGQRFVILDAHDRVGDVWRERFDSLRLYSPARYDGLPGWGIPAPAWSWPGKDEVADYFEAYAQRFALPIRTGTTVDGLSRDGDRYVVTAGTDRFEADNVVVASGTWQSPVVPDLAERLDPRIRQLHSSDYRNPSQLQDGPVLVVGCSHSGADIALEASRSHRTTICGPVRGEVPFDIEGRLAHLAVPIMWFMANHVLTERTPVGRKMCTHVRSGGGPLLRVKRADLAAAGVEHFPAKVTGVHDGRPVLDDGTAFDVRNVIWCTGFRKDTSWIQIPVTGSDGWPEQSRGVSPDHPGLYFVGLPFLQAFASMLTGGVGRDAAYVAKHIAKRVVVRSPEAVA

SEQ ID NO: 10489 - protein, 246 aa, Lolium perenne
MGRGRVELKRIENKINRQVTFAKRRNGLLKKAYELSVLCDAEVALIVFSNRGKLYEFCSTQSMTKTLEKYQKCSYAGPETTVQNRENEQLKNSRNEYLKLKARVDNLQRTQRNLLGEDLDSLGIKELESLEKQLDSSLKHIRTTRTQIMVDQLTELQRREQMFSEANKCLRIKLEESNQVHGQQLWEHNNNLLSYERQPEVQPPMNGGNGFFHPLDPAGEPTLHIGYPQESLNGSCMTTFMSPWLP

SEQ ID NO: 10490 - protein, 228 aa, Lolium perenne
MGRGKVELKRIDNKISRQVTFAKRRNGLLKKAYELSVLCDAEVALIIFSTRGRLFEFSTSSCMYKTLERYRSCNYNSKATATPETELSNYQEYLKMKTRVEFLQTTQRNLLGEDLGPLSIKELEQLENQIEISLKNIRSTKSQQSLDQLFELKRKEQQLQDVNKDLRRKIQETSAENVLHMSCQDVGPSGSSGQANQANEQELFHSAVCDPTLHIGFHQSYLDQLNNN

SEQ ID NO: 10491 - protein, 415 aa, Magnaporthe grisea 70-15
MSDLQGRKIFKVFNQDFIVDERYTVTKELGQGAYGIVCAAVNNQTSEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMAKKPFPTLFPNANPDALDLLDRMLAFDPSSRISVEQALEHPYLHIWHDASDEPDCPTTFNFDFEVVEDVGEMRKMILDEVYRFRQLVRTAPGAGGHGAPHAPQVPIPAGAGQGQWKAEDPRPQEYVGQMNDLEAELAGGLDQRR

SEQ ID NO: 10492 - protein, 241 aa, Lolium perenne
MGRGKVVLQRIENKISRQVTFAKRRNGLLKKAYELSILCDAEVALVLFSHAGRLYQFSSSSNMLKTLERYQRHIFASQDAVVPTSDEMQNNYLEYMELKARVEVLQHSQRNLLGDDLAPLNTSELDQLESQVGKTLRQIRSRKTQVLLDELCDLKRKEHMLEDANLTLKRKLDEMEVDAAPPPPPPPQQQQLPWQNDHGVAVPSYAPPQPDHFFQALECSPSLQPAFRCMDVNQPPPAWMA

SEQ ID NO: 10493 - protein, 358 aa, Campylobacter coli RM2228
MNTYKIAVLPGDGIGLSVMKEALKILNFVAQKHGFKLETKEAKIGGASIDAYGVALSDETLKLCEQSDAILFGSVGGPKWDNLPIDQRPERASLLPLRKHFNLFANLRPCKIYESLRHASPLKDEIIQKGVDILCVRELTGGIYFGKQELGKESAYDTEIYTKAEIERITRLAFESARIRNKKVHLIDKANVLASSILWRDVVGQIAKEYEDIKLEYMYVDNAAMQIIKNPSTFDVMLCSNLFGDILSDELAAISGSLGLLCSASLNDKGFGLYEPAGGSAPDIAHLNIANPIAQILSAALMLKYSFKEEKAARDIENAIAIALERGKMTKDLNANSYLSTDEMGDCIVEILKENNNG

SEQ ID NO: 10494 - protein, 448 aa, Zea mays
  misc_feature (132)..(132): Xaa can be any naturally occurring amino acid
  misc_feature (209)..(209): Xaa can be any naturally occurring amino acid
  misc_feature (225)..(225): Xaa can be any naturally occurring amino acid
  misc_feature (233)..(233): Xaa can be any naturally occurring amino acid
LGPSRPAGKRARPQSANSYRIYAPACWLASSSCLDPLVRGPWRRPWLSATTVPLQQGGGLSEFSGLRSSASLPMRRNATSDDFMSAVSFRTHAVGTSGGPRRAPTEAKLKVAINGFGRIGRNFLRCWHGRGXASPLDVIAINDTGGVKQASHLLKYDSTLGIFDADVKPVGDNAISVDGKVIKVVSDRNPSNLPWGELGIDLVIEGTGXVFVDREGAGKHIQAGXAKKVLITXAPGKGDIPHLRRRASMPDQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 10495 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDYGFDMEETLVEAIYTAEQSENAFYMHDEAMFEMPSLLANMAEGMLLPLPSVQWNHNHEVDGDDDDVSLWSY

SEQ ID NO: 10496 - protein, 229 aa, Erythrobacter sp. NAP1
MTPEEQERELQRRERAASRLFSGRVDFLLSAPQLKFLPDPICPEVAFCGRSNVGKSSLLNALTGRKAIARASVTPGRTQELNFFDVGGEPGGKPLFRLVDMPGYGFAKAPVKVVERWKNLVKSYLRGRPVLARNLVLVDSRHGLKDVDREMMKMLDEAAVGYRIVLTKTDKIKASELERVANKVADEARKHVAAYPELHLTSSEKGMGIEALRAAVVADALGESWFDAG

SEQ ID NO: 10497 - protein, 995 aa, Saccharomyces cerevisiae
MAGVQKRKRDLEDQDDNGSEEDDIAFDIANEIALNDSESDANDSDSEVEADYGPNDVQDVIEYSSDEEEGVNNKKKAENKDIKKKKNSKKEIAAFPMLEMSDDENNASGKTQTGDDEDDVNEYFSTNNLEKTKHKKGSFPSFGLSKIVLNNIKRKGFRQPTPIQRKTIPLILQSRDIVGMARTGSGKTAAFILPMVEKLKSHSGKIGARAVILSPSRELAMQTFNVFKDFARGTELRSVLLTGGDSLEEQFGMMMTNPDVIIATPGRFLHLKVEMNLDLKSVEYVVFDEADRLFEMGFQEQLNELLASLPTTRQTLLFSATLPNSLVDFVKAGLVNPVLVRLDAETKVSENLEMLFLSSKNADREANLLYILQEIIKIPLATSEQLQKLQNSNNEADSDSDDENDRQKKRRNFKKEKFRKQKMPAANELPSEKATILFVPTRHHVEYISQLLRDCGYLISYIYGTLDQHARKRQLYNFRAGLTSILVVTDVAARGVDIPMLANVINYTLPGSSKIFVHRVGRTARAGNKGWAYSIVAENELPYLLDLELFLGKKILLTPMYDSLVDVMKKRWIDEGKPEYQFQPPKLSYTKRLVLGSCPRLDVEGLGDLYKNLMSSNFDLQLAKKTAMKAEKLYYRTRTSASPESLKRSKEIISSGWDAQNAFFGKNEEKEKLDFLAKLQNRRNKETVFEFTRNPDDEMAVFMKRRRKQLAPIQRKATERRELLEKERMAGLHILSKMKFWKGDDVETGYTVSEDALKEFEDAHQLLEAQENENKKKKKPKSFKDPTFFLSHYAPAGDIQDKQLQITNGFANDAAQAAYDLNSDDKVQVHKQTATVKWDKKRKKYVNTQGIDNKKYIIGESGQKIAASFRSGRFDDWSKARNLKPLKVGSRETSIPSNLLEDPSQGPAANGRTVRGKFKHKQMKAPKMPDKHRDNYYSQKKKVEKALQSGISVKGYNNAPGLRSELKSTEQIRKDRIIAEKKRAKNARPSKKRKF

SEQ ID NO: 10498 - protein, 585 aa, Synechococcus sp. WH 8102
MGDGAAAAQQETATSLPKAEQRKLDSDYLREPLLSELANDLPNFSEDALQILKFHGSYQQDDRDKREKGKDKTWQMMLRLRSPGGRIPAQLFLALDELSDRLGDGTLRATTRQAFQMHGIPKADLKEVIGTIVRNLGSTLAACGDINRNVMAPAAPFEKGGYPAARRLADEIADLLSPEAAEGSYLDLWVDGDLSYRFSPPAAVRRARKRQLEPGVFSGSEAEPLYGDTYLPRKFKVAVTVPGDNSVDLLTQDIGLVAFTDPSGDLRGCNVYVGGGMGRTHNKEETFARIADPLGYVDAADVFDLLQAIVALQRDHGDRRIRRHARMKYLLEDRGIAWFRNELKANYFSRPLKGFRNEAKPKLLDYLGWHRQKAGLWFVGLPLLCGRLKGTMKQGLRAIVDTYQLEIRLTANQDLLLCNIGTAQRATIKAELAALGFDLPDAPPPLARHAIACPALPTCGLAITESERILPSVLERLDAQLRRLEIDKSVLIRMTGCPNGCARPYMAELALVGSGVNQYQLWLGGSANLQRLAQPFLQRMPLDELEQTIEPLLISWKQAGGRRSLGDHVEKLGDQAVSELLGAAA

SEQ ID NO: 10499 - protein, 395 aa, Alkaliphilus metalliredigenes QYMF
MNNMSIDMKEASLNLHRKRKGKVAMRGTTPMKNGTDLAMAYTPGVAEPCLEIFKDKNTVYDYTMKGKTVAILTNGTAVLGLGNIGPEAGLPVIEGKALLLKKFGQVDAMPICLDSTDSDAIIKTIQMIAPGFGGIHLEDIKAPECFYIEEKLRELLDIPVYHDDQHGTAIAVLAGLYNALKVTGKSIEDAKIVINGAGASGIATAKLLISAGVKHIVLCDLEGTLLEGDTGLNEAQQSIAQVTNRQLEKGSLRDIIKNKDVFIGVSAGNVVDEAMVRSMNADSIIFALANPLPEVHPTVAKAGGARIIATGRSDFPNQINNVLVFPGMFKGVLKVRAKDICSEMKIAAAKAIADLVREEELKEDYIVPNVFDKRVSIGVAKAVMKAAREVGIARV

SEQ ID NO: 10500 - protein, 137 aa, Brassica oleracea
FKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 10501 - protein, 471 aa, Triticum aestivum
MHMMRRLKSIASGRSSVSDPGGDSGSKRPKFDQDGLGDIVIQPHLSDDKPMHLDQESSSSSSHRDAEASTSTSMNPAKAEETGADLPKGMNDMTISDDKVDGHNNDKEAEGVTVDGNGTEAGQIIVTTIGGQNGKPKQKVSYMAERVVGTGSFGVVYQAKCLETGETVAIKKVLQDKRYKNRELQTMQLLDHPNVVQLKHHFFSTTERGEVYLNLVLEYVSETVYRVAKYYCRLNQRVPILYVKLYAYQMCRALAYIHRVVGVCHRDIKPQNLLVNPHTHQLKLCDFGSAKKLVPGEPNISYICSRYYRAPELIFGATEYTTAIDIWSVGCVVAELLIGQPLFPGESGVDQLVEIIKILGTPTREEIRCMNPNYSEFKFPQIKAHPWHKLFGKRMPPEAVDLVSRLLQYSPNLRCTAVDACAHPFFDELRDPKTCLPNGRPLPPLFNFSGAELEGLPVELLHRIIPEHMRK

SEQ ID NO: 10502 - protein, 188 aa, Haemophilus influenzae R2866
MAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDANGKTVNRWATTGIMTASAMSNEAALLTQKWIRMLGMVPVCNQANT

SEQ ID NO: 10503 - protein, 808 aa, Haemophilus influenzae R2866
MTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYDEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDKDTSYDQYINAITPKDIVPNQVNYYRHTSKFFVSMMKTFYGDNATKENGWGFDFLPKADRLYDPITHVKLMNEGKLHGWILQGFNVLNALPNKNKTLSGMSKLKYLVVMDPLQTESSEFWRNFGESNDVNPAEIQTEVFRLPTTCFAEEDGSIVNSGRWAQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPLHPNVVTDPTLRIYKEDREFIGSNKDYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 10504 - protein, 610 aa, Coccidioides immitis RS
MAIKNELIWAASPSTTRGQPTQLAADPKGERLAYASNKSVFLRSIDNPAFATQYTEHRADTTVARFSPSGYYVASGDAAGTVRVWDCVGEGITKGEYFIVSGRINDLAWDGDSQRIIAVGDGKQRYGHCISADSGNTVGEITGHSQSINSVSIRQQRPLRAAAAGDDKTLVFYHGAPFKYHTGHRDNHSNYIYGVAFSPNGDNLISVSGDRRIWLYDGKTGEPKLQIGEGEHKGSIFAVSWSHDSRKFVTASADRTVKIWDVETQKVVQNWQLGPEQGPATVPYQQVGVVWPSGRSDGLIISLSLSGDLNYLVEGQQEPTRVIHGHQKNITSIARDDTGPKETLWTGSYDGRLCSWDVGGSEMERVGGEGHPGYVAGLAAARQGGGRIYSVGWDDTIRSVDISSHSYVGNATKLSSQPKGIAAGENTVLVANFQAVEIFQDGKKTGEFLSKASLSTIAAVGTTAALGAEDSSVQIYTVTPTGLEPKANGRVSRNPITAMAFSPDGSLLAAGDSRGRIVVFKAADGTVVTDRWTAHTGRVASLAWNSKGTQLVSGALDTNIFVWSLERPGDWLEAPNAHKEGVNAVAWIADDSKVASAGADGAVKIWQVEF

SEQ ID NO: 10505 - protein, 395 aa, Prochlorococcus marinus str. MIT 9301
MAQLETRTEPMVVNFGPHHPSMHGVLRLVVTLDGENVIDCEPVIGYLHRGMEKIAENRTNVMYVPYVSRMDYAAGMFYEAIVVNAPERLANIPVPKRASYIRVLMLELNRIANHLLWLGPFLADVGAQTPFFYIFREREMIYDLWEAATGQRLINNNFFRIGGVACDLPYGWLEKCIDFCDWFGPKIDEYEKLITNNPIFRKRIEGLGTIQRDQAINWSLSGPMLRASGVSWDLRKVDSYECYDDFDWQIASEKEGDCYARYRVRVEEMRQSLSIIRQACKMIPGGPTENLEAQRMSTEDKKSEIFGIDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 10506 - protein, 151 aa, Rhodococcus sp. RHA1
MDSYQSTLRMLHYFAIPEHLRGDLGLWRAGAHTDFDCLTLLFQQEGQGGLQVLPGKEMDTQEWTPIEPSEDAITCNIGDMLMRWSDDRLPSNFHRVKNPGPDGDHGARYSLAFFAQANRDVVISGPAGKYPDITAEDYLYQRVNANFAKEK

SEQ ID NO: 10507 - protein, 285 aa, Solibacter usitatus Ellin6076
MGAVEIPGALQLENGDDGLTRVLIDTPQAEAEIFLHGAHITRWVPAGKRPVLFTSSRSLYAPGKPIRGGVPLVFPWFGPRGGGLPGPMHGYARISEWTLHATSMRDDGAVELVFTLPRVDAFRLAYRVAVGARLEMELDVRNTSAEELCFEEAFHTYFAVGDIHQVSISGVEGTEYIDKADGFQRKRHPAEPIRIDRYTDQVHVNTTGVCVIDDAAWARRIVIAKSGSATTVVWNPWSDKTPGMPDMAPEDWREMVCVETANAGENGIRLGPGASHIMRATMKVE

SEQ ID NO: 10508 - protein, 107 aa, Brassica napus
  misc_feature (36)..(36): Xaa can be any naturally occurring amino acid
  misc_feature (50)..(50): Xaa can be any naturally occurring amino acid
  misc_feature (52)..(52): Xaa can be any naturally occurring amino acid
  misc_feature (60)..(60): Xaa can be any naturally occurring amino acid
MDPTQNPNPVYDIVILGASGFTGKYVVREALKFLQXPSSPVKSLGFSGVXTXTRLTPVSXRGYSRPNPAGGGIHWLDTAPRILWDEPKSWPRFPPRDVALGPPWGFK

SEQ ID NO: 10509 - protein, 434 aa, Rhodococcus sp. RHA1
MDRTQVVIVGSGFGALAAAKKLGKAGTPFVLISETTEHLFQPLLYQVATGVISPGEIAPSIRAILAKYPSGDVRLGRVVDVDPDKKEVVYEAGGVSHTIGYDSLIAATGARQAYFGHDEFAEVTYALKTVADADRLRRQIVRCFEEAHTTSDPERRRDLLHFIVIGAGPTGVELAGQIKELAGRYFEKSLRDITSEDVTVTLVEGAGETLPVFGGKLSKYTQDSLERAGVEVVLGTMVTDIDEHGATLSSPSTGFEKRLTADTIIWSAGIQANDFAAVLAERTGCETGRGGRLLVDEDLTVGRYDDIYAIGDMASLNNLPAQSPFAMQGGRHVAAIITGKRALGTPFTYRDKGSMAIINRFRAITRVGKIELTGVLAWFLWLAVHLVYLVGFRNRYVAVMSWCGSFLGHRRPHFHYAQEIEPAELREQREDAAA

SEQ ID NO: 10510 - protein, 424 aa, marine gamma proteobacterium HTCC2080
MAVVWAAENVFECSNGALLNEGGLFMRLRIGPGAMVAAAFIGPGTITTASVAGATTGITLIWAIAFSVFATVLLQELAVRSALATDRDLATLIRDFGAGYWWGAPLLLLIILAVGVGNAAYQSGNLSGAGIGLNTALGTNFTSVVLLSATASAILIVINRYRLLERILVVLVAAMGLLFTGLAIMLAPLLWVQPEVRLLPDFSYANLTLVLALIGTTVVPYNLFLHATAARQHWQGSSIGEALKGARWESCVAILFGGVTTTAIVVVAAALVPNAVDQPAINAVIEAIEVQMPGWGVMILGMGLFAAGLTSAIAAPVAAGWTICGALGWSVDPQSLRFKLVALTVVLIGGLFAVVTSRPSALILTAQVTNALLLPLIALVLIMVANSSLLPSSYRNNVVLNATGIAVLVAMTLLAGGKLFKILG

SEQ ID NO: 10511 - protein, 345 aa, Glycine max
  misc_feature (36)..(36): Xaa can be any naturally occurring amino acid
MKNKNGKLKLTFEKFTWTISNFSKLDSKKLYSEKFXLDHHTWKILAYPKGTDVGYLSIYLDAGVVNLPFGWSKFANFKFALINQANDKMTKIKETTKQFNATEIAWGFPKFIHLDELNDSSSGFMVNDTCIIEVQILVSKSEQENQVDQQVNKIDDNHDIDKPIKHTDIFLPKETFPTSFGELVDFQGLGKIEQAFVPLLEEVFSRHPSLIDCQQKRSGRFVEWAFTALGRVLHFLKTKKVKDMDGDACNNLQIFWEELKMFRFDLTWLEPHVQSALAMKTCIERAVRVKRTREDVTALEMETKRLKAKMIQAEVDLEIARRDFVKAKEGFEECDLDAELGYGEP

SEQ ID NO: 10512 - protein, 727 aa, Zea mays
  misc_feature (493)..(493): Xaa can be any naturally occurring amino acid
MNYRFQNLLGAPYRGGDAVFAGDSPVLLSAVGNRVASTDLTASSSLTLPFESSSNVTRLATSPSGDFLLAADDNGRALYANLRRRAVLHRVSFKGAPSAVRFSPDGQLIAVAVGKVVQIWRSPGFRREFFPFHLLRTFPGFAAGVTAFDWSPDSAFLLASCKDLTARLLPVKKGLGGKPFLFLGHRAAVVGAFFATDKKTRRVKGVYTVSKDGAIFTWDLVEGNEENDTSPPPSPGTPEQGSEQNVVDAMELDGGSRKRKILGELEGLDTMLHLAKWELREKHFFMQSPAKLTACDYHRELDMVVVGFSSGVFGLYQMPDFVCLHLLSISREKITTAIFNSSGSWLVFGCAKLGQLLVWEWRSESYILKQQGHYFDVNCIAYSPDSQILATGADDNKVKAGALRSIKTKNIMYKKVWTVSSGFCFITFSEHTNAVTAVHFMANNHSLLSASLDGTIRAWDLFRYRNFRTFTTPSPRQFVSLTADQSGEVICAXTLDSFEIFVWSMKTGRLLDVLSGHEGPVHGLMFSPINAILASSSWDKTVRLWDVFESKGAVETFQHSHDVLTLAYRPDGRQIACSTLDGLIHFWDPSDGLLMYTIEGRRDIAGGRLMTDRRSAANTSIGKYFTTLCYSADGSSILAGGNTKYICMYDVGEQVLLRRFQITRNLSLDGVLDFLNSKKMTDGGALDLIDDEDSDVEEGIDRHTRGNLGLGLPGSMANRGRPMARTK

SEQ ID NO: 10513 - protein, 468 aa, Streptomyces coelicolor A3(2)
MARFRMGEGVLRRKPIEHIEETESGGGLVRSLGLWQLTAIGVGGIIGAGIFTLAGTVANGTAGPAVLISFLIAGVASAAAALSYAEFAGLIPKAGSAYTYGYAVLGELVGWFIGWDLLLEYTAIVAVVAIGISGYFSFLVGEMGADLPNWMLGAPGTGDGHKVDLFAAALCLLIAYLLTLGIRNAARFEMVVVVLKVLVVLLVIGVGVFHINSSNYHPFFPFGVGGAFTGAATVFFAVFGYDAMSTAAEESKDAQRHMPKAIIYSLIISMVLYVAACLVLTGMQNYKDIDPESGFSTAFKSVGLSSLADIIAVGAIIGILTVMFTFMLGVTRVWFSMSRDGLLPKWFAKTHPTRHVPTRVTWIVGVASAVIAGFLPIGEAAELTNIGILLAFVVVCAAVIVLRYRQPDLPRTFRTPWMPFVPALGIVFSIWLITFLQWQTWVRFAVWFVIGLVIYFAYSYRKSELARR

SEQ ID NO: 10514 - protein, 525 aa, Burkholderia thailandensis E264
MRIFRFVKIVFTVIRFGLDEVMLSRIENPRVKFLLRITTIGRRFADPPAVRLRRALESLGPIFVKFGQVLSTRRDLLPVDFANELAKLQDQVPPFDSAVAIAIVEKSLGARIDELFDEFEREPVASASIAQVHFAKLKQGEHKGKAVAVKVLRPNMLPVIDSDLALMRDIATWAERLWADGRRLKPREVVAEFDKYLHDELDLMREAANGSQLRRNFAGLDLLLVPEMFWDYSTPSVLVMERMTGVPISQVDTLRAAGVDIPKLAREGVEIFFTQVFRDGFFHADMHPGNIQVSLDPKHFGRYIALDFGIVGALSDFDKNYLAQNFLAFFKRDYHRVATLHLESGWVPPDTRVEELESAIRAVCEPYFDRALKDISLGQVLMRLFSTSRRFNVEIQPQLVLLQKTMLNVEGLGRSLDPELDLWKTAKPYLERWMAEQIGLRGWYERFKVEAPQWSKTLPQLPRLVHQALLSHHEAPRAISDDLIRQILVEQRRTNRLLQALLVFGLAVGAGAVIARVLIVIAYGG

SEQ ID NO: 10515 - protein, 261 aa, Oryza grandiglumis
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNASRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 10516 - protein, 311 aa, Saccharomyces cerevisiae
MTASTPSNVMTLFLLRHGQSELNHENIFCGWIDAKLTEKGKEQARHSAELIEQYCKANNLRLPQIGYTSRLIRTQQTIETMCEEFKLKPQLQVVYDFNKIKLGDEFGSDDKDNMKIPILQTWRLNERHYGSWQGQRKPNVLKEYGKDKYMFIRRDYEGKPPPVDLDREMIQQENEKGSSTGYEFKEPNRQIKYELECSNHDIVLPDSESLREVVYRLNPFLQNVILKLANQYDESSCLIVGHGSSVRSLLKILEGISDDDIKNVDIPNGIPLVVELDKNNGLKFIRKFYLDPESAKINAEKVRNEGFIKNP

SEQ ID NO: 10517 - protein, 629 aa, Poa pratensis
MARLRPFAGGAGSVAAVVVVFTGWLLAAGGVSAGDPPLSPKGLNYEVAALMAVKSRMRDEKGVMAGRDINSVDPCTWSMVTCSADQFVVSLQVANNGLSGALSPSIGNLSYLQTMLLQNNRISGDIPPEVGKLAKLKALDLSGNQFVGEIPNSLGQLTQLNYLRLDRNNLSGQIPVNVASLPGLTFLDISFNNLSGPVPKIYAHDYSLVGNKFLCNSSILHGCTDVKGGTHDTTSRPSAKAKNHHQLALAISLSVTCAIIFVLLFVCWLSYCRWRLPFASADQDLEMELGHLKHFSFHELQSATDNFNSKNILGQGGFGVVYRGCLRNGTLVAVKRLKDPDVTGEVQFQTEVELIGLAVHRNLLRLYGFCMTSKERLLVYPYMPNGSVADRLREYRHGKPSLDWSKRMRIAIGAARGLLYLHEQCNPKIIHRDVKAANILLDESFEAVVGDFGLAKLLDRQDSHVTTAVRGTIGHIAPEYLSTGQSSEKTDVYGFGILLLELITGPKTLSNGHGQSQKGMILDWVRELKEEKKLDKLVDRDLKDLFDIAELECSVDVIIQCTLTNPILRPKMSEVLQALESNVTLAENGIDLNREALPYGGSCSFSVRHEDPHDSSSFIIEPIELSGPR

SEQ ID NO: 10518 - protein, 895 aa, Ralstonia eutropha JMP134
MSAVPEQILGASSANDADPQETHEWLDALQGVIAAEGSERAAFLIDKQIEYARVNGVTQPFHAETQYINTIPVEQQARIPGDQDIEHRIRSYTRWNAMAMVLRANKHTNVGGHISSFASAATLYDVGYNHFWRAPSEQSGGDLVFVQGHSAPGVYSRAFLLGRLTPDQLDSFRQEVDGKGISSYPHPWLMPDFWQFPTVSMGLGPIMAIYQARFMKYLDSRGLAKAGDRKVWAFLGDGETDEPESLGAIGMAGREKLDNLVFVINCNLQRLDGPVRGNGKIIQELESEFRGAGWNVIKVVWGSKWDSLLARDTKGLLMKRMMDCVDGEYQTMKAKDGAYVREHFFNSPELKAMVADWSDDDIWRLNRGGHDPHKIYAAYKAASEHKGQPTLILAKTIKGYGMGDAGQAMNVAHQQKKMPVDAIRKFRDQFNLPVPDDKLDEVPYITFPEGSKELEYMRQARMNLGGYLPARRQKAEALQIPQLSAFDALLKATGEGREVSTTMAFVRILNTLLKDKQIGKHVVPIVPDESRTFGMEGLFRQVGIWNQEGQKYVPEDHDQLMFYKESQTGQVLQEGINEAGAMCDWIAAATSYSTHGVQMIPFYIYYSMFGIQRIGDLCWAAADMRSRGFLLGGTAGRTTLNGEGLQHEDGHSHVFHSVIPNCISYDPTFQYELAVIMQDGLRRMYAEQEDVYYYLTVMNENYEHPEMPAGVEQDIVKGMYQFRKGVENSNAPRVQLLGSGTIFREVIAAAELLKKDWGVESDLWGCPSFTELAREGQAAERFNLLHPAEPQRESFVAQKLKSARGPVIASTDYVRAFAEQIRPFVPRRYVVLGTDGFGRSDTREKLRHFFEVDRHWVTLAALKALADEGAISRDKVAEAIKKYNLDPNKPNPMSV

SEQ ID NO: 10519 - protein, 629 aa, Poa pratensis
MARLRPFAGGAGSVAAAVVVFTGWLLATGGVSAGDPPLSPKGLNYEVAALMAVKSRMRDEKGVMAGWDINSVDPCTWSMVTCSADQFVVSLQMANNGLAGALSPSIGNLSYLQTMLLQNNRISGDIPPEVGKLAKLKALDLSGNQFLGEIPNSLGQLTQLNYLRLDRNNLSGQIPINVASLPGLTFLDISFNNLSGPVPKIHAHDYSLVGNKFLCNSSVLHGCTDVKGGTHDTTSRPLAKAKNHHQLALAISLSVTCAIIFVLFFVFWLSYCRWRLPFASADQDLEMELGHLKHFSFHELQNATDNFNSKNILGQGGFGVVYRGCLRNGTLVAVKRLKDPDVTGEVQFQTEVELIGLAVHRNLLPLYGFCMTSKERLLVYPYMPNGSVADRLREYHHGKPSLDWSKRMRIAIGAARGLLYLHEQCNPKIIHRDVKAANILLDEGFEAVVGDFGLAKLLDRQDSHVTTAVRGTIGHIAPEYLSTGQSSEKTDVYGFGILLLELITGPKTLSNGHGQSQKGMILDWVRELKEEKKLDKLVDRDLKDLFDIAELECSVDVIIQCTLTSPILRPKMSEVLQALESNVMLAENGVDLNREALPYGGSCSFSVRHEDPHDSSSFIIEPIELSGPR

SEQ ID NO: 10520 - protein, 417 aa, Oryza sativa
MDPSKRGFMNLLNQGSPSQQSSQNSPPTQFPSTFSQSQFPQSPHFTQASPPNFQTFNPFGPPANYHLYGSSPPNFQGFQQQASWLQSAPISFQGFRPQESWMHSPNQVVGSASSHGSESASQCPARQEENNLVNIEESSDNSQETGRRGTHVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 10521 - protein, 444 aa, Agrobacterium tumefaciens str. C58
MLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 10522 - protein, 152 aa, Brassica napus
MAGKLMTLQVFHLLSISLVIFFVFSVNVVSEEDYQRAVPPEDKTTTVWFSRIKQSGNDYWAKLKESLGRGHARFFPPNIDFRGKDDASMGAGGKMKEAVTRSFEHSKDSVEEAARSAAEVACDAAEAVKEKVKRSFSGSETTQQQSYGTEEL

SEQ ID NO: 10523 - protein, 506 aa, Coccidioides immitis RS
MTGNIVDHAFKMFIGGLNWETTDQSLKDYFSQFGEVQECTVMRDGATGRSRGFGFLTFKDPKTVNTVMVKEHYLDGKIIDPKRAIPRDEQERTSKIFVGGVSQDANEQDFKKFFMQFGRVVDATLMIDKDTGRPRGFGFVTFDSEAAVEACLSQPLEILGKPIEVKKAQPRGNLRDEDDRRLRARGFQGDRFKDEKSGSTDVSQQGAQGQTNLANTMTPQMMAQYWQRMQQYFAMMQQQMALAAAQGQGMAGAAAMGGMNPAMAQQMQQLKQMQQMNPMAGGQPQGAAMNQPAQGAVPQGMQGMMNPMMMQQMQQMQQMQQLQQMQQMQNQPQGGPGYGGPGMGGQMSGAKPGNMNQGMTSGPGAMGGGNFSGPRGGPGYNAQEQLAFEQQKYEQQQQVRRVIDPRNYGGYQQGTTGNWDNGYEEQPNIPTGPQAGMGRGQPAGRGGMSPSPGLAPKQPQKIPTPQPQSSPPANAPTGPRNAGKPGANYRGGGRGVHRGFHPYARG

SEQ ID NO: 10524 - protein, 253 aa, Glycine max
MGKKGGSWFSSVKKVFKSSSKDSPQPEKKKDNTQKLQHEVAEVVSFEHFPAESSPDNVSNAEMSTTSTPVTNEDRSHAIAVAAATAAAAEAAVVAAQAAARVVRLAGSYGRQSKEERAATLIQSYYRGYLARRALRALKGLVRLQALVRGHNVRKQAQMTMRCMQALVRVQARVRARRFQLSHADQEREKKEEPKPIPVPVPMSPLRRIDDINDWDNRRQSSYKIKENDLRKHEAVMKRERALAYAFNYQQVS

SEQ ID NO: 10525 - protein, 303 aa, Rhodococcus sp. RHA1
MTDLTGAIVLGDHQYGKAENRIVRIYRDTPRHEIRDVSVSTCLRGDFSAAHLAGDQSSVLPTDTQKQTAFSYAKEKGLDSIEEYGLTLARHFVDDVAPVEGARIEIEEYAWQRAVVDGAEHDHTWVRKGEEVRTAAITVDGDGTWVVGGLKDLVILKSTGSEFFGFLKDEYTILEETHDRVMATSLVVQWRFVTTDVDWNGVYAGIKERIVATFATVHSLALQQTLYEIGKAILERYPVLAEVRLSAPNKHHFAHDLARFGVENDNEVFHAADRPYGLIQATVQRSDAPDAGPAWSAYAGWLS

SEQ ID NO: 10526 - protein, 109 aa, Rhodococcus sp. RHA1
MSKILSTHVLDATDGTPAAGMFVHLLSPERDVIASASTDADGRIAEIAPEGLIAATYSLVFETGEYFAARGQETFYPEVSVTFVLDDPQRGYHVPLLLSPYAYSTYRGS

SEQ ID NO: 10527 - protein, 170 aa, Rhodococcus sp. RHA1
MTEPPGLIAFNALSDARAADLLVQCCSSAVWAERVAAGRPFPSADALYTAADNVLGDLTESEIDAALAGHPRIGDRADNPSSAREQSAVASADDVVRARLRAGNEEYEQKFGHVYLVCASGRSAQELLDVLRDRLGNDSATERKILRTELAAINRIRLERLLGEIGDTEH

SEQ ID NO: 10528 - protein, 214 aa, Pseudozyma flocculosa
MEDEVAALVIDNGSGMCKAGFAGDDAPRAVFPSVVGRPRHQGVMVGMGQKDSYVGDEAQSKRGILTLRYPIEHGIVTNWDDMEKIWHHTFYNELRVAPEEHPVLLTEAPLNPKANREKMTQICFETFNSPAFYVAIQAVLSLYASGRTTGIVLDSGDGVTHTVPIYEGYSLPHAIRRLDLAGRDLTEYLSRILMERGYPFTTTAEREIVRDIKE

SEQ ID NO: 10529 - protein, 369 aa, Burkholderia vietnamiensis G4
MRRTCSPTCTCRIRERGLTEQLPADTANRIFQETDMARKITYSQAINEALAQEMARDDSVIVMGEDNAGGAGAPGEDDAWGGVLGVTKGLFHKFPGRVLDTPLSEGGYIGAAVGAAACGMRPVAELMFIDFMGVCFDQIFNQAAKFRYMFGGKAVTPVVIRAMYGAGLRAAAQHSQMLTSLFTHIPGLKVVCPSTPYDAKGLLIQSIRDNDPVIFLEHKLLYTREGEVPEESYAIPFGEANVVREGDDATIVTYGRMVHLATDAAAKLAKDGIHVDVIDLRTTSPLDEETILESAERTGRVVVVDEANPRCSIATDIAALVAQRAFRSLQAPIELVTAPHTPTPFAGVLEDLYIPSADAIAQAVLKTRS

SEQ ID NO: 10530 - protein, 192 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKIRYEITSESGAWASGLHMDGQNTGHRPAVKGGYAPVAPIDCG

SEQ ID NO: 10531 - protein, 327 aa, Burkholderia vietnamiensis G4
MTVSTQLSRDTLLDAYRLMRTIREFEERLHVEFSTGEIPGFVHLYAGEEASAVGTMLHLGLEDYVATTHRGHGHCIAKGVDVHGMMAEIYGKKTGVCHGKGGSMHIADLAMGMLGANGIVGAGGPLVCGAALAAKHKKTGGVGVCFFGDGASNQGVIFESMNLASVWRLPAIFVAENNGYAEATSASWSVATDNIADRANGFGMPGVIVDGFDFFAVHEALGEAVARARNGGGPTLVEVKFTRYFGHFEGDAQTYRAPGEVQKLRDEKDCLKHFETRVVRAEVLTTDELRAVDAQVKALIDDAVAQAKAAPLPDAADLLADVYVSYP

SEQ ID NO: 10532 - protein, 495 aa, Leptospira interrogans serovar Copenhageni
MEPVQKLQIPYKSIRLSDGTEYQSYHTEGALSGKQPADYKNGIPAFRKEWIQKRFNHSNHSQMYFAKKGIITEEMRYAAFRENMEPEFVRSEIACGRAILPSNRNHPELEPMVIGKNFLVKINANIGNSTFSSSIEEEVEKLHWAIKWGADTVMDLSTGKNIHETREWILRNSPVPIGTVPIYQALEKVKGKTENLNIQIFLETLEEQAEQGVDYFTIHAGVLLRYIPLTTNRITGIVSRGGSILAKWCQAHHKENFLYTHFDEILKVMKKYGVSISLGDGLRPGSIADANDKAQFSELETLGELTQLAWKEDIQVMIEGPGHVPMNLIKENVDLQTKICQEAPFYTLGPIVTDIAPGYDHITSAIGAAMIGWYGTAMLCYVTPKEHLGLPNKEDVKQGVIAYKIAAHAADLAKGHPGAIDRDNLLSKARFEFRWEDQFSLSLDPETAKTFHDEMLPQDRMKTAHFCSMCGPHFCSMNLTQELRKFAQEKEIQES

SEQ ID NO: 10533 - protein, 354 aa, Rhodococcus sp. RHA1
MLPPVPEPFDVPVIDISPYVTGGSDSERARVAREIDSACATVGFIQILGHGIPEPVIEGLAGAVDDFFALPLETKKTYRVEGANRGYSPPKSESLSLSLGVESATRMNDFFEAYNVGTEARSFPDLNLSEADYGLNVWPEVPSFTDSVQEYYAHGERVAHTLTRIFADALGLDPGFFTALTDHSIDVLRMNNYALPEGSVTLDGELTGMGEHTDFGLVTVLWADRVAGLQVLGRDERWHDVSPAEGALLVNLGDLTARLTNDRWMSTLHRVTPPVVDGTIKRRRSAAFFHDGNVDAVIATLPGLCEHSDDGYAPVTVREHIKAKLAGSRHGKKNTAAGRETERVLAAAERAAAR

SEQ ID NO: 10534 - protein, 405 aa, Triticum aestivum
MTALATILCGGAVAGHQRSRRRAAPSLHVRGGSASDAAHLVCGRKLRPALFPASSFGTLPLSSPGSRKLLRTSASAAAPSSDSQGQAKPIGFLERYPALVTGFFFFMWYFLNVIFNILNKKIFDYFPYPYFVSVTHLSVGVLYCLISWSTGLLKRAPMNSTLLKLLLPVAICHAIGHVTSTVSFAAVSVSFAHTIKALEPFFNAAASQFILGQQVPFTLWLSLAPVVIGVSVASLTELSFNWTGFINAMISNISFTYRSIYSKKAMTDMDSTNLYAYISIIALIVCIPPALIIEGPQLVQHGFKDAIAKVGLAKLVSNIFLAGLFYHLYNQVATNTLQRVAPLTHAVGNVLKRVFVIGFSIIIFGNKITTQTGIGTAIAISGVALYSVIKAKIEEKKEGVAAAAP

SEQ ID NO: 10535 - protein, 460 aa, Rhodococcus sp. RHA1
MSFHAVDQRLPLVRQAAFGLQHVLIMYTGCITVPLVFGAAVGLDKSTVALLISADLLIAGIITIIQSLGVGKLAGARLPIVCGATFAGLTPMILIAKEYGLQAVYGSMLAGGVVGLALAVPFARLIRFFPPLVTGVVLTVVGISLIGVAAGLVVGNDPTAATFADPGNIMLAGVVVLVAIAFLCLGRGIWTQLGVLLALVTGTLVAIPMGLIDLGGVSGSPWFGITAPFHFGAPEFPITAVVAMSIVMAVVFAESTASMLALGEITGKPLTKGDVARGLVGDALSGVLGGIFNAFVDTIFTQNVGAVATTRIHSRYVTATSGAILIVLGLVPKMGTVVAALPAPVVGGVGIILFSTVAVVGMNTLRKVDLSDRINTTIVAVSVGIGLLPEFAEGMFEHFNSSAQILLGSGITLAAISAFSLNLLFNHTRIGAAARAASAPVIAADPVSPTSEEPHVAARA

SEQ ID NO: 10536 - protein, 536 aa, Arabidopsis thaliana
MEKGVECNTTCNLPFIVLRLGPFSLFSSLNRKLNRRHHRPNSLLSSPISNFQFVCFISSQILPLTPKFYKIHHRRLRFFMGKWNHRSRHHRRRSPERWYSGRQSSSSSVYCEDDGIPVWEKRFCEVIGSVPWQKVVEAKDFKSWYNGNVITWDDSACEDTFHNEKKRFWSQVNGLHCDVSIPDPDLYISEVDWDTFVDPELIRDLEKAYFAPPDDVNIGFKRGRGDKNWSGCDTVPEARMLETPWKNSDDIIETGKKSSGWNLTEGSSWEAKPCCVNEKANDTASGGCLTTEEWRENQWIAKDRVNDSWEYSGQGKDDGWDKSGHQNKKVKGSEEYKKIDNPWEAQPSCIKETAKDTTWGGCSGEGWEDRGWNNDSWGSGGWDNRDLGNQGMEMKEWRGKGYSRDFREPKGCNPWKGGFVPDNVAFRESGVNAGGWQTCRGSETKQINWDVKRASDGWGRQNDNAALREYGANAGDWQRRRGCEGNQRNWDAKRTGDGWGRQNKERVDSYGYHSNYKNSWPRRDDYQNRKVNFSTK

SEQ ID NO: 10537 - protein, 261 aa, Oryza latifolia
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNLLNERTLKGTFFGNYKPRTDLPNVVELYMKK

SEQ ID NO: 10538 - protein, 327 aa, Saccharomyces cerevisiae
MSFRPGSRGGSRGGSRGGFGGRGGSRGGARGGSRGGFGGRGGSRGGARGGSRGGFGGRGGSRGGARGGSRGGRGGAAGGARGGAKVVIEPHRHAGVYIARGKEDLLVTKNMAPGESVYGEKRISVEEPSKEDGVPPTKVEYRVWNPFRSKLAAGIMGGLDELFIAPGKKVLYLGAASGTSVSHVSDVVGPEGVVYAVEFSHRPGRELISMAKKRPNIIPIIEDARHPQKYRMLIGMVDCVFADVAQPDQARIIALNSHMFLKDQGGVVISIKANCIDSTVDAETVFAREVQKLREERIKPLEQLTLEPYERDHCIVVGRYMRSGLKK

SEQ ID NO: 10539 - protein, 150 aa, Synechococcus sp. WH 8102
MSLHSWSQRVVNTAMRRLRSALLLLPLLLATAAVEPIAAEDSRGDGLITIESDQQSADNSTGVVTASGNVRIVHANRGVVATSRQAQYFTKEERIVLRGDVDVVQNDGHALRADQVIYLLQEDRAVAIPVEGEQVYSQWTLKDPSPGTEP

SEQ ID NO: 10540 - protein, 500 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNPRVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 10541 - protein, 547 aa, Candida glabrata CBS 138
MVDENSNNENGLDQEEEIDVYSDLYSTYTQVTSLTTNDVDNTTYPMTWKTVALFGSSTVGGLLFGYDTGVISGVLLSLKPQDLGRATISDWDKELITSITCLGCFVGSLLGSPLADKYGRRITLAIFCVLFIVAALWMALASNLVLLVFGRFVVGIAVGTAAQCTPVYLCEISPAKIRGQILALNSIAVTGGQFLSYIFAYELYDVNGSWRILFGLSAVPAIIFLSMLDFIPESPRWLVSMSKYDSAKAALRMIYPTASPGQINLKFNELVINLSKLKHYQDEQTSLMVPLSVRSSRVTINSADYGSVANLRSLHSLMNEPSGTNHSNKTVHHRMEPRTKRALLIGCVLMFFQQITGFNAFMYYAPLIFSKLNSHNPLLPAMSIAFTNFLFTFLAVYLVDLVGRRSMLLNTIWIMTVGLLLSTIGFQHENVVVLLFAVSIFVAAYASAMGTIPWSSVEFLPLNRRSFGASCISCTNWLTNFVITASYLSVMNKIGTEDTMLFFALFSVMAWFFVYFWYPEVKGLSLEEIGKVFENGIDVHYVYRNYY

SEQ ID NO: 10542 - protein, 281 aa, Saccharomyces cerevisiae
MSNHSEILERPETPYDITYRVGVAENKNSKFRRTMEDVHTYVKNFASRLDWGYFAVFDGHAGIQASKWCGKHLHTIIEQNILADETRDVRDVLNDSFLAIDEEINTKLVGNSGCTAAVCVLRWELPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 10543 - protein, 944 aa, Candida glabrata CBS 138
MLKFLRTNRYYHLLSGTKLSQKIIEQCRNEIDTIRKNHKFLPTLKILQVGNRLDSSAYVNMKLKKSEQSGVKCIVEKLPESITEFELLSKIEAINNDTSIHGLLIQLPLPKHLDETTITSSVSVDKDVDGFHIYNAGELTKKNGHPKFIPCTPNGCIELLKEHNITIAGKNAVVIGRSSIVGTPITSLLKNLDATVTQCHSKTVNLPEIVKTADIVIAACGQANMIKGEWLKEGAVVIDVGINHVPDNTKKSGHRLVGDVDFDSASKKASYITPVPGGVGQMTVAMLVSNVVLAAKRSLANFEKVPEIKPLPLKLEKPVPSDFEISKSQEPKHIDNLAKELGIFQDELELHGHYKGKISTSILDRLESKKNGRYVLVAGITPTPLGEGKSTTTMGLVQALTGHLGKPSIANVRQPSMGPTFGVKGGAAGGGYAQVIPMDQFNLHLTGDIHAVGVANNLLAAAIDTRMLHESTIKNDAKFYDKLVPKKNGIRSFSPAMTRRLERLGINKTNPDELTAEEINKFVRLNINPDTINIKRVVDVNDRMLRKITIGQAATEKGRTRETGFDITVASELMAILALSTSLQDMKRRVSKLVVASDINGKPVTVDDIGCSGAIVALMTDTIKPNLMQTLEGSPVLVHAGPFANISIGASSVMADKIALKLMGTCLDSQEPGYVVTEAGFDFSMGGERFFNIKCRSSGLVPDTVVLVATVRAIKSHGGAPDVKPGQALPQEYIEENIEFVKKGVANLVKQIENVKKFGVPVVVAINKFSTDTENETKAIEESCKAAGANNVVVSNHWEEGGKGAIDLANAVVQSCEEPKSFQFLYDTDLPIKEKLETIVKEMYGGAGIELSEKAQKQIALYTEQGFDKLPICIAKTQYSLSHDPKLKGVPQDFIVPIRDIRASIGAGYLYALAAEIQTIPGLSVHAGYLNVEVDDKGNINGLF

SEQ ID NO: 10544 - protein, 167 aa, Nicotiana tomentosiformis
MLPMITEFINYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSVINDYTIRTISNLPQIKNE

SEQ ID NO: 10545 - protein, 444 aa, Mycobacterium avium 104
MLDILPSLGHAAPPRFDPAIWPVTAHPDEEGRLCVGGVPLGDVADEFGTPVYVVDEADFRCRARRYRRALRGVEVVYAGKSLLSTAVARWAREERLGVDVCSAGELATALAGGVDPARIVMHGNAKSPEELREAVRVGVGRIVLDSTIEIAYLAGLARRRQPVLIRVTPDIDIHGHRAVTTGVSDQKFGFTLAGDHAADAVRRVLAHPILDLVGLHCHLGSQVSDPALYGEAIRRMIAAMADVRARHGVILTELNIGGGHAIPYASGDPELNLDQLADVIEDALDEACAAERFPRPQIVVEPGRAISGRAGVTLYRVCSVKTQCGGRTFVAVDGGMSDNPRVSLYGARYAVALANRHPLGLKQRVTVAGRHCESGDEIARDVGLPADLRPGDLLAVACTGAYHHSMASNYNMVGRPPLVAVSEGRARELVRRETVADLLARDRG

SEQ ID NO: 10546 - protein, 210 aa, Triticum aestivum
  misc_feature (16)..(16): Xaa can be any naturally occurring amino acid
  misc_feature (42)..(42): Xaa can be any naturally occurring amino acid
MAPTVMASSATSVAPXQGLKSTAGLPVSRRSNGASLGSVSNXGRIRCMQVWPIEGIKKFETLSYLPPLSTEALLKQFDYLIRSKWVPCLEFSKVGFIFREHNASPGYYDGRYWTMWKLPMFGCTDATQVINEVEEVKKEYPDAYVRIIGFDNMRQVHCVSFIAFKPPGARSPPRPPQLTHDRPYIKCHCSFVNSDIALGFPSPFIFLICS

SEQ ID NO: 10547 - protein, 393 aa, Nicotiana tomentosiformis
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNFFRIGGVAADLPYGWINKCLDFCDYFLTGVAEYQKLITRNPLFLERVEGVGIIGGDEALNWGLSGPMLRASGIEWDLRKVDHYESYDEFDWQVQWQREGDSLARYLVRISEMTESIKIIQQALEGIPGGPYENLEIRRFDRLKDPEWNAFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 10548 - protein, 484 aa, Agrobacterium tumefaciens str. C58
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 10549 - protein, 115 aa, Coccidioides immitis RS
MSRSTKLAPEANRILFVKNLSYNVTADDLFDLFGKFGPIRQIRQGIAANSKGTAFVVYEDVHDAKQACDKLNGFNFQNRYLVVLYHQPEKMAKSKEDLAARQENLEKLKQQHGIE

SEQ ID NO: 10550 - protein, 1499 aa, Candida glabrata CBS 138
MSLASDKKDADVASTTTTAQDDDNLSTYHGFDHHVQDQVRQLARTLTQQSSLHQKKEHTLPEEGINPIFTNTEADDYNPRLDPTSDEFSSAEWVQNMSNISNSDPDYYKPYSLGCYWKDLVATGESADIEYQANFLNGPYKGLKTVYNTVVPSTASSKDKNFKILKSMEGAVNPGELLVVLGRPGSGCTTLLKSISSNTHGFNIAKESTISYSGMTPNDIRKHFRGEVVYNAEADIHLPHLTVYQTLLTVARLKTPQNRLKGIDRETYARHLTEVAMATFGLSHTRNTKVGNDLVRGVSGGERKRVSIAEVSICGSKFQCWDNATRGLDSATALEFIRALKVQASISNAAATVAIYQCSQDAYDLFDKVCVLYDGYQIYFGPAGKAKEYFQKMGYVSPERQTTADFLTAVTSPSERIINQDYINRGIFVPQTPKEMWEYWRASEDHADLIKEIDSKLSDNYDANLAEIKDAHVARQSKRARPSSPYTVSYGMQIKYLLIRNFWRIKQSSGVTLFMVIGNSSMAFILGSMFYKVMKHNTTSTFYFRGAAMFFAVLFNAFSSLLEIFSLFEARPITEKHRTYSLYHPSADAFASILSEVPAKLITAVCFNIIYYFLVNFRRNGGVFFFYFLINIVAVFAMSHLFRCVGSVSKTLSAAMVPASMLLLGLSMYSGFAIPRTKILGWSKWIWYINPLAYLFESLMINEFHDRKFPCSQYIPSGSVYNNVPADSRICSSVGAIRGNDYVLGDDFLRESYSYLHKHKWRGFGIGLAYVIFFLVLYLILCEYNEGAKQKGEILVFPQNIVRRMKKERKLKNVSSDNDVEIGDVSDISDKKILADSSDESEESGANIGLSQSEAIFHWRNLCYDVQIKKETRRILNNVDGWVKPGTLTALMGASGAGKTTLLDCLAERVTMGVITGEVSVDGKQRDDSFARSIGYCQQQDLHLKTSTVRESLRFSAYLRQPADVSIEEKNQYVEDVIKILEMEQYADAVVGVPGEGLNVEQRKRLTIGVELAAKPKLLVFLDEPTSGLDSQTAWSICQLMKKLANHGQAILCTIHQPSAILMQEFDRLLFLQRGGKTVYFGDLGDGCKTMIDYFESHGSHKCPPDANPAEWMLEVVGAAPGSHANQDYHEVWRNSDEYQKVQEELEWMSNELPKKNTNNSETVHKEFATGVLYQCKLVSLRLFQQYWRSPDYLWSKFFLTIFNNIFIGFTFFKADRSLQGLQNQMLAVFMFTVIFNPLLQQYLPSFVQQRDLYEARERPSRTFSWKAFIVSQILVEIPWNILAGTVAFVIYYYAIGFYSNASVAHQLHERGALFWLFSCAFYVYIGSLALFCISFNQVAEAAANMASLMFTLSLSFCGVLVTPNGMPRFWIFMYRVSPLTYLIDGMLSTGVANVAIKCSNYELLRFSPAANLTCGEYLGPYLQTVKTGYIVDPSATDTCELCPYSHTNDFLSSVSSKYSRRWRNWGIFICYIAFNYIAGIFLYWLARVPKKSGKLAKK

SEQ ID NO: 10551 - protein, 544 aa, Petroselinum crispum
MGDCVAPKEDLIFRSKLPDIYIPKHLPLHTYCFENISKVGDKSCLINGATGETFTYSQVELLSRKVASGLNKLGIQQGDTIMLLLPNSPEYFFAFLGASYRGAISTMANPFFTSAEVIKQLKASQAKLIITQACYVDKVKDYAAEKNIQIICIDDAPQDCLHFSKLMEADESEMPEVVINSDDVVALPYSSGTTGLPKGVMLTHKGLVTSVAQQVDGDNPNLYMHSEDVMICILPLFHIYSLNAVLCCGLRAGVTILIMQKFDIVPFLELIQKYKVTIGPFVPPIVLAIAKSPVVDKYDLSSVRTVMSGAAPLGKELEDAVRAKFPNAKLGQGYGMTEAGPVLAMCLAFAKEPYEIKSGACGTVVRNAEMKIVDPETNASLPRNQRGEICIRGDQIMKGYLNDPESTRTTIDEEGWLHTGDIGFIDDDDELFIVDRLKEIIKYKGFQVAPAELEALLLTHPTISDAAVVPMIDEKAGEVPVAFVVRTNGFTTTEEEIKQFVSKQVVFYKRIFRVFFVDAIPKSPSGKILRKDLRARIASGDLPK

SEQ ID NO: 10552 - protein, 544 aa, Petroselinum crispum
MGDCVAPKEDLIFRSKLPDIYIPKHLPLHTYCFENISKVGDKSCLINGATGETFTYSQVELLSRKVASGLNKLGIQQGDTIMLLLPNSPEYFFAFLGASYRGAISTMANPFFTSAEVIKQLKASLAKLIITQACYVDKVKDYAAEKNIQIICIDDAPQDCLHFSKLMEADESEMPEVVIDSDDVVALPYSSGTTGLPKGVMLTHKGLVTSVAQQVDGDNPNLYMHSEDVMICILPLFHIYSLNAVLCCGLRAGVTILIMQKFDIVPFLELIQKYKVTIGPFVPPIVLAIAKSPVVDKYDLSSVRTVMSGAAPLGKELEDAVRAKFPNAKLGQGYGMTEAGPVLAMCLAFAKEPYEIKSGACGTVVRNAEMKIVDPETNASLPRNQRGEICIRGDQIMKGYLNDPESTRTTIDEEGWLHTGDIGFIDDDDELFIVDRLKEIIKYKGFQVAPAELEALLLTHPTISDAAVVPMIDEKAGEVPVAFVVRTNGFTTTEEEIKQFVSKQVVFYKRIFRVFFVDAIPKSPSGKILRKDLRAKIASGDLPK

SEQ ID NO: 10553 - protein, 402 aa, Dianthus caryophyllus
MSGTRTFSSVIHLHKPIVKQAIEDLVRDGLFKPVGFVVDMFCAEMVDLANEMNVPTYLFFTSGASFLNFLLYAQSLADDRPEIDIVREFSRRDFSALVPGFQNPVTSNVIPALLQEKSGCELLLNFARKFREMKGILVNTYAELEPYGLQALAKGDGKRIPPVYPVGPILELHKKSGRGTTSMDESVIQWLDAQPESSVVFLCFGSWGSFDEEQIKEIANGLEQSGHRFLWALRKPPPKGKLAAPSDNEPYVEGPPGRFLERTSGRGKIVAWAPQVEVLAHRAIGGFVSHCGWNSTLESLWFGVPMATWPMYAEQQMNAFELVKDLNLAVEIRMDYKRDLVMGKSNFAVTAEEIENGVKTLMNADGKLRSRVTKMSEEGRKALEEGGSSHDNLEHFIEDVLQ

SEQ ID NO: 10554 - protein, 402 aa, Prochlorococcus marinus str. MIT 9301
MSKLSLSSLDKTHLEGKKVLVRVDFNVPLNEDGQITDDTRIRAAIPTIEYLVNHSAKVILAAHFGRPKGQVNEKMRLTPVAARLSELLGQSVALTNSCIGDEAVAKSNSLSNRDVLLLENVRFFGEEEKNDLEFAQKLASHADMYVNDAFGAAHRAHASTQGVTNYLSPSVAGFLLEKELKYLQGAVDSPNRPLAAIVGGSKVSSKIGVLDSLLDKCDKIMIGGGMIFTFYKARGLDVGKSLVEEDKLELAKDLEAKAKAKGVELLLPTDVVLANEFSPDAESKISQIDSISGNWMGLDIGPDSIKVFQNALAECKTIIWNGPMGVFEFDKFADGTNAIATTLADLSAFSEVCTIIGGGDSVAAVEKAGLAEKMSHISTGGGASLELLEGKILPGVAALNDA

SEQ ID NO: 10555 - protein, 285 aa, Arabidopsis thaliana
  misc_feature (26)..(26): Xaa can be any naturally occurring amino acid
  misc_feature (197)..(197): Xaa can be any naturally occurring amino acid
LSNSLASTSLSNRLETIFKKASEAQXLCILCDIEACVIYYGPDGELKTWPKEREKVEDIALRYSQLNEALRRKKSVTLYDFLNKKKDKTNLEKKAMITDNDDLKTCLKNVNVLKSPIADHYFNDQISQLIQSLEPHVSKVQERIRFVESQKHKETKLDHQSLASIYSLNQSLNPSQFTLFLYNHGDNTMSQTPVTAXNFNQDFSELLQESGLMKQELCGYDQNMFMNNNNFQHSFVSNTQDYSALQESVNNNYGLMPNVLCGYDQNLFTSDITNNNLLIDNSMYL

SEQ ID NO: 10556 - protein, 327 aa, Pseudomonas fluorescens PfO-1
MLFAISALASTLAAQATSRTEPKPDWSTQDMPSQNGRIVLVTGGTSGMGYEDALALTRAGAEVIIAARNAERGREAIANIRQAVPEARVQFETLDLANLQSVRDLANRLQGRLPRLDVLINNAAIMSPPVRGVSADGYEMQLATNYLGHFALTGLLMPLLRKSDDGRVVSLSSIAAGRAVLNFDDLQAERAYDPFTTYSQSKLAVLKWSIELQQRSDAAGWGIRSIAAHPGVAVTELIARGPGLDSEFGKQWAVERDMYHSAAQGALPTLYAATAPEAVGGAYYGPTGDNEKRGPLGFAKMPPAAADRSNSDALWQLSERLTGVTYR

SEQ ID NO: 10557 - protein, 130 aa, Zea mays
  misc_feature (48)..(48): Xaa can be any naturally occurring amino acid
  misc_feature (103)..(103): Xaa can be any naturally occurring amino acid
  misc_feature (112)..(112): Xaa can be any naturally occurring amino acid
MWRVSVFNDALKSMYNAENIGKRQVMIRTTAKGIIKFLTVMHRHGYIXECEYADDHRSRKIMPELNGRMNKCGVIRPRCDISAKDIEGWTARMLPSRQIAYIXLTTSTGIMXHDEARRKSVAGKDLRFFY

SEQ ID NO: 10558 - protein, 180 aa, Ostreococcus tauri
  misc_feature (97)..(103): Xaa can be any naturally occurring amino acid
MCKQSASAVTYDELQGLTYLQVKGTGLANTCPVVEGGVSGKDIKAGDYKLERFCMEPTSFTVKEESQFKAGESEFQKTRLMTRLTYTLDGMTGDFKXXXXXXXIAGVFESIQPSDTDLGAKVPKDVKITGLWYGNIAKRHVDLRTRRWINSVVDACECRFPYTQCNGSLCFISSLSSKCA

SEQ ID NO: 10559 - protein, 390 aa, Parvularcula bermudensis HTCC2503
MRKRSLDDFHQTRRLPPYVFAQVAEMVKAARAAGRDIIDLSMGSPDMQAAPQVIETLRERVYDEDASRYSDSRGILPLRQACADYYDQRFGVALNPDTQVVATLGSKNAFANLAFAITAPGDLICCPNPSYPIHMFGFVMAGGSVRHLPAEPSEEVFRAAERTIRFSVPKPIALILNYPSNPTTITAEIGFYEEAVRFAKKHDLFLLSDLAYAEVYEGTPPPSLLQVEGAMDISVEFTSASKSFNMAGWRMGFAVGNEDLIAALTRVKSYLDYGSFGPIQQACTVALQDWQSITDDVRAHYRSRRRALHKAAEEAGWHIPRSETTMFAWTPLPKGETDSLAFCRRMVAEAGVALSPGVGFGEGGEGHVRIALVADEARLAEAAQRVGRAL

SEQ ID NO: 10560 - protein, 431 aa, Synechococcus sp. WH 8102
MKRVLAIILGGGAGTRLYPLTKMRAKPAVPLAGKYRLIDIPISNCINSNINKMYVMTQFNSASLNRHLSQTFNLSASFGQGFVEVLAAQQTPDSPSWFEGTADAVRKYQWLFQEWDVDEYLILSGDQLYRMDYSLFVEHHRSTGADLTVAALPVDPKQAEAFGLMRTDGDGDIKEFREKPKGDSLLEMAVDTSRFGLSANSAKERPYLASMGIYVFSRDTLFDLLDSNPGYKDFGKEVIPEALKRGDKLKSYVFDDYWEDIGTIGAFYEANLALTQQPTPPFSFYDEKFPIYTRPRYLPPSKLVDAQITNSIVGEGSILKSCSIHHCVLGVRSRIETDVVLQDTLVMGADFFESSDERAVLRERGGIPVGVGQGTTVKRAILDKNARIGSNVTIVNKDHVEEADRSDQGFYIRNGIVVVVKNATIQDGTVI

SEQ ID NO: 10561 - protein, 261 aa, Oryza latifolia
GVTDLAPGDHVLPVFTGECKECPHCKSAESNMCDLLRISTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNLLNERTLKGTFFGNYKPRTDLPNVVELYMKK

SEQ ID NO: 10562 - protein, 305 aa, Parvularcula bermudensis HTCC2503
MPPIERIPLPLPAPEDVVVAEGGQVYTALRDDGVLVELPSGGSSARVCAEIGGRGLGVELYGDGRLLVCNATMGLQAVDPVTGRVESLLSQIDGRPIGVCNNASVGRDGTVYFSESSRVHPLDHYRRDLIENTRSGQLLRWRPGTAPEPLLSGIAFANGVVLSPEEDFVLLAETGLCQIHRYWLSGPRAGQADLFAALPGFPDNLSLGTDGLFWAAIAAPRVATAEAIHKLPRPLRALIARLPESLGPQAEKTCEVMAFDGEGQVVHHLRGDASRFHQVSGVREHNGVLWLGSIEEEALGRVVLR

SEQ ID NO: 10563 - protein, 510 aa, Zea mays
MERRRRRPPRLPLLVFVLVATTCPLGSSGIGSFGVGAESNGASSSFRTRSLLQIGDRNEDGLFHLPHTRALTHKSRSHRKVPTPAPAPESAPAPSPSMSPPDSSPSPSPHGSHPMPRQSTSHRHPSITPPHLVRPGPRQDGNDPLVYTPAHSRHKHFWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITNLSKVSHKNFMNLLGYCEEEHPFTRVMVFEYAPNGTLFEHLHVREAEKLDWMARLRISMGIAYCLEHMHQLQTPAALRNFDSTTVYLTDDFAAKVSDLEFWNDAKGHNSTTNNELAFSLDMEDIVRKYGMVLLEILTGRVPSSEDDGPLENWVSRYFEGGMRLEELIDPSIGFFPEDTARALCEVVRSCIDRDPKKRPQMKEVAARMREITALGPDGATPKVSPLWWAELEIMTSES

SEQ ID NO: 10564 - protein, 399 aa, Streptomyces coelicolor A3(2)
MLGIVLAGGEGKRLMPLTADRAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSFGVITPGSDGQTVTGFLEKPADPPGLADDPGCVFASMGNYVFTTKALVEALHRDAEDPDSVHDMGGSILPQLTDRGEAALYDFSANHVPGETTRDQGYWRDVGTLDAYYDAHMDLIAERPAFNLYNRDWPVYTHSTQLSPARFNAGGIASESIISAGCLIRGQVTRSVLSPGVVVDPGAVVQGSVLHDNVHIGRGAVVRGAVLDKNVQVPPGATIGVNPQRDGELYTVSKGGVIALGKGQRVP

SEQ ID NO: 10565 - protein, 261 aa, Oryza australiensis
GVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 10566 - protein, 381 aa, Oryza sativa (japonica cultivar-group)
MEYGAATRGALLAATLLAGARRSRLPLSPPPSPPSIQIQNRLYSMSSLPLKARGVRRCEASLASDYTKASEVADFDWENLGFGIVQTDYMYITKCGQDGNFSEGEMIPFGPIALNPSSGENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 10567 - protein, 766 aa, Alkaliphilus metalliredigenes QYMF
MIKIPQEVIEEEKNYRNKVEELKKGVIEPERFKPYRVSMGIYEQRDNDTYMIRTRIPSGVISLEQLKKISELAKQYSHGYIHFTTRQDIQFHKVTLDDTVNIMEGLLEAGIVTRGTGGNTARNIGCSPLSGVSQDDVFDVASYALVTTEYALKDPSMLNLPRKYKIAYSNSPEDTGNATISDLGFVAKIENGEKGFEVYGAGGLGGSPNVSIKLADFIPASEVLYHVQAMKELFENEGDRTNKHKARIRYILQRLGEETFKAKYQEILQEIKKEKSLEVFFKESIPTKQIGEYAEISNPLIFEQKNKGYFSLYIHPENGNLDVENLDKVIKYIDDLNYEVSIRLTNTQGFFVRDLLGSDAENLLDLTGSFTSTFDIDNSVACAGAATCKLGLGLSQNLLSAIKSRFANVDEAIKLQLPRIFISGCQNSCGQHQKGEIGLYGRARRVADGLVPMYVVSFEGAVGVGKANLGSDYGTIPAKKIPGFLYELANLKSESGIIDFSEFVKKEKASLDQLIEGFSTIESETENPNLYYDFGSEEKFSLKGRGPGECSAGVLDVIKLDISNSQAYINEFEKVKESIKLYDASVSAARALLILKGVDTTKDRLIFKEFISHFVDTGHVKEQIKSLIEDLLDYKLGDLDSLENHYEEVKYLVNKVVQMYESLNTKLEITLPKEAEVQNTQNASEVEVNNHTSLNIVDLKGVKCPMNFVKAKIEMAKILSNETIGFYLDNGEPIVNVPKSLGGEGHEIIKIDDKYEGYNLLIVKKK

SEQ ID NO: 10568 - protein, 405 aa, Coccidioides immitis RS
MGNESSIMVDDDVRPQALESRTLEAVAKYIHEKNARKIVVMVGAGISTAAGIPDFRSPDTGLYANLARLNLPTPEAVFDIQYFRTDPRPFYALTKEMLPGKCKPTITHSFIKLLYNKGRLLKLFTQNIDCLEREAGIPSEMIVEAHGTFATQSCIECKTPYPGELMTKAMEANDVPLCPECMNLVKPDVVFFGEALPSSFFLNRTLPAAADLCIVMGTSLSVQPFSSLPSLCREGIPRLLINLTQAGGLGSRPDDVLLLGECDDGVMKLADALGWRQELEELWATVNPEKAAAIASKEQKSTPITRDDQLREEVEKLTEEVEHALDISQAHEERVRAQLQEMKAKQDRGVEEPEDAQSRQVGSTSPGEPDGIKHANNPTQNGAIAATEQNTAEQQPERSKQDSSL

SEQ ID NO: 10569 - protein, 467 aa, Nicotiana tabacum
MATFTLPSLFILLSLLSVAHSGSIGINYGRIANNLPSPAQVVQLLKTQGVNRIKLYDTDSNVLTALSGSNISVTVALPNEQLSDAAEKQSFTDSWVQSNILTYYPKTLIESIAVGNEVFVDPKNTTKFLVPAMKNVYASLVKYGVAESIKVSSPVALSALGNSYPSSAGSFKPDLVEPVIKPMLSFLKQTGSYLMVNIYPFFAYAANTDTISLDYALFKDNKGVTDPNNGLVYKSLFEAQIDAVYAALKAVGFGDVAMAVSETGWPSKGDENEAGAGADNAAAYNGNLVRRVLTGSGTPLKPNEPLDVFLFALFNENQKPGPTSERNYGLFYPNEQKVYDITLTKDGLGNGPTMNNGSKSTVVTAPEPALEASKVGNTWCVANEKAAREKLQAALDYACGEGGADCRPIQQGATCYDPDTLEAHASYAFNSYYQKNTRGVSTCDFSGAAYVVTQHPKYGSCKFPTGY

SEQ ID NO: 10570 - protein, 238 aa, Zea mays
FLGFIIVCKRAIVLDEMKSAVFSAAVVSIGYALLGWDFAALSEANHHMEKEFELLNGPSIEGITLAASTFGAIVITIFSGALLDWLGRRVILVYSSLVLFSGGVLMLWSPNIYIVLLARLIVGSGSGLVFTCVPIYISETSPSNMRGLLGTMPQFMFFIGTIFSYCLIFWLTLMSSPSWRIMIGAIFAPSIVYFALLVYYLPESPRWLASDGKISEARVSLQWLRGKKHDVSGEIVAT

SEQ ID NO: 10571 - protein, 98 aa, Brassica napus
RPPGRPTRPLMNRNFDLRRKMFGDECLGARNIEMVGVARRVGAASKFTGSGGAVVVFCPEGPSQVKSLEEECKKLGFILEPVKIAPSCLNDSDIQSLG

SEQ ID NO: 10572 - protein, 119 aa, Glycine max
MEPSKNSQKPSHFHDYLPVMANKLGGDGLIDELCNGFNLLKDSDRGVITFESLKRNAALLGLQGLGDEDLRSMLGQGDFDGDGALSQLEFCVLMFRLSPELMEGSKLWLEEVLQQELEH

SEQ ID NO: 10573 - protein, 156 aa, Brassica napus
KEAAAVAIWAITQNVDCCKHWENLYSDNLEASVTVLKRLIDEWKERSVKLTPSETLTLNKTMKSLRQKNEEALAEGGASGASQSLYKDADKCCKVISGKLSSGSGYFKGVAIAAVLAAAGAAALSANPEVIEELKSQVESLDLSKLTESVMTAFKN

SEQ ID NO: 10574 - protein, 430 aa, Prochlorococcus marinus str. MIT 9301
MKETIEFLIDTVEARQVLDSRGNPTVEAEVFLECGASGRAIVPSGASTGAHEAHELRDGGSKYMGKGVLNAVNKIHETISPALCGLSSLDQIAVDKLMIEIDGTPNKSNLGANSILAVSLATARASANALDIPLYRYLGDPLSNLLPVPLMNVINGGAHAPNSLDFQEFMLVPHGVNNFSESLRMGTEIFHSLKSLLDQKGLSTAVGDEGGFAPNLSSSEEAGDLLLEAIQKAGFKPGEQVSLALDAASTEFYSDGIYKYEGKSLNSSEMISYLSRLVSNYPIVSIEDGLAEDDWEGWSELNKELGNKVQLVGDDLFVTNTERLRKGIMEKSANSILIKVNQIGTLTETLEAIELAKMSGFTSVISHRSGETEDTTIADLSVATRSGQIKTGSLSRSERIAKYNRLLKIEEELGNQARFAGALGLGPKNI

SEQ ID NO: 10575 - protein, 353 aa, Parvularcula bermudensis HTCC2503
MSRTVRLTILPGDGIGPEVTDAAISVLTAVAPDAGLSLAIDRCPFGGAGIDATGNPLPEQTLKSCVSADAILLGAVGGPKYDEAARHQGAPRPEQGLLGLRKELELFANLRPSKLFEGLEAASPLRRDIVADTDILIVRELTGGVYFGDHREGTDVASDIMPYSREEVDRVARVAFEAAKGRNGRLTSVDKANVLATSRLWRAVVDDVAKDYPTVTVDHVLVDAMAMHLVTKPASFDVVVTENLFGDILSDELSAIVGSIGLAPSASLGTPDTPGLFEPIHGSAPDIAGQGIANPIGTILSAAMLLRHGLKADAAAERIETAVSTVLKQGLRTKDLGGDADTAAATSAILAAL

SEQ ID NO: 10576 - protein, 172 aa, Magnetospirillum magnetotacticum MS-1
MAAGLGSDLFRIKTLERLNADAEAGENKLERHLGPWSLVGLGIGAVIGAGLFSLTGIAAAEHAGPAVTLSFAIAAIGCALAGMCYSELAGMIPVAGSAYTYTYATMGEFVAWIIGWDLVLEYAVGAATVSVSCRATSPASCATPSASTCPVRWCIHPSRPTSSPTARGARLS

SEQ ID NO: 10577 - protein, 285 aa, Arabidopsis thaliana
MTPVNEEKDDFSRNDSTSFRMPSQKCLKANTFQHNKSRYLFSSSKVRSATFSFALLSIPPKDRLSKLFRHLPTFESVSHELNTREWDDLIEKSDIRNKTLPNEDVEPIQSLPPIQFLTHASKTKRVPKDFMVQCTDCKKWRLIPSMQHYNIIKETQLQTPFVCGTTSGWTPNMSCNVPQDGTTCDTWPSIPPIPTGWSRSVHIRSESTKFADVYYFPPSGERLRSSAEVQSFLDNHPEYVREGVNRSQFSFQIPKPLDDNYVKKRTRPVKRRKSSKDNNCEKGKK

SEQ ID NO: 10578 - protein, 115 aa, Glycine max
MAAQRNFQDYLPVMANKLGGDGLIDELCNGFNLLKDSDKGVITFESLKRNSALFGLQGLSDEDLRSMVLEGDFDGDGALNQLEFCVLMFRLSPELMEGSKMWLEQVLQQELKDYF

SEQ ID NO: 10579 - protein, 896 aa, Yarrowia lipolytica CLIB122
MENISDEVVYTTEPPQTTDEKKDQTDYDASIAEVSMTTVEWVAQQLLIPPSELDGSYPEDVHYMARKVEEMSNVTAASIIRANIDYHMNDKNLPAGMMDECRDLLEEYTHGPEGEKEDEMVGDYAGDDFQPENSLMMRYYAALFHDWSPYPQVRSVTTPIPADPNEHVETIRCYIVGTIWVAISAFVNQFFYPRQPAISLTTPVLQLFLYPSGVLLQYILPKWGFKLWGIDFALNPGPWSAREQLMATLMCSVAAVPPYINSNIIVQYLPMFYDQSWALGFGYMFLFMLVTQYMGFGLAGLLRRVAVYPTRAFWPTSLPTLAVNKALLDGHRKETVSGWKITEYQAFMMFGFGAFLYFWVPNYLFTALSTFNWMSWIAPNNINLATVTGSVTGMGFNPIATFDWSVITALVQPVYMPLYTIVTQYVGFVLSGLCILGVWYSNYYNTAYLPINSNDLFDNTGQPFEVAKVLTNSQLDEDKYHNYSPPYYTAANLVLYGIFFAIYPMSFFYYVANEWSVCKQSVKDIWLSIRYLNRSNYEGRDDPFSRQMAQYKEVPDWWYYAILIVMFGLTVAFVEHWEVQTPVWSIVLILCVTLVFLFPFTIVMSATGAQLTLNVILELIMGYTIAGRPIGINVAKAFAVQIQAQAQNLSSDQKIGHYMALRPRSMLRVQLWATMVNGLVTIGVIQFQLTKIEHFCDIKYQKEHEKFTCPNERTFFTASVIWGLFGPKRMFDNQYPVLRWAFLMGFGVFLLFWGVQTVLPWALVKKYPQKERKIRKWQDRLMMVNPVLVAFGGLSWAPYNLSYMTGGLYIAVLFSYYLRKYYTAWWKKYTYVINAALTTGTALSGIIIFFAVQYTNKDLSWWGNNVPFAGQDGAGPPLMDIPADPGYFGPPPSHYP

SEQ ID NO: 10580 - protein, 612 aa, Oryza sativa (indica cultivar-group)
MVRRLLVILLQALTGLLVILALWIVSHLAGDRPPPGPVVCAANGTSGCTLTNIYGSFSDRAICRAANVTYPRTEEELVAAVAAAVAAGRKVKVATRYSNSFPRLACPGGEDGTVISTRWLDRAVRVDAARRLMTVESGMVMRDLIREAAAAGLALPHSPYWSGLTIGGVLATGAHGSSLWGKGSAVHEYVVGMRIVTPAPASEGFAAVRELAAGDPDLDAAKVSLGVLGAISQVTLELQPLFKRSVAFVTRNDSDVADTVAAWGRLHEFGDVAWLPRRRVAVYREDDRVDVATPGDGRSDYPAFRPTPTLPLVASRLAEEWLEERSGSDAARCAASRVMPATLEHLNYGLTNDGEAFTGYPVVGYQHRIQASSLCTGAMEDDGHIPTSTCLWNGRLRGHLFYNSGFSIALSRAPAFVADVARLRDLNPAAFCQIDSKMGLLMRYVAASSAYLGKAEDSVDFDVTYYRSYARGAPRAHADVFDEVEQMALRKHGGVPHWGKNRNYAFDGAIARYPNAGKFMRVKDRFDPDGVFSSEWSDQVLGVGGASPVIVGDGCAMEGLCVCSDDSHCAPEKGYFCRPGKVFTAARVCSPSPRGAANGGDDDDEISDVGDE

SEQ ID NO: 10581 - protein, 436 aa, Oryza sativa (japonica cultivar-group)
MAFSARRSLASGLSRHLSRRLHPSVSHLLPSHHDDHSENPSPPAQPPPLPSALRSPSRSQALGLPLPFGLLHASRRSLSTSPRSNDELDASAEVLSDAASSVSVPADVLADAAASVPVSAPAPFPGEVAAAAADSFAPVAALQHLIDGVHSLTGLNWWACIALTSLLIRTLTVPLLLNQMKATAMRPEIEAINLEMRTISSTRIAGNEKSSTRVTDEGSMSTDPQSMLEGKRKLGELFLRHGVTPLTPLKGLFIQAPIFMSFFFAISNMVEKVPSFKGGGIYWFTDLTTPDELLILPMLTSLTFLVTVELNMQDGMEGNPMLKTMKNFSRVMAVLTIPFTMSFPKAIFFYWVTSNLFSLGYGFVLRKPAVRSFLDLPPIETQFAPAQQPTFNLFGASKSVPAAGSSIAESDRSSSVLSQRFSDLENRAKSRRESQD

SEQ ID NO: 10582 - protein, 440 aa, Bacillus subtilis subsp. amylosacchariticus
MTLFLHGTSRQNQHGHLEIGGVDALYLAEKYGTPLYVYDVALIRERAKSFKQAFISAGLKAQVAYASKAFSSVAMIQLAEEEGLSLDVVSGESYIRLLQQAFRQNASTFMETIRAGKNCGWRLSTASAALWWIISMKSSLLEDLCKETGHSIDVLLRITPRVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVLYRAYGYSMANNYNRIPRPAVVFVENGEAHLVVKRETYEDIVKLDLPFKTGVKQ

SEQ ID NO: 10583 - protein, 420 aa, Oryza sativa (japonica cultivar-group)
MAVAVRTAKIFEGKDPVRWLSNLYDFYNKAAKPEQGESGGGADEHQRRVAEVLEALRLPPVEAVKLREVLEGHRLPDDPAPPSWMEFIEVPSPPPNLEYGVDLTNYLGAVGDEPEQTWWAALAAHRWVFLFGGLAILGLFGYGVYWMIKRRNRRGEAAPPGATGADPPDNPPPATAAASVQGGADSPARGGRGSPPPASEPPGGATSLDEEDVPPQEVYPEGTQFMILLFERPIIYDVRARPNLVESTSGSRDLQMVKIGLRVLTRPLPEKLPTIYRSLGENFNERVLPSIIHETLKAVVAQYNASQLITQREAVSREIRKILTERASNFNIALDDVSITSLSFGKEFTHAIEAKQGEAKSAQLIGEAINNNPAFLALRQIEAAREISHTMARSNNKVYLDSKDLLLGLQQLNVDSKNKK

SEQ ID NO: 10584 - protein, 432 aa, Campylobacter upsaliensis RM3195
MKTQMLYAREGTWTPQMQVVADKEQVSKDFLLENLASGKIIIPANINHTALEPNGIGLGLRTKVNVNLGVSNDCIDYSEEMEKVDLAHKFGIEAIMDLSNYGKTSHFRDALIAKSKAMIGTVPVYDAVGFLEKDLKQIGAKDFLDVVYHHAKSGVDFMTIHAGINSRAARVFKETKRLTNIVSRGGSVLYAWMAMKEAENPFYEYYDDLLEICLKYDVTLSLGDALRPGCTHDASDAAQIAELIELSLLTQRAWNAGVQVMIEGPGHMAINEIEANMQLEKRICKGAPFYVLGPLVTDIGAGYDHISGAIGGAVAAASGADILCYVTPAEHLRLPNLQDVRDGIVATKIAAHAGDLAKLPKERARDDAMSVARQKIDWESMFKLAIDGEKAKKMFNERRPEELNSCSMCGKMCAMNTMNQVMKGEDVSLVKE

SEQ ID NO: 10585 - protein, 324 aa, Arabidopsis thaliana
MMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 10586 - protein, 444 aa, Bacillus subtilis
MAKYTREDIVKLVKEENVKYIRLQFTDILGTIKNVEIPVSQLEKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKDGVNAFYDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 10587 - protein, 171 aa, Brassica napus
TPRSKQAIKSLTSQIKDMAVKASGAYKSCKPCSGSSNRNSDAASASGRFHYAYKRPGISRSGSSTPKILGKEMESRLKGLLSGEGTPESVSGRTESTVFLEEEEEDEPKEWVAQVEPGVLITFVSLPEGGNDLKRIRFSREMFDKRQAQKWWAENFEKVMELYNVQQFNQQ

SEQ ID NO: 10588 - protein, 949 aa, Coprinopsis cinerea okayama7#130
MVLSKRKRAASISSEDDDSFEIVSAGSDDDMDMDISSALTGKASKKKAKSDNELHEEDDEDLANFIKTSITKRDVKQGAQVIKQAKGKAGVAKGEVGGGSFQSMGLHPSLLRSLTLQGYRIPTPIQRLSIPALLENPPRDLVGMARTGSGKSLAYMVPLVQRLGGIHQTTFGARALILLPTRELAVQILKVGKELARGWHAKGDHAGDKEGESSKGQSLRWGLVVGGEGLDEQFEMITNNPDVIIATPGRLLHLVVEMNLDLKSIQYVVFDEADRLFEMGFETAMNELLHRLPPSRQTILFSATLPKSLVEFAKAGLQDPKLVRLDSESKISSDLKMAFFSVKQAEKEACLLTLLRDVIKVPLGENKLEDDDGDKDKKKKGGKKAKVAPHALAPHQTLIFAATKHHVEYLTNLLITVGYSVSHIYGSLDQVARSIQMDKFRKGLTNLLVVTDVAARGIDIPVLQNVVNYDFPHGARVFVHRVGRTARAGRPGWAWSFITNSELPYLLDLQLFLARPLVNTVPGDEDHFYTENLVLGTFGRETLDEEVEYTRSLDDVNHSLPSLRQVMIRGHTLYERSKGKASPASYKRAKEMMKDPKWLLAGSDSSIHPVLLRGSGAEDQRKLQEARANLLRAVSSFKPSETVFEVTHKGNAETAALMKERRKALSKSIERSEAMKMSAKDGIDFDGEDEEVEQRDTKDVEMADEEDIAAVFNTDSKKKGSYRDEEFYLSYTPKDADTERGYSLNDGASSFARQAQNVAFDLEGDDGDGLRKRNNTLTWDKKKKKFIKGDGVGADNVKMIRTESGAKLPATYRSGRFDEWKAKHRVSLPRVGEVENSSGSRGRVFGGKKYKHNQITAPKPLDKLDKNYERKLKKRKEKEAAGMEEEGPSQPTLPGKKGKKGSAPSRRYGGKSFGKVKSELKTVDQIRKDRKIKEQRKAKNARPSKKSRR

SEQ ID NO: 10589 - protein, 717 aa, Arabidopsis thaliana
MAPNLHIKKAFMAMRAMGIEDARVKPVLKNLPALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 10590 - protein, 412 aa, Escherichia coli B
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYERRRDVLVKGLHEAGWMVEMPKASMYVWAKIPEPYAAMGSLEFAKKLLNEAKVCVSPGIGFGDYGDTHVRFALIENRDRIRQAIRGIKTMFRADGLLPASSKHIHENAE

SEQ ID NO: 10591 - protein, 344 aa, Sulfolobus solfataricus P2
MEAVILHGGQGTRLRPLTHTGPKQLIKVAGKPISQWVLEQIRDSGIKDILLILGDNTPTRVVDYYGDGSKFGVNITYVYQGKARGLADAVYRVKDLVSEKFLVYLGDNLVFYDLRKFLSFKGSASILLAKVDNPNRFGVAVINENKVIRLVEKPKEKISDLALVGVYGFTDEIFEVIEKLKPSWRGELEITDAIQGLINEGKEVNYEIIQGWWKDTGTPKDILEANSFLLDRYAERKIEGEVENSTIDGRVILEKGAVVKNSVIRGPAYIGKDTKIINSYIGPFTSIGDLSEISGSEIEYSVILDNVRIKGVSLMDSLIGNNSTVEKGTKWQKLIIGENSSVII

SEQ ID NO: 10592 - protein, 339 aa, Candidatus Kuenenia stuttgartiensis
MRVAMYYNNNDVRIEEMPTPQIGPGELLVKIFASGICGSDVMEWYRIKKAPLVLGHEIAGEIVAIGDAVKQFKVGDRVTVAHHVPCNTCHYCLNGHHSVCDTLRTTNFYPGGFAEFLRVPQINVDRGTFILPQEMSYDEGTFVEPLACSIRGQRLSNFKPGQSLLVIGSGISGLLHIQLARALGAGKIFATDINEYRLKFAKKIGADIAINAKEDVPSIIRKDNNGRLADLAIVCTGAISATEQAFHSIERGGTILFFAPTEPGVKIPIDLWNLWRNCNSIVMSYAGPPADMAVAIELIRTGRIAVNDLITHKLPLNDAAKGFKLVADAKESVKVIIAP

SEQ ID NO: 10593 - protein, 303 aa, Leuconostoc mesenteroides subsp. mesenteroides ATCC 8293
MTKNIVVLGSLNVDNIMKMPRMPLVGETMALTEVTTAPGGKGANQAVAASRQGANVSFIGAVGNDANGQFMRATLLTNGVNVDAVSTNSDVPTGSAYIMLQESGANTILIHGGANQALTIEDINTALIAQADVLIAQFEVPFEVILAAFKIAKKNNVQTILNPAPAVYELTPELMAVTDIVLPNETEAQLLTGINVINDEGVLNRVSDALQAKGVQRSIITLGEAGSFIADGQKRWWVQPEKVDAQDTTAAGDTFIGTLASVIAPDFSNLDDAVQRANIASAIAVTRPGAIPSIPTDKEVDNY

SEQ ID NO: 10594 - protein, 376 aa, Zea mays
MSAEPTSPPLSTAQVRGSLIPPLPDDLAVHCIALLPRAAHPSLALVSRAFHALLCRHPEPLLAARRTLRCSEPHVLLSLRPPSSASPIFFLLLPHPGWPPLPLPSPPVPVSSSASAATDGARLFLVGGSVSAVPSASVQILDPRARSWSAGPRLSSTREFAAAVAHSGALFVAGGCIPSSPFWAEALDLSTPNAKWRAVASPAHLREKWMHGCASLDGKVVVVADRGGLSYDPSAPPAEAWAPVSPVLDMGWKGRAAVVEGILYSYDYLGQVKGYDPYTDSWSTVEGLEGELPKFLCGATLADVGGLLYLGWEGKWKGKLKGKMEMRSMVVIEWASIQITRVQEGRLRGKVVSRDTVLFPDMPRGSTITHCIALEL

SEQ ID NO: 10595 - protein, 443 aa, Symbiobacterium thermophilum IAM 14863
MHFYGTASRNGQGHLTIGGVDVVDLAREFGTPLYVMDEELIRQNCRAYVAAFRDHYPDFDVAYASKAFLCTAMAALVAQEGLSLDVVSGGEIATALQAGFPMDRTYFHGNNKTAEEIRLALEAGVGRFVVDSLHELELLNRLAGERGTTARALLRVTPGVEAHTHEYISTGQLDSKFGIPIEGGQALDAARAALQADHVELLGFHCHIGSQIFDLTGYRVAADRMLAFAAAVREETGFTPSELSLGGGLGVRYVEGDRPLPPADLVACLAEAVRSGAAERALPLPKLIVEPGRSIVAEAGTTLYTVGTIKEIPGVRTYLSVDGGMGDNIRPALYHARYECAVANKLDSERTRIVTVVGRYCESGDVLLTDAAVAADVAPGDLLAVFATGAYNYSMASRYNRFPTPAVVFVRDGRADLVVRRETFADMAACDVLPPRFRPRAEA

SEQ ID NO: 10596 - protein, 478 aa, Pseudomonas fluorescens PfO-1
MNNSYDQLYLFIGGEWIDAQGRSTAAVVNPATGREIGRVPLATAGDLDRALEVSRVGFEQWRQTVPDQRAKILKRAADLILERAPHIAAQMTLEEGKPLSESMDEVVRAAEYFEWFAESARRIDGRVVPANRPGVLQLVKRQAIGPVAAFTPWNFPAITPARKLSAALAAGCSVILKPGEESPSTALALARALDDAGLPKGVLQVVFGVPDQVSSQLIASAIIRKVTFTGSVPIGRLLSARAAEGVKPITLELGGHGPVLVFADADVEKAAVEGVANRFRGTGQVCISSTRFIVQRGAYQAFVDHFVTATKALKIGDGFDPQTQVGPLANPRQLVKMEQLIADAVEKGARVLVGGEALPGDGFFFQPTVLADVPMNARIMHEEPFGPIAVLMPFDELADGLQEANRLPYGLSAYAFTSNARTAIDVADGLEAGMIGINQYRIVATELPFGGMKESGHGSEGGVEGIEHYLTHKFISQV

SEQ ID NO: 10597 - protein, 301 aa, Prochlorococcus marinus str. MIT 9301
MTVQRILIVSGTHGNEINPVWAVKQFSRKENSLNNGIEYEYIIGNPAAYEKGCRYIDVDLNRSFKESGNFDQHKNSFYETNRANFLVDEFGIDGSKPCQIAIDLHTTTANMGTSIVMYGRRSKDFCLAALLQNKFGLPIYLHEKDKAQTGFLVEAWPCGLVIEIGAVAQNFYDQNIVNRFSLIIGSLREEIDKLKNKLVELPKELVVHVHQGSIDYPRDEKGDIDGIIHPARINQDWKMIKKGDPLFLDSQGIIHKYERDKLIWPVFIGEVAYKEKKIAMSYTKKEVICSKKQWVQEFESF

SEQ ID NO: 10598 - protein, 251 aa, Glycine max
MASEEVLKAVFPFLDGVDLASCMAVDKQWKDIASDDFLWKCLCAKRWPSICKQPNPSTLTYYKFYKTFHKRQHRRTLLPPRISFDDLEFFIDIWAENTLLFSEVVPGSVLQAGFKAPASGVCDMLKFQLEGSEYKMTFPVEPRFTIPSGQNQNVSVSVMVGRKDSNKVARVINKSMFDYIDRSSYRALAFDYLDISPGYPFLSGIRAWISLLFMEDRNEDLMDVFGIQMDFCDVANSKEEVLWLLDMLDWK

SEQ ID NO: 10599 - protein, 506 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 10600 - protein, 279 aa, Prochlorococcus marinus str. MIT 9301
MTFNLSSQNFTATLIMRIRSFLAFVISICITFAFVPVKTFAFSERGNAQFTDVVNTGKANDCPTLDSSLIGSISLSNGDSLKGICMHPTEVYVKVPGTKRKAAEFVSTKIISPRNNTTVTEVYGDIDSGTFTEKGGIDFQLITVLTPGGLEVPFAFSAKDLTADLPSSIQPGTEVSGSTFTPNYRTGDFLDPKARAKNTGVEYAQGLVALGGDDEELAKENIKVDVNGTGVITLSINNVDSDTDEFAGTFEAIQPSDTDMGSKDPLDVKIIGELYGRKA

SEQ ID NO: 10601 - protein, 474 aa, Haemophilus somnus 129PT
MNKEIKTQVVVLGAGPAGYSAAFRCADLGLETVIVERFSTLGGVCLNVGCIPSKALLHVAKVIEEAKSLSAHGIVFGEPTTDIDKIRGWKEKVINQLTSGLAGMAKQRKVQVVNGYGKFSGPNAIIVAGDEGETKITFDNAIIAAGSRPIQLPFIPHEDPRIWDSTDALKLKEVPENLLIMGGGIIGLEMGTVYHALGSKIDVVEMFDQVIPAADKDMVQIYTKRIEKKFNLLLETKVTAVEAKEDGIYVSMEGKAASETRRYDAVLVAIGRVPNGKLIDAGIAGVEVDDRGFIRTDKQMRTNVPHIFAIGDVVGQPMLAHKGVHEGHVAAEVIAGQKHYFDPKVIPSIAYTEPEVAWVGKTEKECKAEGINYEVAKFPWAASGRAIASDCADGMTKLIFDKDTHRVIGGAIVGTNGGELLGEIGLAIEMGCDAEDLALTIHAHPTLHESVGLAAEVFEGSITDLPNPKAKKKK

SEQ ID NO: 10602 - protein, 887 aa, Haemophilus somnus 129PT
MSDILKNDVDPVETNDWLLAIDSVIREEGIERAQYIIEQLMQHARANSVSLPTGVSTDYINTIPPSEEPNYPGNLDLERRIRSAIRWNSIMMVLRASKKDLDLGGHMSSFQSSATIYEVCFNHFFKARTEKNGGDLVFFQGHISPGIYARAFLEGRVTEEQLDNFRQEVEGKGLPSYPHPKLMPEFWQFPTVSMGLGPLNAIYQARFLKYLHNRGLKDTSEQTVYAFLGDGEMDEVESRGAIAFAAREKLDNLVFVINCNLQRLDGPVTGNGKIIQELEAQFNGSGWEVIKVIWGRRWDRLLQRDTSGKLLQLMMEVVDGDYQTFKSKDGAYVRKHFFGRYPETEALVAEMTDDEIFALNRGGHDPLKVFAAFNKAKQVKDKPVVLLVKTIKGYGMGEAAEGRNIAHQVKKMDMSGVKHVRDRFNVPVSDAEIDNLPYVKFAEGTEEYKYLHERRQALNGYLPTRLPRFTQQMDVPALEEFAQLFEEQSRPISTTMAFVRSLNVLLKNKSVGKHIVPIIADEARTFGMEGLFRQIGIYNPHGQNYTPQDREQVSYYREAIDGQVLQEGINEQGATASWLAAATSYSTNDMPMIPFFVYYSIFGFQRVGDLMWLAGDQRARGFMIGGTSGRTTLNGEGLQHEDGHSHIQSSVVPNCISYDPAFAYEVAVIIQDGVRRMYGPEQEDVYYYITTLNETYDQPAMPKGAEEGIRKGIYKFETVTGQGKGKVQLLGSGSILRHVREAAKLLADDFGVTSDVYSVTSFTELARDGANADRWNLLHPKEEAKVPYIAQVMNDAPAIASTDYVKLFAEQVRPYIPAQSYRVLGTDGFGRSDSRENLRKHFEVNAHYVVIAALTELAQQGTISKDVVAQAISKYGIDADKINPLYA

SEQ ID NO: 10603 - protein, 536 aa, Triticum aestivum
  misc_feature (228)..(228): Xaa can be any naturally occurring amino acid
  misc_feature (401)..(401): Xaa can be any naturally occurring amino acid
  misc_feature (421)..(421): Xaa can be any naturally occurring amino acid
MGGAADLVLKAACDACGKASELYSTACRHATPCNSCAATMARSRARCNVCAAPITNVIREYNVRVDTTAGKALSIAKFNTGVPPFSKMKGAGNKWSLRKDGLTQGRQLTADMREKYYNRKPWILEDDTGEHQYQSQLEASQSATATYYLLIRRGKEFDAVPVGSWYNFSKIAQYKQLTLEEAEEKMNKRRSSATGYERWMMKTATHGAAAFGSDLKDLGDAKGKAADXSNPRKKVANEDGNHSDKGEEDEEEGVAKKAVRGLSTRGVDDEEDGGKEDFDLEDEIEIGDDWEHEETFTDDDEALDIDPEERPDVADTENPTGPDIKQDDDENEQGAGGNLSKSGKELKKLLRRADGQNESDDEDDGDTDEDESPLSVLAPKLEHQFGSEQQENNTAKLTATXFAVSTPPAPQVPSKKKSGRXMGAKTSNRAAVKKPKAEPEAKTLGVKKEPPSSVEPISKASASAGSDTDTSAITEEEIIRVLRAIAPVRSQDFVPRFKARIRTPEDKKHFHDIVMKYAYSHKTNGVSYLHLRKEYE

SEQ ID NO: 10604 - protein, 326 aa, Bacillus clausii KSM-K16
MGIQFQEGKQFDVIALGRACIDLNAAEYNRPMEETRSFTKYVGGSPANIAIGSAKLGLKVGFVGKIPDDQHGRFISSYMREAGVDTSQLVIDREGHKAGLTFTEILSPEECSILMYREKAADLYLSPDEIDAGYVRSAKVLLISGTALAQSPSREAALKAVSLAKAAGTKVVFELDYRPYTWSSREETSVYYTLLAGMAHIVIGTREEYDIMEGASASGNEQTAKMLFAKEPELVVIKHGVDGSYAYLPSGETFRAGVYKTNVLKTFGAGDSYASAFLYGLLRGYDIDQALRFGSASASIVVSKHSSSEAMPTLSEIKALVEEQHV

SEQ ID NO: 10605 - protein, 309 aa, Thermus thermophilus HB8
MLEVVTAGEPLVALVPQEPGHLRGKRLLEVYVGGAEVNVAVALARLGVKVGFVGRVGEDELGAMVEERLRAEGVDLTHFRRAPGFTGLYLREYLPLGQGRVFYYRKGSAGSALAPGAFDPDYLEGVRFLHLSGITPALSPEARAFSLWAMEEAKRRGVRVSLDVNYRQTLWSPEEARGFLERALPGVDLLFLSEEEAELLFGRVEEALRALSAPEVVLKRGAKGAWAFVDGRRVEGSAFAVEAVDPVGAGDAFAAGYLAGAVWGLPVEERLRLANLLGASVAASRGDHEGAPYREDLEVLLKATQTFMR

SEQ ID NO: 10606 - protein, 554 aa, Leuconostoc mesenteroides subsp. mesenteroides ATCC 8293
MQTDIEIAQSVEIKPITKIATTAGLQANEIEPYGYDKAKINLDPSIVRKQELGKLILVTSINPTPAGEGKSTVTVGLADALNLADKKTMIALREPSLGPVMGLKGGATGGGFAQVVPMADINLHFTGDFHALTSAHDTLAALLDNSIHQGNPLNIDPRRILWKRVVDINDRELRHVTVGLGGPTSGVPREDGFDITVASELMAILTLSTDLMDMKERIKRIVVGYTYSKEPVTVADLGVAGALTVLLKDAIKPNLVQTLAHTPAIIHGGPFANIAQGTNSILATKTALKLADYVVTEAGFGADLGGEKFLDVKVPLLGKTPDTIVIVATVRALKHHGGVALSNLNNEDVTALRNGLENLGQHLTAMNRYGVPVLVAINRFTSDTEAELQVIKDYVQQFGATAYTTEVWAKGGAGAQELAAAVIKKSAQEADFTPLYQADDSAIDKLNTIVQTIYGGTGVELSTKAQKQLQDFKKYGWDKLPIIMAKTQYSFTDDAKKLGAPKDFKIYIREFVPKLGAGFLVALTGSIMTMPGLPKHPAALDIDIDENGTITGLF

SEQ ID NO: 10607 - protein, 494 aa, Anaplasma marginale str. St. Maries
MSGSAVVLCILDGWGNGNGDECDAIHAARKPFWESVVSGCPRSSLSASGEDVGLPAAQVGNSEVGHISLGAGRVVLQDLQRINAEIGEIHSNPYLLQFAEAIKNGRGVCHIMGLLSDGGVHGLQDHITQLARVLAELRIKVLIHAFLDGRDVSPRSAKKHVTALNDAVHSYDISIATISGRYYAMDRDHRLDRTEKAYEAIALARGPRYRDAMTAIESSYSEGISDEFLVPSVIGDYQGFSPKDGILLTNFRSDRIVQILSMILHRSQEVSNILGMVRYSEKIQVPSLFPPRNICNTLGEVVSKCGLKQLRIAETEKYAHVTFFFSGGKEEPFPGEDRVIIPSPQVSTYDLQPEMSAFPMTEVLVERIESRQYSLIVVNYANADMVGHTGNLEAVKKAISVIDACLQMVFNAAKKAGATMLITADHGNAEKMFDMRGTPFTAHTSNTVPLVLCNCDKRFGLVDGRLCDVAPTILELMEIAKPDEMTGSSLLTPE

SEQ ID NO: 10608 - protein, 253 aa, Zea mays
MDEKATMESKLSSAAAFVEGGVQDACDDACSICLDAFCDSNPSTMTKCKHDYHLQCILEWCQRSSQCPMCWQHISMKDPMSQELLEAVEQERNIRANPSRNTAVFHHQMLGDFEIPVGADDAELEERIIQHLAAAAAVRRSHRHHNRRDGHQSRSEASSHPQFLVLSADERTISGQEGDYEQAPAVASGRPLRTLVEQERTRGLADASSPSLRCSTPADSTGRSNNRYFRHIVCMMLSLCTSLHYHRMPVLSV

SEQ ID NO: 10609 - protein, 333 aa, Triticum aestivum
TRPTNPPGSPPAPSSRPCLHSPAPISLHFSSLLMAAARPALPSSPTSLLLARSTSAPDLAARRPRRWLVAAAGVPAVAGALAASASTPAASMLLRDGGATLLVTAGAYSLVRAFDALTERRLVQQSLSRKVVHVLSGVFFMASWPLFSNSTSARFFAAVVPFLNCVRLLTYGLGFYSDEALVKSVTREGKREELLRGPLYYVIVLLIIVLVFWRDSPIGIVSLSMMSGGDGFADIVGRRFGSLKLPFNKKKSWVGSAAMFISGFLLSALMLSYFSWLGYIHVSWDQALGKLVLVALAATVVECIPVTDVVDDNISVPLATMLVAFLLFGNTAN

SEQ ID NO: 10610 - protein, 575 aa, Haemophilus somnus 129PT
MISGITASPGIVFGKALVLKEEKIVLDTQKIKDEQIDIEVARFYSGRAAAIEQLIAIKDRALVSLGEEKAAIFEGHLMILEDEELEEEILDYLRSNKVNAGVAASKIIDQQVAMLSEIDDEYLQERAGDIRDIGNRLIKNILGMKIVDLGDINEEAILVAYDLTPSETAQLNLDKVLGFITDIGGRTSHTSIMARSLELPAIVGTNDITSKVNTGDYLVLDAVNNAIYVNPTQEEIERLKALERQLAEEKAELAKLKDLPALTLDGHQVDVVANIGTIRDCEGADRNGAEGVGLYRTEFLFMDRDQLPTEEEQFIAYKEVVEAMNGRLVVLRTMDIGGDKDLPYLNLPKEMNPFLGWRAIRIGMDRREILHAQLRAVLRASAFGKLAVMFPMIISVEEIRELKSVIESLKQELRDEGKAFDENLQVGVMVETPAAAINAKFLAKEVDFFSIGTNDLTQYTLAVDRGNELISHLYNPMTPAVLSLIKHVIDASHEEGKWTGMCGELAGDENATLLLLGMGLDEFSMSAISIPRIKKLIRNVNYQDAKLLAEQALQQPTAAGILSLVNDFLVEKALN

SEQ ID NO: 10611 - protein, 326 aa, Coprinopsis cinerea okayama7#130
MTTTASTSYKEEWLTGPQSTQFYTRTYLPPGEASPKAVIVFVHGFAEHIGRYTHFHPWLAQRGIAVFAFDQRGYGLTAQDTTGRKSKTSAYGKTCWKDQMGDIDWALKHARNLFPGIPIFLMGHSMGGAEALGFPIETSSSYKDGLALVTAVISTSPLIAQTSPAPSLMKWLGSMASVLLPNTLIPADVNADDLCHDSEVNAAYLKDPLVKQQGSLKGISDMLSKGEALRKELYKNWPPALPVLIVHGNEDKVTCCKASKEFYEAIPATNKKFELFEGGFHELQNEPDGVKEKLVEQIVNFVEETVPTAQVSGGGGSDASVPKASL

SEQ ID NO: 10612 - protein, 119 aa, Lewia infectoria
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTNLCAIHAKPVTIQSKDIQLPR

SEQ ID NO: 10613 - protein, 357 aa, Yersinia pestis KIM
MLRKAWSESNQHTYSVKDDGNTNIGRILSMSTFDLQPGVDFQQAGKQVLQIEREGLAQLDQYINEDFSRACEAIFRCHGKVVVMGMGKSGHIGCKIAATFASTGTPAFFVHPGEASHGDLGMITPQDIVLAISNSGESNEILTLIPVLKRQKILLICMSSNPESTMGKAADIHLCINVPQEACPLGLAPTTSTTATLVMGDALAVALLKARGFTQEDFALSHPGGALGRKLLLRISDIMHTGTEIPTVSPDASLRDALLEITRKSLGLTVICDDSMRIKGIFTDGDLRRVFDMGIDLNNAKIADVMTRGGIRVPPNILAVDALNLMESRHITALLVADGDQLLGVVHMHDMLRAGVV

SEQ ID NO: 10614 - protein, 456 aa, Haemophilus somnus 129PT
MTKHYDYIAIGGGSGGIASINRAASYGKKCAIIEAKYLGGTCVNVGCVPKKVMFYGAQVAEAITKYAPDYGFDVTLNHFDFAKLVESRQAYIDRIHTSYNNVLAKNNVDVLNGFAKFFDAKTIEVSYANGEKELVTADHILIATGGRPSRPTIPGAEYGIDSDVFFALTELPKRIAVVGAGYIAVELAGVVNSLGAETHLFVRRQTPIRSFDPLIIETLVEVMKQDGIQLHTQAIPQEIIKNADNSLTIKLEDGRTQDVDCLIWAIGREPATDVINLASTGVETNERGFIKVDKYQNTNVEGIYAVGDIIEGGIELTPVAVAAGRRLSERLFNNKPDEHLDYHLVPTVVFSHPTIGTVGLTEPKAIEQYGAEAVKVYTSSFTPMYSAVTSHRQPCRMKLVCVGKEEKIVGLHAIGFGVDEMIQGFAVAIKMGATKADFDNTVAIHPTGSEEFVTMR

SEQ ID NO: 10615 - protein, 431 aa, Thermus thermophilus HB8
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 10616 - protein, 876 aa, Aspergillus nidulans FGSC A4
MKTDFKVSTSSKRTDGFANWLWGSSKLTKKQFSNLLGTVYRKGNLLFTPDGNCLISPVGNRVTVFDLVNNTSYTLPFAHRTNIHQLDLTPRGNILLSVDEHGRAILTNLLRRVQIYNFSFKGRVSALKFSPSGRHFAVGVGRRLQIWHTPETPTVGGDGEIDFAPFVLHRDLAGHFDEVQHIEWSSDSRFLLTASKDLTARVWSLDPEDGFEPTTLSGHRQGVRAAFFSADQESIYTVSRDCALFRWEYVSKKDPDTMEDVAEPRWRIVKKDFFQQPHATVKCAAFHAASNLLVVGFSNGLFGLYELPEFNTIHLLSISQSNIDVVSINKTGEWLAFGSSKFGQLLVWEWQSESYILKQQGHLDSMNALAYSPDGQRIVTAADDGKIKVWDVKSGFCLVTFTEHTSGVTACQFSKKGNVLFTSSLDGSVRAWDLIRYRNFRTFTAPSRLSFSSLAVDPSGEVICAGSPDSFDIHVWSVQTGQLLDQLSGHEGPVSALAFAADGNHLLTFWSVADAVQVAGIDGRRDISGGRKITDRTTAANAAGTKSFHCITYSADGSCILAAGNSKYICLYDVLTGSLVKKYTVSVNTSLDGTQEYLNSRDLTEAGARGLIDETGEASDHEERIDRSLPGAKRGDAGSRTTRPEVRVSCVDFSSTGRSFCAASTEGLLIYSLDTEFLFDPFDLDISITPASILSTVEGAKKAAATGDANNDDTYLKALVMAFRLNEAKLIRAVHEAIPPSDIAHVVRSVPTVYLPRLLRYVAHACEETPHLEFNLLWIESLFSSHGRYLKDNAGSLGPELRAVQRALDDINENIKRLSQKNVHNLNYLLAKPVLTGRKAPALPKAIDTLDAAATNGDATMSDAGTDAEGEWHGLE

SEQ ID NO: 10617 - protein, 355 aa, Symbiobacterium thermophilum IAM 14863
MGIFEQMAQYGHEQLVFCYDKSTGLRAIIAIHDTTLGPALGGLRMWPYEREEDAITDVLRLARGMTYKNSAMGLNLGGGKAVLWGDPHTDKSEELFRAFGKFVETLGGRYITAEDVGTTVEDMNYVLMETDHACGRAEVSGDPSPVTAYGVFMGIKACVKQVFGTEELKGKKIAVQGLGKVGYHLCRYLHEAGAELIVTDIDPEAVERAKQEFGAKAVAPDEIYTAECDIFAPCALGAILNDDTIPGLKCRIVAGAANNQLKEPRHGNMLRERGILYAPDFVINGGGVINVAEEYHPQGYSRERALKRVETIYDKLLRVFQIAEQRNISTAEAADVMAEERMHRIHQLNRIYLAE

SEQ ID NO: 10618 - protein, 1320 aa, Escherichia coli O157:H7 EDL933
  misc_feature (174)..(174): Xaa can be any naturally occurring amino acid
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLXIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSTVSERIQLAKAENITAQPFDAVIFHGDSDQLRALCEAVAARDGAIVSVQGFARGESNILLERLYIERSLSVNTAAAGGNASLMTIG

SEQ ID NO: 10619 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVDEGASA

SEQ ID NO: 10620 - protein, 448 aa, Leuconostoc mesenteroides subsp. mesenteroides ATCC 8293
MARKTFTKEEIKQIVADENVEFIRVTFTDVLGAIKNVEVPTSQLDKVLDNDLMFDGSSIEGFVRINESDMYLYPDLSTFMIFPWATDGHGGKVARLIADIYTADREPFAGDPRHALRTVLTEAREAGFTSFNVGTEPEFFLFKLDEKGNPTTELNDKGGYFDLAPLDMGENVRREIVLTLEKMGFEIEAAHHEVAEGQHEVDFKYASALEAADNIQTFKLVVKTIARKNGYFATFMPKPVAGINGSGMHTNMSLFTKEGNAFEDVSDEMGLSKAAYNFLGGVLEHATAFTALANPTVNSYKRLTPGFEAPVYVAWSASNRSPMVRVPASRGQSTRLELRSVDPTANPYTSLAAILASGLDGIKRELEPLASVDKNIYLMDEIERERAGITDLPDTLLAAVRELAADDVVRAAIGEHIADKFIEAKKIEYTSYRQYVSQWETDSYLEKY

SEQ ID NO: 10621 - protein, 233 aa, Glycine max
MAITTISNSSQNWDGVAAGGVKPKRSNSRGVRIVGSRIYDSANGKTCHQCRQKTRDFAVSCKNMKNGKPCPINFCHKCLLNRYGENAEEVQQLGDWTCPKCRNFCNCSFCRKKRGELPTGQLFHTAKASGFKSVSEMLVSKTAESNDLELNKVNKVLLSKETTKEKKQKCVNNLSSGKVPVSTAVSPMKQIASEKELVVVLSGEIGKENSSDGKLDPVTSQKTSTKKKKKKKK

SEQ ID NO: 10622 - protein, 481 aa, Sinorhizobium meliloti
MATPLCQPAASHFIDGTFIEDRTGPEILSVNPVDGEIIAKLHGATSCIIEKAIASAKRAQKEWARKEPAERGRVLSRAADIMRARNRELSVLETRDTGKPISETLVADAASGADCLEYFGAIAATLSGDSIQFGEDWVYTRREPLGVCLGIGAWNYPIQIAAWKAAPALACGNAMIFKPSEVTPLSALKLAEILTEAGLPPGVFNIVQGAGDVGAELATHPAIAKVSLTGSVKTGARVASAAMAGIRPVTMELGGKSALIVFDDADVEAAVSGAILGNFYSAGQICSNGTRVFLQRGIREAFLARLLARVAALKIGDPMDEETDIGPLVSAAHRNRVATYVARAEVEGAYQMAPPRKLPPGDAWHEPVVFTNVTDWMTLAREEVFGPVMAVLDFDDEQDVVARANATDFGLAAGIFTRDLVRAHRLAAELEAGTVWINAYNLTPAGMAFGGIKRSGIGRENGRVAIDHYTQLKSVFVSMQT

SEQ ID NO: 10623 - protein, 514 aa, Hypocrea jecorina
MYRIWNIYVLAAFGTIGGMIFGFEISSMSAWIGSEQYLEYFNHPDSTEQGGITAAMSAGSLVGSLLAGWLADRLGRRLAIQIASVDWIVGAVLQCSSQNVAHLVVGRIVSGLAIGITSSQCIVYLSELAPSRIRGRVVGIQQWSIDWGILIMYLISYGCSVSIHRPAAFRIAWGLQAVPGAVLFFSLFFFPESPRWLATKDRWEECHEVLANLHAKGDRNNIEVLAELEEVREAARIAAESKEIGYLGLFAPKMWKRTLVGVSAQIWQQLLGGNVMLYYLVYIFNMAGMSGNTALTSSIIQYVIFLVTTGGVLFVVDRIGRRWLLIVGAIICGVIHFIVGAVMAVYGHHVDSVDGNDILRWQIGGPPAKAIIALCYIFVGVYGVTWAHGAWIYCGEVFPLKYRAKGVGLAAAGNWAFNLALAFFVPPAFTNIQWKAYMIFGTFCIAMVFHIYFMYPETVKKSLEEIDVLFEGDIPAWRSASAVSTFDEKVARAKEAGGLEEFSKQADIKHEEKV

SEQ ID NO: 10624 - protein, 206 aa, Zea mays
SVGEMIAAVNRVPAGWGEDEMSVLPRHTKVVVTGNNRTKSVLVGLHGVVKKAVGLGGWHWLVLTNGIEVKLQRNALSVIEPPTGNEDDDKFDCENLRWNSSDLVSDDAQSPKPQRSRSRQHRGFHRKSFSRSMSCDSQSKTSVSSSSRAHTKVDLSKLELTALLRYWRHFNLDACPNPSREQLVDAVQRHFTAQAAKRLKTTMKVA

SEQ ID NO: 10625 - protein, 156 aa, Haemophilus influenzae
NRSNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDENEVAKHFAALSTNAKDVEKFGIDTN

SEQ ID NO: 10626 - protein, 309 aa, Coccidioides immitis RS
MADPRETWQRLQTALQQRGRGAGFGGFPGGRPGRAFGGIGALVALGLGGYVISNSLFNVDGGHRAIKYTRIGGVKKEIYNEGTHLRIPWFETPIIYDVRAKPRNVASLTGTKDLQMVNITCRVLSRPRVDALPQIYRTLGTDFDERVLPSIVNEVLKSVVAQFNASQLITQRENVARLVRDNLARRAARFNILLDDVSLTHLAFSPEFTAAVEAKQVAQQEAQRAAFLVDKARQEKQATIVRAQGEARSAQLIGEAIKKSRSYVELRKIENARNIAQILQEAGGRNKLYLDTEGLGLNVNAGADGADKS

SEQ ID NO: 10627 - protein, 445 aa, Oryza sativa (japonica cultivar-group)
MSKAMQCFGFAGWERDERRGRSSAVASAAAATTRSLSARSNSSTSTDRDARRSGSECSLNVSSEISAESFGRYRQLSLPQRASNNLRIFTFQELKSATRGFSRSLVLGEGGFGCVYRGTIRSVLEPRRSVEVAIKQLGRKGLQGHKEWVTEVNVLGVVDHPNLVKLIGYCAEDDERGMQLLLVYEFMPNGSLADHLSSRSPRPASWAMRLRVALDTARGLKYLHEESEIKIIFRDLKPSNILIDENWNAKLSDFGLARLVSQDGSHVSTAVVGTIGYAAPEYIHTGRLSSKNDIWSYGVVLYELLTGRRPLDRNRPRGEQNLIEWVKPYSTDSKKLEIIMDPRLEGSYSLKSAAKLASVANKCLVRHARHRPKMSEVLEMVQKIVDSTDLGTPEHPLISKSRELTRDEKKRKGLDLKRRFADIKAGGDQRWFTWQRWRPKLVRTQ

SEQ ID NO: 10628 - protein, 352 aa, Glycine max
  misc_feature (287)..(287): Xaa can be any naturally occurring amino acid
MSEQVSLKLMENKESDNVIFAEAGQDFVGVATMPGQVSLKLVVNKETNKVVFAEAGKDFVDVLLSFLTFPLGTIARLVQKDSDVGPVQVGCLSSLYESVANLEKECLWTEACKEMLLQPRNSSEDYCRSLKLNIDDTEPTKHFMCTSNLDCAYSQLSTYPNGRCACGFAMTTLVFVDDKVYKGFVNGGATFIVTDDLVVLPNTMYTGLSFFQSCGVKCLSSVQTITLTVTKKKVLDLLKCSLLSKSTLTDLFLVKKPFLENSSFSPAVVENSSTIQIKIKLVMRKSXKILFAEGEEDFADFLLSFLTLPLGGVVRMLGGYSSMGSVDGLYKSIADLNENKYLISEKVKNRLC

SEQ ID NO: 10629 - protein, 307 aa, Coccidioides immitis RS
MAPERTGKSVFLGNIPYTLTEEQVKDILSSAGTVTKFRLMINPETGKPKGYGFADFADADAAASAVRNLNDYEIMGRKIRVDWPHNNEKDSVPLDYSQQGQASAAGQDGQPGYQGQAPLLPSLPPGTDLPPNLTCPNAISQTLSTLPAPQLLDVLSQMKSLVMADPARATELLRQAPQLAYAIFQALLLMNLVDYGTLGAVVEQATQPQPPAPQAQPASHIPPQFQPYPPIPGQVSTPPIHSTPFAPPPPPQPQPQTQPPLQAQIPGQEELLQQVLSMPQATIDALPPAERSQIMLLRQQLLQGGMR

SEQ ID NO: 10630 - protein, 116 aa, Triticum aestivum
  misc_feature (9)..(9): Xaa can be any naturally occurring amino acid
HASAVPHWXGKNRNFAFDGAITKYAKTGEFLKVKERYDPDGIFSSEWSDQVLGIKGSPNIVQKGCAMEGYCICSDESHCAPEQGYFCRPGKVYAEARICSLQPASGHTHTNHQDEL

SEQ ID NO: 10631 - protein, 119 aa, Lewia infectoria
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTKLCAIHAKRVTIQSKDIQLAR

SEQ ID NO: 10632 - protein, 323 aa, Nostoc sp. PCC 7120
MTPATSLFTPVEADLRILADNLKQLVGNRHPILFAAAEHLFGAGGKRIRPAIVLLISRATMLDQGITPRHRRLAEITEMIHTASLVHDDVVDESEVRRGVPTVHSLFGNRIAILAGDFLFAQSSWYLANLDNLQVVKLLSEVIMDLATGEIQQGLNRFDASISIETYIEKSYYKTASLVANSSKAAGLLSEVSPETAEHLYAYGRHLGIAFQIVDDILDFTSTTDTLGKPVGSDLKSGNLTAPVLFALAEKPYLEVLIEREFAQEGDLEQALELIQDSQGIQQSRELAAHHTKLAIEHLATLPPSESHQALIKIAEYAISRLY

SEQ ID NO: 10633 - protein, 141 aa, Yersinia pestis KIM
MISLSALRKSGVKMLRAIKTKLAPAAIGPYVQGVDLGSMIMTSGQIPIDPKTGLVADDIAAQARQSLENVKAIVEAAGLKVADIVKTTVFVKDLNDFSIVNATYEAFFTEHSAPFPARSCVEVARLPKDVKIEIEAIAVRR

SEQ ID NO: 10634 - protein, 521 aa, Frankia sp. CcI3
MRLLPGRKDSHQMGRYFVTTAIPYVNGKPHVGHALELIETDAYARHLRQRGHEVRFQTGTDDNALKNVQAAEAEGITPAEYVERVATGFVGLRGPLGLSFDDFIKTSTDPRHRPGVEKLWSACADRGDFYRKTYAGLYCVGCELFYQPDELVDGRCPEHGTVPDLVEESNWFFRLGRYQDQLHALISTDRLRIEPAARKREVLSFIEAGLEDFSASRSMSRARGWGIPVPGDPEQVIYVWFDALGNYITAPGYGNDDDSFQYWWNDADRRVHVIGKGIIRFHAVYWPAMLLSAGVRLPDTIFVHEYLTADSMKISKSAGNAEDPADIVAAFNTDALRWWMLRDVARAGDTDYTTERLVTRANEDLANNIGNLVNRTVSMVKRYRDGLIPPLALDNPAAAKLRAVRDETPRTIDDAFAAFDFRRAAEVITRIGDEGNRYVEAARPWELAKAERKEGASRDALDAVLAELVATCRELAEHLAPFLPDSAPRIAAQCGDGGSRVAGPSPVFPRLEAPPAEPATT

SEQ ID NO: 10635 - protein, 378 aa, Oryza sativa (japonica cultivar-group)
MASNDDTNGNWDTKVDAKVPSAFLPPPPGFPPLPVPALADEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDAREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQDISSCVLTVLNTQPRRGRTADGGCSSAGARRRRPVADQLRLPGYQLPSAAAAAAIFIGRCSLNGAACWS

SEQ ID NO: 10636 - protein, 471 aa, Oryza sativa (japonica cultivar-group)
MVLGAGLRCPASVPWSSLAYGLLGLVLLWQGGRLLHRLWWRPRRLELALRAQGLRGTRYRFLTGDLGEHGRLNREAWARPLPLRCHDIAPRVAPFLHSSVREHGKACFSWFGPIPKVTIANPDLAKDVLSNKFGHLEKHKFQGLTKLLSDGVASHEGEKWVKHRRILNPAFHLEKLKTLQRMLPAFSTCCEELISRWMESLGSEGSYEVDVWPEMQSLTGDVISRTAFGSSYLEGRRIFQLQAEQAERLLKCVQKIIIPGYMSLPTKNNRKMHQIKKEIDSILRGLIGKRMQAMREGESTKDDLLGLLLESNMRHTAEHGQSSQGLTIEEVTMILYEVLRLYPPAVTLTRQTYKQIEIGGVTYPAGVIIELPLLLIHSDPDIWGSDVHKFNPERFAEGISKASKDPGAFLPFSWGPRICIGQNFALLETKMALCMILQHLELELALSYTHAPQSIITLRPTHGAQIKLRAI

SEQ ID NO: 10637 - protein, 681 aa, Oryza sativa (japonica cultivar-group)
MAAATPASGGGGGGYSCETAEQTREWMEAISAFLHLHRPLLEAHVVNFFKEHWPSSLRDFVLTAKSLVLPREQKSPRSLLPDLHVASINTVLAQGMNSKKKHEVGCLMQIETLAGLVHAITKSCGAKTVIDVGSGQGYLAQALSFEYQLPVVAIDASSHHASVTNTRAERIKKYYTAKCVGKQQLRVPRTVTCHVLSSDTLAAVTLEACQDDHAEHVPESKNFNESSPQIEKPNDSIPPLVLAGLHACGDLSVNMLRLFVSCEQVKALISIGCCYNLLSEECHEDTNTCPGFPMSKAAKLSNLVLRKSTRDLGCQTFYFGGGPYLKSAERWRSLTKDIALQNFDIHAFRAAFQMFLEKHFPEVSRSSPSIGRQGKALRRQRLRKVMESPMAMAETDALSYSTQKEQIMTKDDPLPTGPNNFKEVHVDFLPELSTGFVDSAVSGAAVVPDDIYLDKSQKFTLFKDFTVSGLGRLGCDFVENVSLLEIWKDVQPFTEFIGPFWCLRVALGPLVETYILLDRICSQMAARTTVPVLPMMDQHQGGHSEPSRLFPSPNPYPDLYTRRCHAKPQAKSDGTGGNRRAVLGRAKEGEKWGEDCRRNISSRRGTGRDGDWGRVCVTVSGQLPPRLVCSTSYGGGVYWNVITSDSERISGGVPRRRRLDSWHKILHSLAWSSGVKMSAMG

SEQ ID NO: 10638 - protein, 450 aa, Glycine max
FIFFFTLTCFLQKKVRNMEEEGSARRIQVRFVTKLGEPYKVPTTAIAIPADLARFGLSSLVNALLQSNDADHQLEPFDFLIDGEFIRMSLEQFLLAKGISAERILEVEYTRAVAPRKEEDPSLHDDWVSAVDGSSSRFFLTGCYDGLGRVWKGAGLCTHILDGHSDAVTSVSIINPKGDSGAETVTVATASKDRTLRLWKLNTEDPVNHPMRVRAYKILRGHKSSVQSVAVQTSGEMVCSGSWDCTINLWQTNDFNAEDDQVSKKRKVGGQVEESQLEGEAFTTLVGHTQCVSSVVWPQRELIYSASWDHSIRKWDVEIGKNLTDIFCGKVLNCLDIGGEGSALIAAGGSDPVLRIWDPRKPGTSAPVFQFASHTSWVSACKWHDQSWFHLLSASYDGKVMLWDLRTAWPLSVIESHSDKVLSADWWKSDSVISGGADSKLCISSEIPVQ

SEQ ID NO: 10639 - protein, 558 aa, Oryza sativa (japonica cultivar-group)
MQRLRRREAAREARAAAAASAAAAERRNPLFPSPSPAGLRRRVLRIGPHTWHPSDGQGSASGAQGHELRDGCSSTVGSGASKPRRADLTDEMWPVGLCSVRGDPNEHYDPHGDLYLRPFLQLDSVHQFYSLVFARKASSAMGASTSTKRPLTSKVTNEGENDRVKYASSAMQGLRMSMQDALAVELDLDALKSTSFFGVYDGHGGAEVAMYCAKRFHVMLREEESFLNNLSYAITSVCSRLDDELEAPNVWRASLYPHRSSESSSESSDCFQFLSTGSCANVWRSSEAVSYKLPSYEGSTACVVIIRGNQITVGNVGDSRCVLSKNGDFAYKNIVYRPQYQMVTHFPDIRVAKITGDTEFLVIASDGIWDHMSSQDVVDFVHEKLNSRRQELCQSLINQGKKRECFTEDSQLATNKNIAPNTTTLGEETLHTTCEKLVENCLESRNNATAILVQFKPGADQPIPALPNIQEGSDEVAGGADQPIPVLPNIQQVSDEVAGGTGQPIPVLPDIQEGSDEVAGGAAVAEQHQHNPEGGGEQQLDLDDALDGEALALLFGQP

SEQ ID NO: 10640 - protein, 295 aa, Bacillus clausii KSM-K16
MEKVVGTDRVKQGMAQMQKGGVIMDVINAEQAKIAEEAGAVAVMALERVPSDIRAAGGVARMADPTVTEEVLNAVSIPVMAKARIGHIVEAKVLEAMGVDYIDESEVLTPADEVYHLNKRDFTVPFVCGARDLGEAARRIGEGASMIRTKGEPGTGNIVEAVRHMRKMQAQIKQVAHMSTDELMTEAKQLGAPYELLLHIKETGQLPVVNFAAGGIATPADAALMMHLGADGVFVGSGIFKSDNPEKFARAIVEATTHYTDYERIAELSKNLGSAMKGIDVATLAPAERMQDRGW

SEQ ID NO: 10641 - protein, 622 aa, Debaryomyces hansenii CBS767
MSEQQGSDNRHHHHHHHHNNHHGDHSGQHDGHNNKVHQPQPIDPKANPANRIGKYQVLKTLGEGSFGKVKLAQHTTTGQKVALKIINRKTLAKSDMQGRVEREISYLRLLRHPHIIKLYDVIKSKDEIIMVIEYAGKELFDYIVQRGKMPEDEARRFFQQIIAAVEYCHRHKIVHRDLKPENLLLDEQLNVKIADFGLSNIMTDGNFLKTSCGSPNYAAPEVISGKLYAGPEVDVWSSGVILYVMLCGRLPFDDEFIPALFKKISNGVYTLPNYLSQGAKDILTRMLVVNPLNRITIHEIIEDEWFKQNIEEYLLPPDLSKTKHKKIEVDEDVITALQSTMGYDRDEIVNVINKCNQHNAPQQQSNEIIDAYLLMRENRTLVKDLKNSKLNNMDTFLSQSPPPSWTNNANNNSNMNINVNHSTKAPGVQQSLTYQTLAAVPDLSTLPNSTIAILPSSLPSIHRAYMMESNMDTQLKIAPVSHKKLKTRWHFGIRSRSYPLDVMGEIYRALKNLGAEWSKPTEEELWTIRVRWKYGPCILPNEKSQEEQQKDIPDMMKMQIQLFQLEPNNYLVDFKFDGWENSSNKDVSIKQDVDEMSSFSAYPFLHLATRLIMELAVNSQTN

SEQ ID NO: 10642 - protein, 377 aa, Glycine max
MADAEDIQPLVCDNGTGMVKAGFAGDDAPRAVFPSIVGRPRLTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDFLMKILTERGYSFTTSAEREIVRDMKEKLAYIALDYEQELETSKTSSSVEKSYELPDGQVITIGAERFRCPEVLYQPSMVGMEASGIHETTYNSIMKCDVDIRKDLYGNIVLSGGTTMFPGIADRMSKEISALAPSSMKIKVVAPPERKYSVWIGGSILASLSTFQQMWIAKAEYDESGPSIVHRKCF

SEQ ID NO: 10643 - protein, 604 aa, Desulfotalea psychrophila LSv54
MLLLAGAFRAWAMMLVSIGIIIKILLEKRMGERIVIIGGVAAGPKAACRIKRLSPRAEVVVIDQDALISYGGCGIPYYVSGDVADEKELRSTSFHMLRDEFFFDKAKRVTAMTSTRAISIDRAEKTVLLQDVKTGAEETVSYDKLLLATGSQPFILPIPGVDLDGVFTVTDMHKAIEIKARIAKGQVGKAVVIGGGAIGIEMAEALKDLWGVETSLVEFQKQLLPNILDWPMAAMLAQHMDDKDVHLYLGESAAEIVAGDADHVAGVRLSSGKTLDCDMVIMATGVRPRSELAKEAGLHVSSKGGIVVNERMQTSDPTIYAAGDCVEIPHLVSGRSFYAPLGSLANKEGRVAADNIVGIPTIFKGAIGSFILKAFDFSAASTGLSLESALAEGFDADVSLTSSSDRAHFFPTQQVLCLQLVFDRRTRRVLGLQGIGGASDALLARIDAAAVAITAGATVDDFGNIEMAYAPPFSTAIDAINAAGYVAENLIDGRMRQMRLELFYAWMENVTSQPDWLVLDVRHPKQAKPFMEKYGDLWLNLPYEQVRDRYAELPTDKTLVIFCNAGSRSFEIQRLLDSVGLENNIVLAGGYNFIKRMGADWLPV

SEQ ID NO: 10644 - protein, 362 aa, Streptomyces avermitilis MA-4680
MTTPTIELKPSASPLSDAEREAILASPGFGRHFTDHMVTIKWTEGRGWHDGQLVPYAPLSLDPATMVLHYAQEIFEGLKAYRQPDGSVASFRPDMNAKRFQASARRLGMPELPVETFIEACDVLVQQDASWVPAHGGEESLYLRPFMIATEVGLGVKPANEYLFLVIASPAGAYFPGGVKPVSIWLSEDRVRAVPGGMGDAKTGGNYAASLLAQAEAAEKGCAQVAYLDAVEHKWVEELGGMNLYFVYGNKIITPALTGSLLAGVTRDSLLSVARDLGYESEEGRVSIDQWQADTENGTLTEVFACGTAAVITPVGTVKRSSAEWQHSGGEPGEVTLKLREALLDIQRGIGEDKHGWMHPLG

SEQ ID NO: 10645 - protein, 378 aa, Leuconostoc mesenteroides subsp. mesenteroides ATCC 8293
MADITATNKQVLDFNHQLTAQADSFPTLSVLDNTGKIVDDEAFERAELSNEDLINIIKRMILSRQLDIRSTKLAKQGRFGFFAPTAGQEASQMASSYAFNDDDWLMPGYRDIPQIVVKGWPIWKAILWSRGHVLGNVYTTEDDKPVNSWMPQIIIGAQYVEAAGIALGLKKRGKNAVVYAYTGDGGTSQGDFYEGINFAGAYNANAVFFVQNNGYAISTPRALQTAAPHLAAKGWAAGLPSLVVDGNDPIAVYLASKEARAWAANGNGPVLIETITNRLEAHSTAGDDPLRYRTKDDIGEWWKKEPLIRMRKLLQGQGIWNEEQEDDYVKEVNQLIDDQIKIADSVEKQKISNFIKNTLEVPSQAMKEQIAKFESEGK

SEQ ID NO: 10646 - protein, 387 aa, Zea mays
MIPSVRLSPGPAAFSGSSLRSKLPSIPSISSLKPSKYVVSSLKPLYLAPLDGPRTAELKSRRQPLEFRCSASAADDKESKTQVVPVQSEGAQRLKISIYFATWWALNVIFNIYNKKVLNAFPYPWLTSTLSLACGSAMMLFSWATGLVEAPKTDLDFWKVLFPVAVAHTIGHVAATVSMSKVAVSFTHIIKSAEPAFSVLVSRFFLGETFPIPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWIAAQSVFYHLYNQVSYMSLDQISPLTFSIGNTMKRISVIVSSIIIFHTPVRAVNALGAAIAILGTFLYSQAKV

SEQ ID NO: 10647 - protein, 1131 aa, Zea mays
MSSLRPAQSSSSSSRTRQSSQARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMQALCNTVVKEVFDLTGYDRVMAYKFHEDEHGEVFAEITKPGIEPYLGLHYPATDIPQAARFLFMKNKVRMICDCRARSVKIIEDEALSIDISLCGSTLRAPHSCHLQYMENMNSIASLVMAVVVNENEDDDEPESEQPPQQQKRKKLWGLIVCHHESPRYVPFPLRYACEFLAQVFAVHVNKEFELEKQIREKSILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDEDDSRRMHPRLSFKAFLEVVKMKSLPWSDYEMDAIHSLQLILRGTLNDALKPAQSSGLDNQIGDLKLDGLAELQAVTSEMVRLMETATVPILAVDGNGLVNGWNQKVADLSGLRVDEAIGRHILTLVEDSSVPIVQRMLYLALQGREEKEVRFELKTHGSKRDDGPVILVVNACASRDMHDHVVGVCFVAQDMTVHKLVMDKFTRVEGDYRAIIHNPNPLIPPIFGADQFGWCSEWNAAMTKLTGWHRDEVIDRMLLGEVFDSSNASCLLKSKDAFVRLCIIINSALAGEEAEKAPIGFFDRDGKYIECLLSVNRKVNADGVVTGVFCFIHVPSDDLQHALHVQQASEQTALRRLKAFSYMRHAIDKPLSGMLYSRETLKGTDLDEEQMRQVRVADNCHRQLNKILADLDQDNITDKSSCLDLDMAEFVLQDVVVSAVSQVLIGCQGKGIRVACNLPERSMKQKVYGDGIRLQQILSDFLFVSVKFSPAGGSVDISSKLTKNSIGENLHLIDFELRIKHQGAGVPAEILSQMYGEDNREQSEEGLSLLVSRNLLRLMNGDIRHLREAGMSTFILTAELAAAPSAAGH

SEQ ID NO: 10648 - protein, 484 aa, Glycine max
MSTQNRRSSFSSSTTSSLAKRHASASTTSSLAAAPTNMAKKRPPLSNLTNTVAHRNSSSSVPCAAKFAKTKKDVVPACSGNKRPTLANVKPASAVIFPKANSFPVKNEAPPTPPPPVATVTVPAPVVDVSPSKSDTMSVSTDESMSSCDSFKSPDIEYVDNSDVAAVDSIERKTFSHLNISDSTEGNICSREILVELEKGDKFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKYKYVAKKYCPPSIPPEFFQN

SEQ ID NO: 10649 - protein, 569 aa, Propionibacterium acnes KPA171202
MIGAMTMKSDLEIAREAHLDPIEKVAARAGIDEKYLEPYGRGVAKVDLDVVTHNRDHSCGKYVVVTAMTPTPLGEGKTTTAVGLAQGLEKIGKHSVLALRQPSMGPTFGIKGGAAGAGYSQVLPMEKLNLHLTGDFHAIGAAHNLLAAMIDNHLHQGNELDIEPHSISWRRVVDINDRALRNTIVGLGSRVDGVPRETGFDITAASEVGVILSLATSLSDLRARLGRIVIGYNRSKEPVSAEDLHAAGSMAVILKDALKPNLLQTTENSPVLVHAGPFGNIATGNSSVIADRVGIGCGDYLLTEAGFGADMGAERFFNIKCRIGGMRPDAAVLVATVRALKTHAGRYKVIPGKPLPPAMLEDNPDDVLAGAANLRKHIEIVREFGVSPIVALNVFPTDHPDEIDAVRKVAEAAGAHFASSTHVVDGGDGAVDLAHAVVAACDHKADFRYTYDLEDSLVEKLTKVATKVYGADGIDIAPAAAKELAHFEDLGYGTFPVVIAKTHLSLSHDPSLKGAPTGWRLPVREVRAAVGAGYIYAICGDMRTMPGLGRHPAAERIDIDDNGETIGLF

SEQ ID NO: 10650 - protein, 377 aa, Yersinia pestis KIM
MPAQNPLQHQRQHDGIYHIGYFVGGKWSQAQEQFDVYNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGIAMRWAVISSSQR

SEQ ID NO: 10651 - protein, 310 aa, Oryza sativa (japonica cultivar-group)
MADELDELLGFLSSPQPNVRGAAAGIVRGLTGDADGLRALSARADRALPALLRLLASAGGELGTGGAAADSLVNLSQDGALSARLVSLGAVVAAMDVVAKRGGEQPGLARSLVMLLANLTQVDSGVAALLQVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQYSMQREKMIFANLPPPNTVLF

SEQ ID NO: 10652 - protein, 116 aa, Haemophilus somnus 129PT
MAEETIFSKIIRKEIPANIVYQDELVTAFRDISPQAPTHILIIPNKIIPTVNDVTSEDEVTLGRLFTVAAKLAEKEGIAQDGYRLIVNCNKHGGQEVYHLHMHLVGGEHLGKMLAK

SEQ ID NO: 10653 - protein, 244 aa, Streptococcus pyogenes MGAS8232
MEIKGKNIFITGSTRGIGLAMAHQFASLGANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 10654 - protein, 714 aa, Mycobacterium sp. JLS
MAAAPRPNVTPEVWPGKAYPLGATYDGFGTNFALFSEAAERVELCLFDADGEQTACVTLPEVDGFVWHGFIPNIEPGQRYGYRVHGPYDPPNGQRCNPNKLLLDPYAKAIDGTFDWGQPLFSYNFGDPDSRNDDDSADCMPKSVVINPYFDWGTDRPPNHEYADTVIYEAHVKGLTQTHPDIPEQIRGTYSAVAHPVIIDHLKSLGVNAIELMPVHHFANDSTLLDKGLSNYWGYNTIGFLAPDPKYSSSLTPGGQVQEFKAMVRTLHEAGIEVILDVVYNHTAEGNHMGPTLSFRGIDNAAYYRLVDDDKRYYMDYTGTGNSLNAGHPHALQLIMDSLRYWVTEMHVDGFRFDLASTLAREFYDVDRLATFFELVQQDPTVSQVKLIAEPWDVGPGGYQVGNFPPQWTEWNGKYRDTVRDYWRGESATLDEFASRLTGSSDLYEHTSRRPVASINFVIAHDGFTLRDLVSYNEKHNEDNGEDNNDGESHNRSWNCGVEGPTDDPQVNALRSRQQRNFLTTLLLSQGVPMIAHGDELGRTQHGNNNVYCQDNELSWIDWSTVDTELMAFTQKVSELRAAHPVFRRRRFFSGRPVRQRGAPGLPDIAWFAPDGSEMTDEDWDSGFAKSIAVYLNGQGIPDLDVRGQRVTDDSFLLCFNAHHEPLEFAMPAAEFARAWLPVINTADDDDARESVTAGAKIEVAERSVLVLQAVNEP

SEQ ID NO: 10655 - protein, 647 aa, Oryza sativa (japonica cultivar-group)
MALKESLDPAGRVLGSWARSGEPCGGSFVGVTCDSGGRVTAISLQGRGLSGTLPPAIAGLRRLTGLYLHYNGIKGAIPREIGSLSELTDLYLDVNHLTGPLPVEIAAMENLQVLQLGYNQLTGSIPPQLGKLNKLAVLALQSNQLTGAIPATLGDLTQLARLDLSFNSLFGSIPSKIAEVPLLEVFDVRNNSLSGSVPAGLRRLNGGFQYVNNKGLCGVGFSLLDLCLSSEDGLKPSKPEPFGPDGTVKTRQVPQSANTDNHCEGSGCSKSSNASVGVLVVGVVAVVIGAAFCGIFAFSYYRRQKQKIGSSLEVSDSRLSTDHYQQKEVCRRSASPLISVEYSNGWDPLSGGGVGSSGEVGDSFRFNLEEVECATQYFSEVNLLGKSGFAATYKGILRDGSVVAVKSLNKTSCKQEESDFLRGLKMLTVLRHENLVGLRGFCCSRGRGECFLVYDYMVNGCLSQYLDVKEGSGANVLDWPTRVSIIRGIAKGVEYMHSKKANKPSVVHQNISAEKILLDHHLTPRLSVPGLHKLLADDVVFSTLKASAAMGYLAPEYATTGRFTEKSDVFAFGIVVLQVITGRRAVSQLKVSTVANDLDSLIDENLNGVFSRTEAAKLAAIAALCTSETASQRPTMEAVVQQLSNCH

SEQ ID NO: 10656 - protein, 474 aa, Aspergillus oryzae
MASSLRIGTSVLRSTSLAGKPVVQSVAFNGLRCYSTGKAKSLKETFADNLPGEIEKVKKLRKDYGNKVIGEVTLDQAYGGARGVKCLVWEGSVLDSEEGIRFRGYTIPECQKLLPKAPGGEEPLPEGLFWLLLTGEIPSEQQVRDLSAEWAARSDLPKFIEELIDRCPSTLHPMAQFSLAVTALEHESAFAKAYAKGINKKDYWNYTFEDSMDLIAKLPTIAAKIYRNVFKDGKVAPIQKDKDYSYNLANQLGFGNNNDFVELMRLYLTIHSDHEGGNVSAHTTHLVGSALSSPMLSLSAGLNGLAGPLHGLANQEVLNWLTKMKAAIGNDLSDQAIKDYLWSTLNAGQVVPGYGHAVLRKTDPRYVSQREFALRKLPDDQMFNLVSQVYKIAPGVLTEHGKTKNPFPNVDAHSGVLLQYYGLTEANYYTVLFGVSRALGVLPQLIIDRALGAPIERPKSFSTEAYAKLVGAKL

SEQ ID NO: 10657 - protein, 1400 aa, Oryza sativa (indica cultivar-group)
MAWFWRMSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHRKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEMNPKGKRSSNCYFYLQLPETKDTCVISKFQCVISSVKSCPTCFIFNMPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRDPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 10658 - protein, 347 aa, Streptomyces avermitilis MA-4680
MARSINLAVIPGDGIGQEVVAQGLKVLSAALPSDVKLETKEFDFGARRYHATGETLTDADLDALKQHDAILLGAIGDPSVPSGVLERGFLLKLRFAFDHHVNLRPSKLLPGVETPLAGQPEIDFVVVREGTEGPYTGNGGTIRTGTPHAVATEVSLNTAFGIERVVRDAYARAQARPRKKLALVHKNNVLVHAGHLWTDIFNKVGEEFPDVTTEYMHVDAATIYLVTQPERFDVIVTDNLFGDIITDLAAAISGGIGVAASGNINPSGAYPSMFEPVHGSAPDIAGQGKADPSATILSVALLLRHLGYEAEAARIEEAVSADLAERVGKPARSTDEIGDALTVRVAG

SEQ ID NO: 10659 - protein, 393 aa, Oryza sativa
MFPTAGGRRLLVLIRRASAAAAAGANPNHHHHHATLFTHRYSSSPLARTPEAESAAAASYLVASVGLSPAAAARISRKARFRSNADAEAVVSLLRGHGFSDANIAQVLPKIPGLLILNPDKILRPKLEYFASLGVVPSALSRAPLLARSQEKHLVPCVEFIRGVVGTDANLCAAISRNPWALWCDINSSMRPAVESLRRHGLAEANISRLVVINLSALTMSPDRIDGIFGDLEALELPISHSRFVYGFWALSRLKRGAWEERMSVFMRFGVSRSELLKAFREQPGILVFTAKTIQRKLSFYQEKLKVAPADVIAHPLLLTFSLEKNIIPKCAVLNVLLREGKIKRYGREMDLLRPLQRSNISFFERFVRKYEEDVPDVVKAYEGKIKFTGFMD

SEQ ID NO: 10660 - protein, 326 aa, Leuconostoc mesenteroides subsp. mesenteroides ATCC 8293
MAVKSYIDAIREAMDLALEKDDDVIIFGEDVGKNGGVFRATDGLQAKYGEDRVFNTPLAESGIGGMAIGLTTQDYRPIMEIQFFGFVFEVMDSIAGQMARNRFRFNGTRNMPIVVRSPYGGGTKTPEMHADNLEGMVAQIPGIRVVMPANPADAKGLLLSSIASNDPVVFLENLHLYRSLKGEVPEGYYTTPLDKAAIAREGDDVSIISYGGGVPVALKAAEELSKNGISAEVLDLRTVSPLDIQSIGETVAKTGRVVVVQEAQRMAGIGAAIMSEISERFILSLKAPIGRVAAPDSVYPFGQAENDWMIKSDDVVAKVVEVVNYD

SEQ ID NO: 10661 - protein, 316 aa, Schizosaccharomyces pombe 972h-
MSASHPGILHEYTERLVAFELVGKSNVTLTSNVTRSLLLFVGGLGDGLLTVPYVQELVNPLDEIGWSIVQVQTQSSYIGWGTGSLKRDDEDLHKAVDYFLHIGGADFSTRKIVLMGHSTGSQNVLYYLTQSILPNYLIAGIAQAPVSDREAAYQFNGKEKTKELVDWVKAEYLDKGLGNDVLPRSKVENFFGEVPTSANRCIDLTDVRGNDDFFSSDLSADDFAKTFGNLKEISGSTAHSQLILLMSERDEFVSPSTDKAQLLNRFRESIRPTTSNSSLSGIIPGATHNVGPKSSPEALKWLINQLITALRSFIDQ

SEQ ID NO: 10662 - protein, 431 aa, Leuconostoc mesenteroides subsp. mesenteroides ATCC 8293
MTEIFKMPDIGEGMAEGDITSWLVKVGDTIAADDPVAEVQNDKLMQEILSPYGGKVTKLFVDAGTTVEVGDPLIEFDGDGSSENDSDNGHVAQPSTSSNVVETEQSTPKNTAPKETSTVQVANGHVLAMPSVRHLAHEKNIDLTQVPATGRHGHVTLADVENFQGSDNSAPTQTQTSTTSQTESSAAVHEEPTPALPLREGRQPMAPVRKAIARAMDRQAAIPTVTNFDSVDVRKLVGHRKAFKEMARDDKGIRLTYLAYAVKALAAVAKKFPELNASVDMKAQEIVYHDDVNMGIAVDAPTGLFVPVIKNADRKSIFTIAQEITDLAEAVRDGSITPAQMQGGTITISNLGSARGTWFTPIINGKEVAILGLGSILKEPIVNDDGELAVGQNMKLSLTYDHRLIDGMLGQSALNYLKQLLSDPAYMLMEV

SEQ ID NO: 10663 - protein, 174 aa, Oryza sativa (indica cultivar-group)
MAKQGVKKTRDANKKRMDLILRLILAANVIYVVVRMAVMHSSFTWKHWIGLAVTSAAYFLPYKQLANMSEPEYSENGELINAGYDLNAGGMSEYLQDVIYITLFVQLMSIFSDKFWWTYLVIPAYGGYKISGLLRGAFFGGSSEGEEEDEKTRKKREKMEKKASRGKIIKTRTR

SEQ ID NO: 10664 - protein, 424 aa, Brassica napus
MATAFSATLPLHGSSQENRLLLPPTRLPPPPSSFLGSTRSLPIRRLNHAHAARRSPVVAVQEIVKEKKPTNTLLITKEEGLVLYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFTSKYKREVLKQDCDDVTVAFFGDGTCNNGQFYECLNMAALYKLPIIFVVENNLWAIGMSHLRSTSDPEIWKKGPAFGMPGVHVDGMDVLKVREVAKEAVTRARRGEGPTLVECETYRFRGHSLADPDELRDAAEKAKYAARDPITALKKYLVENKLANEGELKTIEKKIDELVEEAVEFADASPQPGRSQLLENVFADPKGFGIGPDGRYRCEDPKFTEGTAQV

SEQ ID NO: 10665 - protein, 469 aa, Leuconostoc mesenteroides subsp. mesenteroides ATCC 8293
MVVGAQAREIDTVVIGSGPGGYVAAIRAAELGQKVVIIERDNIGGVCLNIGCIPSKALINVGHRYREATEETPFGLLTSGATLDWQQTQDWKQNKVVHTLTSGVEMLLKKHHVEIVKGEAVFNDNETLNVLQEDGHELLQFNNAIIATGSRPIEIPTIPFGERIVDSTGALGFTEIPKRLIIVGGGVIGSEIGGAYANLGAQVTIIEGLDHTLNGFDAEMTKPVLDDFKAHGGTVVTSAMAKEATQTAKEVTLTYEADGKEQSITGDYLLVAVGRRANTDGLGLNNTDIKVDSKGLITTSDTMKTSVPHIYAIGDVVAGPQLAHKASFEGKIAAAAIAEDAQARDLHYSLPSVAYTQYELATTGETPESVKVNHLEAKISKFPFAGNGRAISMDQAVGFVRLISDKSSNALIGAQIVGPSASDLISELSLAIENGLTTKDISLTIHPHPTLGEAIMDAAELADGLPIHI

SEQ ID NO: 10666 - protein, 349 aa, Schizosaccharomyces pombe 972h-
MVSNNAVIIKKYLDSTAGYPVIGEHLAFEKREFDLENAQVDEETPVLLKNIYTSVDPYLRMRMQSPKHASYIPPLELGKPFYNSTVAKVVKSTLDQYKPGMDVVFVSGWEEYTFVSKQALGFLQPINNPYKLPLIDFVGSLGMPSQTAYCGLKHIGKPKAGETIYISAASGAVGQMAGQLAKAMGLHVVGSVGSDEKFKICLDSGYDSVFNYKKESPFKALPRLCPKGIDIYFENVGGETMDAVLENMNLQGRIIFCGAISQYNNPNPYRVKNLGMVLVKSLTIQGFIVANILPQYQEQYFEEMPKLIAEGKIKYKCDVYDGLESAPEAFIGMLQGKNSGKTIVKIADE

SEQ ID NO: 10667 - protein, 802 aa, Zea mays
  misc_feature (446)..(446): Xaa can be any naturally occurring amino acid
  misc_feature (591)..(591): Xaa can be any naturally occurring amino acid
LLLANAVRALNQDGVHLLEAKRALTVPPGALADWNPRDATPCAWTGVTCDDAGAVTAVSLPNLNLTGSFPAAALCRLPRLRSVDLNTNYIGPDLDPAPAALARCASLQRLDLSMNALVGPLPDALADLPDLLYLNLDSNNFSGPIPDSFARFRKLQSLSLVYNLLGGGVPPFLGAVATLLELNLSYNPFAPGPVPATLGGLSDLRVLWLAGCNLIGPIPPSLGRLANLTNLDLSTNGLTGPIPPEITGLASALQIELYNNSLTGPIPRGFGKPQELRAIDLAMNRLDGAIPEDLFHAPRLETVHLYSNKLTGPVPDSVARAPSLVELRLFANSLNGALPADLGKNAPLVCLDVSDNSISGEIPRGVCDRGELEELLMLDNHLSGHIPEGLARCRRLRRVRLSSNRIAGDVPDAVWGLPHMSLLELNDNQLTGEISPAIAGAANLDXLVLSNNRLTGSIPSEIGSVSNLYELSADGNMLSGPLPGSLGGLAELGRLVLRNNSLSGQLLRGIQIQSWKKLSELSLADNGFTGSIPPELGDLPVLNYLDLSGNELSGEVPMQLENLKLDQFNVSNNQLRGPETYRSSFLGNPGXFAWMMRSIFMFAAAILVAGVAWFYRRYRSFSKSKLRADRSKWTLTSFHKLSFSEYEILDCLDEDNVIGSGASGKVYKAVLSNGEVVAVKKLWSTAVKKEEGSASASAADNSFEAEVRTLGKIRHKNIVKLWCCCSCRDCKLLVYEYMANGSLGDVLHSSKAGLLDWATRYKVALDATEGLSYLHHDCVPAIVHRGEFCNQTTTEGRRPGRE

SEQ ID NO: 10668 - protein, 1396 aa, Schizosaccharomyces pombe 972h-
MSEQEKGKGDLDDPNSKNTKCPDKFEQKVEEYLEVLNELHLTGRTSGFCMRNFTVEGAFNPKFQIRSFFAQLLHPINIIFRTGPKRDIIPLVKGFDGYLQPGSSLLVLGHEGSGGSTLLKALCGIVEENERLNGSLHYDGLDYKIAHSQFKADLSYCGEGHSKVATITVRRLLEFVCSCRLPASKYDHPRSHYIRRICEIIRDAFDLGDFYNHRILRVFNSGDQIKVDVAQTMCARPLIQCWDNNMRDFDSISVIDILSRIKVLSHKLGTTLVAIVSQASDRIFHMFDMVTLMYEGEQIFYGPTSRLKPYFLDLGFIPAKHSTTVEFVTSLTYPEMRIINKKHQGFIPSTPAEFRECWLRSEDYAKLIKFMDRYEENHSDIHAFKDAKFDQTRLQKFLRWLNSNPCLIPYRLQVFATAKVTFFQYLHDYSYIATFVFTYVFQALMLGSLFYNLRNESSELYSRGSVLSNAIVFTAIQTMSEVDIIFLKKSLFKEHRVQSLYHPSAALMGSSLVEFPMRIVVVTMYDIIVYFLSDLKRNARSFFIFYLFTIVITFCMSAVFRFIALLSTTAEIAALIGGIGALVLIIFCGAVMPVQYIGWWFRWIAYANPVNYGYESIMLNEFDGREIPCSLMAPAPDTAPIENNFCLATAGRTGTSIVSGYQYLQVVYQYKADFLWRNCGIILGFAIFILASSLILANFIRYDRESVHIPEFQKRKSYSQVASSFLIEPQDKPPSQTEPDNKKVDVSTTLSTNDNLVLCWRDLNFTVVTKTSKKQILTNVSGYLKKNTLTALLGENKSGKSVLLRILSQRGIAGSVEGEITLSGLKNPKNLRKRIGYVRKNPLFISEYTVRETLRLHAALRQSKQRSLSEQYAYVEYVIDFLGLGEVADFIVGDMGKGLSLYHKRLLSIAVELSARPGSILLLDEPANGLDSQSAWMLVCILQKLARSGLSILCSVSQPSSRILELFDMMLILDLNGNTVYYDTMGRDLSKLVNYFKRIHGTNEHSKDTADFVLHCIQFLKQGPEFDYAGAWASTNTHKQIIEHVNFIMDNPELTDDDFPNETRFMTSFFFQIYKISMRNFVAYWRDSSLLRARVAFNIVAGLIIGFSFYKQGVGVEETQNKMFSAYMLTVASTSTMNGLQPKFIYFRSIYEQYEQNTAIYSRTAFIIAFFLVEAVINCCFATLFFFGWYYPSGFYEFNHNIPFYGGFAWLMLMIFTLYYTTLGIGIATISPSIGTASIISGTAFVFIQYFNGMIQLPGVIVGFWKWMDALSPYKYFLEGMIGGVLHDAPITCEKFEIHYVDPPPNYSCGEYFSSFLNSSGHGIVYNPEAYSSCQYCPYKNADELMVGFGYHYNHKWRNFCIMIGYTAFNLGAAIALYYIIHKTPWKRLAARFVPD

SEQ ID NO: 10669 - protein, 236 aa, Oryza sativa (japonica cultivar-group)
MRRRFQDSVKALEADIEHANELASEFLRDYDGAVIQMRMAYSAVAHFLVQWIDCKLAGALGLLKIMIYKVYADGTTALPEWEREASIRQFYGVIFPSLLQLPSGITELDDRKQRRLCLQKFRKVEERVSEVDLERELECGICLEVNAKIVLPDCAHSLCMRCFEDWNTKSKSCPFCRACLKKVNPSSLWLYTDDRDVVDMDTLTRENIRRLFMFISKLPLVVLHVVDLDIYEYRIK

SEQ ID NO: 10670 - protein, 508 aa, Oryza sativa
AVPPASTRTPRAARSSSPPPAACSVRWAVTASSSSPAAPSPPSSPRLARTHPLAPRPPPSPPWTPPPAAGELPADDRRRRGEAAGVLLLARDHDLCRFHADDPAGPDPGAQALQRRRGLPRLRRPLQLLPELRRRLRQAQPQPRHRHQRPRARPHGDAAPFAVDEYLVATCGLTRAQAAKASEKLSNLRSPSNPDAVLAFLSDLGLSRPDGIAAAVAADPRLLCADVGSSLARRVDELGGLGLSRSQIARLLPLAGRCFRSSSLATRLAFWHPVFGSFENILKALKMNAALLGSDLDKVAKPNLAFLAQCGINASDVTRTTLSLYSCRLFTVNPRFLQDAVARVEELGVARGWRTFHRVLSTVAFLSRETIASKMQLLDDLGFSQDDFLVIVRRAPQVLRLSDGRIRRSVEFLIRDVGLEQSYIAQRPTLLAYSLERRLLPRHCLLKVLKAKGLLNCDLSYYCIAAMSEEKFVQRFVDPFKDKIQGLADAYTSSCSGEANGVRSLVCL

SEQ ID NO: 10671 - protein, 980 aa, Rhodobacter sphaeroides 2.4.1
MCWPAPPRPSRRSSNGSPLLWQPGGYDRPPPPCRSLPHVCQNFVVRGCLMTISGGTFDPSICEMEPIATPGAIQPHGALMTARADSGRVAHASVNLGEILGLPAASVLGAPIGEVIGRVNEILLREARRSGSETPETIGSFRRSDGQLLHLHAFQSGDYMCLDIEPVRDEDGRLPPGARQSVIETFSSAMTQVELCELAVHGLQLVLGYDRVMAYRFGADGHGEVIAERRRQDLEPYLGLHYPASDIPQIARALYLRQRVGAIADACYRPVPLLGHPELDDGKPLDLTHSSLRSVSPVHLDYMQNMNTAASLTIGLADGDRLWGMLVCHNTTPRIAGPEWRAAAGMIGQVVSLLLSRLGEVENAAETLARQSTLSTLVERLSTGDTLAAAFVAADQLILDLVGASAAVVRLAGQELHFGRTPPVDAMQKVLDSLGRPSPLEVLSLDDVTLRHPELPELLAAGSGILLLPLTSGDGDLIAWFRPEHVQTITWGGNPAEHGTWNPATQRMRPRASFDAWKETVTGRSLPWTSAERNCARELGEAIAAEMAQRTRAELARLRHYDPLTGLANRSYLQERLAQDGQSAAALLFIDLDRFKAVNDSMGHGVGDGLLIEVARSLVATVRPHDLVVRLGGDEFVVLCHRLDAAGIVSLAERLRQVLEQPFEVAGRKCHISASIGIAMADSIGDLDLVRAADIAMYAAKKNGGNRGELFRPSLYEETTQLVELDNDMRGAIESEQFHLVYQPIFALNPETERLVGFEALLRWDHPLHGALQPGIFIPLAERLGHIHAMGNWVLRRAILQLQAFRSAGPELDLKMNVNVSPLQLARPDFLARLADLLAQVPDLPRHALCLEITETSLSDEAVSEALISIRALGVRIAIDDFGTGFSSLACLRRLPVDVAKLDRAFLGGGHTAAQDHRFFAAVTGLVHAADLKVVQEGIETLDQLALVRAAGADFAQGFHLAAPLSIAAALGLIAASRKE

SEQ ID NO: 10672 - protein, 97 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCG

SEQ ID NO: 10673 - protein, 452 aa, Frankia sp. CcI3
MVVPSAAPASEELFRRAERVVPGGVNSPVRAFRAVGGTPRFMVAGNGPYLTDADGRTYIDLVCSWGPMILGHAHPAVVEAVSRAVSVGTSFGTPTPGEVELAELIVDRVGPVEKVRLVNSGTEATMSAVRLARGFTGRSTIIKFAGCYHGHVDALLASAGSGVATLGLPDTPGVTGAATADTIVLPYNDLALVEAVFVERGETIAAVITEAAAANMGVVPPLPGFNAGLRRLCDIHGALLILDEVMTGFRISRAGWWGNEGAIEDWSPDLFTFGKVMGGGLPAAAFGGRADVMARLAPAGPVYQAGTLSGNPIAVAAGLATLRACTDEVYATVDTRAADVAGIVSTALTEEGVAHLPSSAGSLFSFFFTDAATVVDYAGAQAQNTARYAAFFHSMLDAGIYLPPSAFEAWFVSAAHDDETVERIAAAAPAAARAAAAVPEPVTVSASPEGRA

SEQ ID NO: 10674 - protein, 674 aa, Coprinopsis cinerea okayama7#130
MSQPDVHQLYQRLETIGKGAYGSVHKGKHIPTGNVVALKIINLDTPDDDVADIQREVALLTQLRDAPNITKYFGCYMDGPRVWIVMEYAQGGSVLTLMKASKDGCIEEKYTSVIIREVLVALSYLHKVPVIHRDLKAANILVTATGKVMICDFGVSALLTTVSSKRTTLTGTPYWMAPEVIQGVSAYDTKADIWSLGIMIFEMIKGTPPHSNLDKFKVMDLIPRAKPPRLQESEGSKDMRDFMSYCLKESPTERLPAEELLKTKWIKSISKVNVSILKDLILRLQQTGPRASLAGPLDWELEEEADQNAQQDWEFDTVRFDRRPSLDEEDYNAPSQATPTDSFETVRVPASAKTLPSSLRHLFGDSASTEPEPFTVPPPFTRPLTPPQSTTPVTNEWNTIHHVPSADDFASSTSNTLRRADNPPIAEPGEEPQPIISPDVPSPLEASLAPQPIQIPEPPREELQPAFIQPHLGLPAEDLPSFTLSQQTPGRSTPSRLDPPARSKPATHQSTISLDNTSAPGNGNLGVTYSPSPIVRTRSATTLPAIQPPPVSIIPRAFVQQSSPVKSATFTDDPSARGGPGLKDVLKSSWDGRSSAPVTLCAGYFKSLAWGTRNIETIPILWWTYGLSFTGYKQIRNGARSFTTKRAELDISGWFADFGTSELCGVDFQRGPSK

SEQ ID NO: 10675 - protein, 284 aa, Pseudomonas fluorescens PfO-1
MDETSLTVEDARTALRQAQVTCVHDLAIESHGRSLPLRLYTPPGKGPFPVLVFFHGGGWVTGDLDTHDGFCRLMCEWAGCAVVAVDFARPPEHLFPAALEDCWTAFKWVTRQGAGCGLDTSSIAVAGGGSGGGMAAVISQRDAECDEPCICFQLLLYPLLDCNTRRSSHTRFGQGHGLTVDLLEWYLGHYLPPGTSRVDRRLSPLLSDSLHGLPRTLIITCGLDVLRDEGRAYAKRLRAANVTVEHKEFSGMRHGFMNYPAAHEEARRALLLCARTLQAQLRGE

SEQ ID NO: 10676 - protein, 378 aa, Streptococcus pyogenes MGAS8232
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREALQAFAEASGDKMLHPKKKGFFDKVKDALEDI

SEQ ID NO: 10677 - protein, 213 aa, Oryza sativa (japonica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPCFWQIRTLKVLW

SEQ ID NO: 10678 - protein, 1097 aa, Oryza sativa
  misc_feature (664)..(664): Xaa can be any naturally occurring amino acid
MATPGLDDDSLQQLRSRATQLLLKENWTEYIAVCSLIIEAFDAAAACKDRRVLCSTLAHRADARARLGDAPGALADCDAALAADPAHPGALLSKGAVLRGLGRYSRAAECFRAALAVSGTDEVREMVEQCKRLDAQARSGAVDLSEWVLAGFSGKCPDLAEHVGAVEVRRSAHGGRGVFAVKNIEAGANLVISKAVAIGRGVIPDAADSGEKMVVWKDLVDKVLDAAEKCPRTASLIYTLSTGEEPEDELPIPDMAHFKQETEELDDGTAMAPKASLDVDKILKVLDVNCLTEDAAPSANLLGSNGVVNCGVGLWILPAFINHSCHPNARRTHVGDHAIVHASRDIKAGEEITFAYFDVLTPASKRREAARAWGLECQCDRCRFEASDAIVGQELTKLENELVNGRGGDMGALVVRLEERMRKSMVKERRKAFLRASFWSAYSALFDSDKLVRKWGRRVPGEAAVAESVAGAIGGNESVLRAMLRGADNGNGCGNRLEVEDKVVRIGRATYGRVVKRQAMRALFRLTLDADTNAPVCSKVVIRVWARIKTEPFMKSPMEEAHAMPVTSFFPVAGIHKLIAIFLVVLSWILVHKWSLRNQKGPRSWPIIGATVEQLKNYHRMHDWLVEYLSKDRTVTVDMPFTSYTYIADPVNVEHVLKTNFTNXPKGEVYRSYMDVLLGDGIFNADGEMWRKQRKTASFEFASKNLRDFSTVVFREYSLKLSSILSQACKAGRVVDMQELFMRMTLDSICKVGFGVEIGTLSPDLPENSFAHAFDAANIIVTLRFIDPLWRLKKFLHVGSEALLEQSMKLVDVFTYSVIRRRKAEILQARATGKQEKIKHDILSRFIELGEAGGDEGGGSFGDDKSLRHVVLNFVIAGRDPTATTLSWFTYMAMTHPAVADKLRRELAASEDERAREEGVALADAAGEASFAARVAQFASLLSYDAVGKLVYLHACVTETLRLYPAVPQDPKGIVEDDVLPDGTKVRAGGMVTYVPYSMGRMEYNWGPDAASFRPERWLSGDGGAFRNASPFKFTAFQAGPRICLGKDSAYLQMKMALAILFRFYTFDLVEDHPVKYRMMTILSMAHGLKVRVSTSV

SEQ ID NO: 10679 - protein, 277 aa, Silicibacter pomeroyi DSS-3
MTENRIPLAGVIGHPISHSKSPRLHGHWLKTYGINGHYIPMDVAPQDLAQVVRTLPKAGFVGVNITIPHKEAVMSVADQITDRATLIGAVNTLIFREDGRILADNTDGYGFMENLRAGAPGWDPKSGPAVVFGAGGAARAVISALAEAGVPEVIVTNRTRVRADKLKDDFGQRVTVADWVQAGNVIEDARLVVNTTSLGMIGKPELRVPLDGLRADAVVTDLVYAPLKTRLLAEAEEMGCTTVDGLGMLLHQAVPGFERWFGERPVVDAATRAAALR

SEQ ID NO: 10680 - protein, 269 aa, Oryza sativa (japonica cultivar-group)
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 10681 - protein, 257 aa, Zea mays
  misc_feature (182)..(182): Xaa can be any naturally occurring amino acid
  misc_feature (214)..(214): Xaa can be any naturally occurring amino acid
  misc_feature (241)..(241): Xaa can be any naturally occurring amino acid
MARHHLLLFLPLLALAFSFVVAAPERQGDAAAFIDGASHRYLRDQQEDQATSMSLDEVSAAVSVLLGFAPPAMLPAPSSAKFNKLLLPNPFDRPRSVFLMQLDGSHDYVDCFISDAGSIYKTKIDGAKSAAIELTDKDELIVIRSDESSGLDVLDNELANLATWLAGSYQKADSKLNIPLEXSGNSLTLFLTKEADVEFASSLISLLKTIKRGXFRVHEDFSGGIVSHAELLVCHFTGIKXALENEYGPAEIVKQGA

SEQ ID NO: 10682 - protein, 955 aa, Yarrowia lipolytica CLIB122
MSLEHIAPLDLENRPQRAIARYKSLEALRGRKDSYPPLRNSVIQETQDDSALDLELSEHSDPNDTNDPNDTNNSNDTSLFATDLSPAASAPVLGTVPPLIPPIVTNTTPFSVPISPRLSTSSSPRFSPRFSPSSLANTLASSLSISPTLGSTVMELPTALARKLSRRGLSTSPPFRSRSSSCPSVEMPITRHKNSEEQSAGNVATVSSILSSESAEVTVPLVLQQGMPFLRITHKKKVQRMFKIDPVTGKVSWDDKKASACFSVDTICEISLQENARNHREELKVSSNHESRWVTITYMKNKRRKPLHLVAPTKEEFTLFVDALQNLVYFRQELMRGFQSSNPKIASVHWKSYAAKEQGEERLTFEAVQRLAQRHHVLCSKAYLKSKFDEADVDKSGFLEFNEFKIFVKLLKRRPEIVTLYYQTLGKPEPANIWSDDRMTRDDLLGFLDHVQRTRFEPHIFEKIWAKFAPKDDTFDSSLDYWTVDSFNDFLLSSYNLFVKPETNLNRPLNEYYISTSHNTYLIGRQVADTSSEEGYIRALQSGCRSVEIDIWDGPDDRPVVKHGRTFTSSVSVEDVCSAIRKYGFIASPNPLILSLEIHCSASNQLKVVDILKGTFGENLVTQPLVPGALNLPSPHELKHRVLIKVKAGREPVAGDKNNGASFSSSYTSSSTTTASEFDDLSGTPSVSGGGKRKDTSGTTKKIVPALGELGVYVQGLKFRNFAFPESKTTNHCFSFSERKFISICKDPENREQMMKHNRRYLTRIYPSGYRVKSSNLNPLYFWQNGAQMVALNWQTYDLPAQLNDAMFAARGGYVLKPPYLRHLKSPRSGHSVNLSFISAQQLPRPKDLGKSSFDPYIVAQLHGPGENHKLKTSPVIDNGFNPRWNKDWSLSLSPEDYEFSFVQITLYTQDRPFAVSCLRLSSLNEGYRHVPLNDLQGEEYLFSTLFMKVSKISN

SEQ ID NO: 10683 - protein, 148 aa, Glycine max
MARQTFIMIKPDGVQSGLIGEIISRFERKGFYLKGLKLVTVDRPFAEKHYADLSAKPFFSGLVDYIVSGPVVAMIWEGNVVTTGRKIIGATNPAQSEPGTIRGDFAIDIGRNVIHGSDSVESANKEIALWFPEGPANWQSSQHSWIYE

SEQ ID NO: 10684 - protein, 390 aa, Glycine max
MFGSAQPSSSPFGTPSSTPAFGTPSSTPAFGTPSSTPAFGTPSFATPSSTPAFGTPSSTPAFGSSLFSTPFSSQPQQQQQQQQQQQTSLFQQQQTSSAFGFQNSLALAAPQPSLFPNAQLTTQMANVAPVPFSLADRDVQTIVDAYKEDPGNPKYAFKHLLFSVTEPQFRVKPAGVSDIMWAEAMGKLEGMESADRERLWPQLVQGFKDLSQRLKIQDEVIVSDAERLRITQSNVKMLQRHFQADTLPWIQRLKQKEQILQQRLLRVMRIVEALEEKGCRIPLTKGEAELAEKLATITRQLKGSGAELSRRVQNLLTVSRVKANSNGFGSSVYLPGSTKIHEQSLGDLQEVLQQQMEAIARLGSVLKRDIRDMEIMMTEDTARTENGNLI

SEQ ID NO: 10685 - protein, 588 aa, Oryza sativa (indica cultivar-group)
MAAASPPASPPHPKRPKMSSSSDPDQEPTSPSAAGADGAQPRAPRYKRRKVAILLGYCGAGYQGMQKNPGARTIEGDLEEALYRAGAVPEADRAAPRRYDWARAARTDKGVSAAAQVVSGRFYVDPPVFTDRLNAQLAPQIRAFGYVRVTNSFNAKKFCDRRRYVYLLPVFALDPSAHPDREAVMASVGSGSELTKCLECSERGRKVPGVMGREGKVPDPALQEEKSVEASREEAAVGSNEDANCDPASTGDRSVDLPIPDNETNTQITEMRSNGAEKCDVQLSGGTLCSEAVPASISETVCPILNSDSNTNSDSVDVDPSFVAEKKGSIETVVTEDGKKQAMDVVTEDEKKQDVDYEGSSLEEMPLRSAFSYTHEVKERFNRILKKYVGTHNFHNFTTRTKAEDPAAKRFIISFAADRVVNLDGIDFIRCEVVGQSFMLHQIRKMIGLAVAVMRNCAPESIYDVAFRKDVNLNVPTAPEVGLYLDECMFTSYNKKWKDSHEAVSMEPYSEEAEEFKLKYIFPHIAAMEHKEGAVALWLHSLNSRNYPDFRYMDNAGTEASIAAAVESVDEGTVPSDNISSVMASYDA

SEQ ID NO: 10686 - protein, 78 aa, Triticum aestivum
MGSETTERNDTLLGNGVIGILAETVNMWERRAPLTPSHCARLVLGGGKRESGVNRIIVQPSTKRIHHDAQYEDAGCEI

SEQ ID NO: 10687 - protein, 1491 aa, Gibberella pulicaris
MATPDANMSSTRSEQSSHDTIVNNELSTNEKPLQSAPAPGDQTSSTDDEDDGPQTEEMVRRHSIVRDLARNYTNTSHHFNGSNADLFNAADPASPLNPSSENFNARAWAKAMSKSMNENGAGFRQSGLCFQDMNVFGYGAETDYQKDVGNVWLGLPSMAQQLFKPNAGKRRIDILRGFDGVVNAGEMLVVLGPPGSGCSTFLKSISGETNGIYVDDSTYFNYNGIAADEMHKHHKGETIYTAEVDVHFPMLSVGDTLTFAARARCPQNLPSGINHNQYSEHMRDVVMAMYGISHTVNTQVGDNYIRGVSGGERKRVTIAEATLSNAPFQCWDNSTRGLDSANAIEFCKTLRLQSELFGQTCAVSIYQAPQTAYDLFDKALVIYEGRQIFFGPADEAKAYFIGLGFECPDRQTTPDFLTSMTAPSERVVRPGFENKVPRTPDEFATCWKQSQQYQIVRAEVESYKSLYPINGSSADAFRENKQSAQAKGQRLKSPFTLSYMQQVQLCLWRGFKRLVGSPGVTIFQLIANTVVALIASSLFYNMEPTTGDFFKRGAVLFLAVLSNAFASALEILTQYAQRPIVEKHARYAFHHASAESFASILVDMPYKITNSILFNLTLYFMTNLNRDAGAFFFYLLVSFIMVLAMSGIFRSIASISRTLSQAMVPASLLILALVIFAGFVVPVDYMLGWCRWINYLDPVAYAFESLMVNEFSGRNFTCTGFVPNPLIPGYADVDDMNRACSTVGAVPGQSWVNGDDYLNLEYKYFHSNKWRNVGILIAMTIFNHIVYIVATEYISAKKSKGEVLVFRRSNMPANVKSDPEAASSGPIPVTEKNNNEVANIQGSTSVFHWNDVCYDIKIKGEPRRILDHVDGWVKPGTLTALMGVSGAGKTTLLDCLADRISMGVITGEMLVDGKLRDDSFQRKTGYVQQQDLHLETSTVREALTFSALLRQPASTPREEKIAYVDEVIKLLDMQEYADAVVGVLGEGLNVEQRKRLTIGVELAAKPPLLLFVDEPTSGLDSQTSWAILDLLEKLSKAGQSILCTIHQPSAMLFQRFDRLLFLAKGGRTIYFGDIGKNSETLTNYFVKNGSDPCPKGENPAEWMLEVIGAAPGSHTEIDWHQTWRESSEYQEVQGELQRLKAEGNANGGAEIHDAESYREFAAPFGEQLRIATTRVFQQYWRTPSYIYSKAALCIQVGLFIGLVFLNAPLSLRGLQNQMFAIFQVLTVFGQLVQMQMPHFVTQRSLYEVRERPSKTYSWKVFMLSQIMAEIPWNTLMSVFLFVCIYYPVGFQKNAEFAGQTAERGGLMWLLFWQFLIFTCTFAHAAIAITDTAEAGGNLANVVFMLSLFFCGVFGSPDNMPGFWIWMYRVSPFTYLVSAILSTGIGNAEVTCTAQELTTFNPPNGTTCGEYLESYIAQAGGYLTNNDATSDCKFCTIKDTNVYLEALSSSYDNRWRDFGIGMVYIVVNIVGALFLYWAFRMPKNKNKKQKKA

SEQ ID NO: 10688 - protein, 191 aa, Oryza sativa (indica cultivar-group)
MAEAELLLERSRGDHPERPRQARPRRPRALGGRAEAELRGYVRRRVLPEIGEREFVVVYVHSLVDRGDNFPGVAAIRAAYEALPAAAKERLRAVYFVHPGFQARLFFATLGRFLFSSGLYEKLRYMSRLEYLWEHVSKGEMEVPECARQHDEELERRPLMDYGIEATDRRCMFDAASMDTSASLHSLRCIS

SEQ ID NO: 10689 - protein, 362 aa, Schizosaccharomyces pombe 972h-
MSATRRIVLGLIPADGIGKEVVPAARRLMENLPAKHKLKFDFIDLDAGWGTFERTGKALPERTVERLKTECNAALFGAVQSPTHKVAGYSSPIVALRKKMGLYANVRPVKSLDGAKGKPVDLVIVRENTECLYVKEERMVQNTPGKRVAEAIRRISEEASTKIGKMAFEIAKSRQKIRESGTYSIHKKPLVTIIHKSNVMSVTDGLFRESCRHAQSLDPSYASINVDEQIVDSMVYRLFREPECFDVVVAPNLYGDILSDGAASLIGSLGLVPSANVGDNFVMSEPVHGSAPDIAGRGIANPVATFRSVALMLEFMGHQDAAADIYTAVDKVLTEGKVLTPDLGGKSGTNEITDAVLANIHN

SEQ ID NO: 10690 - protein, 103 aa, Brassica napus
MAKKRKSVATRLDEVDRTMYSTFCSTANSLSHLYTHAMNQQKLSFQAGERHALEKLYQWILRQQQEGSRVATIDIVTHLQNELFNNPGGARTFPQKRIKGPGF

SEQ ID NO: 10691 - protein, 777 aa, Arabidopsis thaliana
MKRQAKPPEKKTKRTTNASSPTPSSSSPSLSSLPDEIVENCLARISRSYYPTLSIVSKSFRSIISSTELYVARSHLRNTEECVYVCLSDKSFEFPKWFTLWVNPNQANSMVEKKRKKKKTIGKLLVPIPSSNLSPVSKSAIAVGSEIYVIGGKVDGALSSAVRILDCRSNTWRDAPSMTVARKRPFICLYDGKIYVIGGYNKLSESEPWAEVFDIKTQTWECLSDPGTEIRNCTIYRIAEIEGKIHFGYTQKTYAYDPKQGEWECCEGEVAFPRSQCVMESVLYTFANNYTWEDDYGCKWWSTDGYGEKVKGLESLLEIHKRNGGSSDNTTKLVACGGKLLLLWEGYMKHNPNNRKKIWCAVIALEKRDGVKIPSLPLIVITVAMNFQVEPPEKKKTKNSSPPHSPPSSSSPSLSLLPEEIVVHCLARISRLYYPTLSLVSKSFRSILSSTELYATRSHLGSTEQCVYLCLWDPSYQFPQWLRLLVNPNRTLANSIIKKRRKKKKTTGQMLVPLTSSKFTSVSKATVVVGSEIYVLGGPVDSAVRVLDCCSHTWRDAPSMNVSRMNAWACFHDGKIYVMGGCQGLKDEPWAEVFNTKTQTWEGLPEPGSEVRKCSIDRSGVIEGKIEFGNVNEMCAYDTKLCKWEYCVNKSAALRSECMIENVSYGFWNMRLLWYDNDIQKDYWKRLEGLESLDDKYMRNGGSSGNTTKLVACGGKLLLLWEGYMKHNPNNRKKIWCAVIAIEKCDGGGVWGIVESVDVLYTVPISCQLLHCLVVSV

SEQ ID NO: 10692 - protein, 292 aa, Oryza sativa (indica cultivar-group)
MEDERNTESHQGGEAAEQVEVKDRGLFDNLLGRKKDDQPEEKKHEEELVTGMEKVSVEEPKKEEHHAEGEKKESLLSKLHRSSSSSSSSSSSDEEEEVIDDNGEVVKRKKKKGLKEKIKEKLPGHKDHAGEHAPPPAATGFPAPAPPASVVTAAPTPAPAPVVTHGDHHHDTAVPVEKIEGDHAKTEATLPHAPEEEKKGFLDKIKEKLPGGHKKPEDATAVPPPAAAPAAPATTPAPAHPPPATEEVSSPDGKEKKGILGKIMEKLPGYHKGSGEEDKTAAAATGEHKSSA

SEQ ID NO: 10693 - protein, 522 aa, Oryza sativa
MTGSVPFEKALAARLSLFKPSLGQVEDCMEKRPPRISPGIAELVKMLKAKNVDVYLVSGGFRQMIKPVAMQLGIPPENIFANQLLFGTSGEYVGFDPSEPTSRSGGKAVAVQNIRQKCGYRTLFMVGDGATDLEARQPNGADLFICYAGLALARSIVRRVSETELTFIGDGMSYCLGKKGYQAVHRHYSPPQAAAGDGGAPLRVPGARAAQRGLTWLEGRKIRCLLLAKHPVVESHELKLLQIVDAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNS

SEQ ID NO: 10694 - protein, 1161 aa, Zea mays
MASGSRATPTRSPSSARPEAPRHAHHHHHSQSSGGSTSRAGGGAAATESVSKAVAQYTLDARLHAVFEQSGASGRSFDYSQSLRAPPTPSSEQQIAAYLSRIQRGGHIQPFGCTLAVADDSSFRLLAFSENSPDLLDLSPHHSVPSLDSSAPPHVSLGADARLLFSPSSAVLLERAFAAREISLLNPIWIHSRVSSKPFYAILHRIDVGVVIDLEPARTEDPALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVFHGDSTGLSTDSLADAGYLGAAALGEAVCGMAVAYITPSDYLFWFRSHTAKEIKWGGAKHHPEDKDDGQRMHPRSSFKAFLEVVKSRSLPWENAEMDAIHSLQLILRDSFRDAAEGTNNSKAIVNGQVQLRELELRGINELSSVAREMVRLIETATVPIFAVDTDGCINGWNAKIAELTGLSVEEAMGKSLVNDLIFKESEATVEKLLSRALRGEEDKNVEIKLKTFGSEQSKGPIFVVVNACSSRDYTQNIVGVCFVGQDVTGQKVVMDKFVNIQGDYKAIVHNPNPLIPPIFASDENTSCSEWNTAMEKLTGWSRGEVVGKFLIGEVFGNCCRLKGPDALTKFMVIIHNAIGGQDYEKFPFSFFDKNGKYVQALLTANTRSKMDGKSIGAFCFLQIASTEIQQAFEIQRQQEKKCYARMKELAYICQEIKNPLSGIRFTNSLLQMTDLNDDQRQFLETSSACEKQMSKIVKDASLQSIEDGSLVLEQSEFSLGDVMNAVVSQAMLLLRERDLQLIRDIPDEIKDASAYGDQCRIQQVLADFLLSMVRSAPSENGWVEIQVRPNVKQNSDGTNTELFIFRFACPGEGLPADVVQDMFSNSQWSTQEGVGLSTCRKILKLMGGEVQYIRESERSFFLIVLEQPQPRPAAGREIV

SEQ ID NO: 10695 - protein, 442 aa, Kineococcus radiotolerans SRS30216
MDGAARGPGLRTRRGDRAGHRPPGLQPGLLQPVPGAGDRRRDGRDRHRPPRRRGDPRPGRCALHGRGGARAGPLRPHEGPRRPRPARPRPARQPAADRGPHHRLKEHPVTSSTQVQLVSRPRGWPTPEDFRTVSVELPALAPGQVRIRNEFLSVDPYMRGRMSAARSYVAPYAVGETMTGGAVGRVEESTSDDLPVGTLVVHDLGWRDVAQGDAAAFRAVAEVPGAPSSLHLGILGMTGLTAYVGLTAIAGLREGETVFVSGAAGAVGTAVGQIARLLGASTVIGSAGSAEKVALLEGKYGYDRALNYRDAPIREQLAQAAPDGIDVFFDNVGGDHLEAALAAFNDHGRAAICGAISQYNATGPVAGPDNLGNLVTRKLTLRGFIVGDHRELAGEFRERMTGWFADGRIAYDETVFEGIGNAVDAFLAMMRGANTGKMVVRL

SEQ ID NO: 10696 - protein, 352 aa, Xanthomonas axonopodis pv. citri str. 306
MLPVHRVLRYLGLAVARRTGGGTRMSASKHQVVCFGEALIDMLALPQARPDEARTFAQYAGGAPANVAVAVARLGGAAHFVGMLGRDMFGDFLLQSLQQSGVATDGIVRTDQAKTALAFVALDDAGERSFSFYRPPAADLLFRPEHFAADGFTQAAVLHVCSNSMTEPEIAQCTLDGMRRARADGAIVSLDLNLRPMLWPQDVEPAPLLWEALALADVVKLSREELEYLAGTLDSDASAVTQKLWQGRASWLLVTDGGGPVHWQTRTDSGQVPAFQVQVRDSTAAGDAFVGGLLYQLATRAASLEQLCGDPAVINEVIRFAAAVGALAVTRKGAFAAMPSIDEVHSLIQEQS

SEQ ID NO: 10697 - protein, 530 aa, Solanum lycopersicum
MENQQQNQVIGGSKRIVALNESPLPSNNDHHIEHQKHGWKNFFAYVGPGFLVSLAYLDPGNLETDLQAGANHRYELLWVILIGLIFALIIQSLAANLGVSTGKHLSELCRAEYPVFVKYCLWLLAEVAVIAADIPEVIGTAFALNILFHIPVWAGVLCTGVSTLLFIGLQRYGVRKLELLIAILVFVMAACFFGEMSYVKPPANELFKGMFIPKLNGDGATADAIALLGALVMPHNLFLHSALVLSRKIPNSVRGINDACKFFLIESGFALFVSFLINVAVVSVSGTVCGADNLSDQNKESCSDITLNSASFLLKNVLGKSSSTVYAIALLASGQSSTITGTYAGQFIMQGFLDLKMKTWLRNLFTRLIAITPSLVVSIIGGSSGAGRLIIIASMILSFELPFALIPLLKFSSSSTKLGPHKNSIYIIVISWILGLGIIGINIYYLSTAFVGWLISNNLPKVGNVLIGIVVFPLMAIYILAVIYLMFRKDKVVTYIDPIKDDHMENGINSMELVDRVPYREDLADIPLPQ

SEQ ID NO: 10698 - protein, 462 aa, Cryptococcus neoformans var. neoformans
MHPQNSSTPSTNSPSTFSLPKSSISRKKPPGLDISKSILRPTRTAPVLPANGSSPSNFVSEADRLRDDIANLQLSSRSTGSNHSPEALDSPRAFQSDSSVASGLAKKEKSRDGKERGDKEKRKKKHKDKDGEDLVKDEDLEILHDLGAGNGGTVTKVWNKKRKCVMARKLILVDAKPSIRKQILRELQIMNDCDSPYIVGYYGCFPVDVHVGIVMEFMDAGSLDYIYRHHGAIDIDIVGKVAQAVLEGLIYLYDKHRIIHRDIKPSNVLANTRGEIKICDFGVSGELINSIANTFVGTSTYMSPERIQGAPYTIKSDIWSLGISLIELAVGRFPFSDSPDSEELSPSVSDFDPDPTLPRSVRRPKIESNSRHNGVSQSGGPHAMSILDLLQHIVNEPAPRLASRRRRFPQEAVAFVEGCLIKDPDQRRSPKELLSSSWITNLKTTKEDLQTWAQSMVGPREE

SEQ ID NO: 10699 - protein, 170 aa, Mycoplasma mycoides subsp. mycoides SC str. PG1
MNLKEFVVDVKDFPKQGIVFKDITPLLNNKDAFKYTIDQMADFIKQLDVDVVVAPEARGFLLASAVAYAANKRFVLVRKPNKLPREVYDVEYSLEYGTNHQQIHVGDLKPNDKVVVIDDVLATGGTMQAIIDLVKLSKAEVIGMSFLIDLTFLHDVNLFDQYKVQKLIKY

SEQ ID NO: 10700 - protein, 423 aa, Yarrowia lipolytica CLIB122
MGKADTKDAKVRHSPLHVDMSQGSGLLRESAKQKTSRNTKKTDAAEEDFIDSATSRRILQMARDQQRELDEEERGEEFPEDDDVEFEDEDEEEDEEEYEEYEDVQQEFMTPEDAALYAKYFNEDEPVSLADKIMAKIREKEEEEQFERTGEAPGTSQGLEGEGVMLPPKVIAVYEKVGELLSRYKSGKLPKAFKIVPTLRNWQDVLYVTDPASWSPNAIYEGTKMFVSNQQAKEAQKFIQIVLLERFKEEIEEKKTLNYHVYRSLKKALYKPSAFFKGFLFPLAEQCTLKEAIIVSSILSKVSIPTLHSAAALMRLAEMPYSGPTSLFIKVLLDKKYALPYRVVDAVVFHFMRFAHVEEALPVIWHQSLLVFAQRYKSDITEDQRDALLDVIKVKNHPKITPEIRRELISGESRPIVDEQMEV

SEQ ID NO: 10701 - protein, 109 aa, Oryza sativa
MVGQGKGGKAVGGKGVGKVGAKRRAGRSQKASIEGITKPAIRRLARRGGVKRISTFIYDDSRAVLKGFLENVVRDATTYTEHAKRKTVTAMDVVYALKRQGRTLYGFGA

SEQ ID NO: 10702 - protein, 569 aa, Frankia sp. CcI3
MTSPARPARSARPSRPKGAGQWALGYSEPLNANERMKKDQGGLEVRDRILNLYPRTGFDGIDPQDLRGRFRWWGLYTQRRPGISGGRTAILEPEELDDSYFMQRIRLDGGRMTSDQLRVIADVSTCYGRDVADVTDRQNIQLHWIRIEDVPAIWAALENAGMTTAEACGDTPRVILGCPLAGVDGDEIIDGSEAIDEVVRRFVGDPTLANLPRKFKSAISGCADHCTLHEINDIAFVGVVHPELGAGYDLWVGGGLSTNPRLGVRLGAFVPPARVAEVWHGVVSLFRDYGYRRLRTRARLKFLVADMGAEWVRATLEKEYLASALPDGPPPAPPRSEGRDHIGVHRQRDGRNAVGFAPRAGRLSGTTLSAVADLADRFGQGRIRATTTQKLVILDVADADVNALEAELGALDLVVRPSVFRRGTMACTGIEFCKLAIVETKGRARDLIDELERRLPDFDEPIGINVNGCPNACARFQVADIGLKGSLVPDDATGEMVEGFQVHLGGHLGTRSRLGRKSRGLKVTADGLVDYVVAVLETYRADRTAGESFADWAERADEAQLTALGAADG

SEQ ID NO: 10703 - protein, 553 aa, Aspergillus oryzae
MTTAIVTGTGRRSSIRQSDLQPPATDFISQSMTTSPIDKFPQFKDDLYEIAAGPRESHSNFATKYTPNDRWEPRKENNFASEYTNGTIRHSKHKPRKSISEAISTIRTRNASVSANAQELAQALRAPVSYKLISLCLIWYMTSALTNTSSKSILNALPKPITLTIVQFAFVSIWCLLLSYLSKILPWLRNSIPALKNGIRYPSRDVIMTALPLAVFQLAGHILSSMATSQIPVSLVHTIKGLSPLFTVLAYRVFFRIRYASATYLSLVPLTLGVMLACSTGFSTNFFGIICALVAALVFVSQNIFSKKLFNETARGESETQVSAQRKLDKLNLLCYCSGLAFILTLPIWVLCEGYPLLSNVLRDGSISLSGKENSLDHGALLLEFVFNGVSHFAQNILAFVLLSMISPVSYSVASLVKRVFVIVVAIVWFGNSTTGMQAIGIALTFIGLYLYDRNSHDDLADQRANADHFHTKENVLPLNIRSTTKTWDSNGYVFPPGKTSERQFLDETHSFPNDLKKDDDRPGRVRPRGSSNTRAWLPPGTKQETTWQPSDS

SEQ ID NO: 10704 - protein, 372 aa, Schizosaccharomyces pombe 972h-
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 10705 - protein, 462 aa, Bacillus clausii KSM-K16
MAHAYSFPKDFWWGSAVSATQIEGAANEGGKGKNIWDHWYELEPNRFFEEVGPSATSDFYHRYQDDIALMKAIGHNSFRFSISWSRLIPGGEGEVNKEAVAFYNNVIDELIANGIEPFVNLFHFDMPFELQEKGGWENREVVELYAQYAAACYDLFGDRVKKWFTFNEPIVPVEGGYLYDFHYPNIVDARRAFQVAYHTVLAHALAVAAFRTRSIEDGKIGIILNLTPSYPRSDHLGDQKAAAIADLFFNRSFLDAVVLGSFPKELVALLDEYGQLPTYEKEDVALINAQRIDLLGVNYYQPRRVKAKEHLPNPASPFMPEWFFDHYDMPGRKMNHYRGWEIYEKGIYDIMVNLKDNYGNIESFVSENGMGVQNEERFMENGQIQDKYRIEFIKGHLKWLHQAIQEGCNVRGYHLWTFMDNWSWTNAYKNRYGFISVDVQTQKRTPKKSAEWIKAVSQQNGF

SEQ ID NO: 10706 - protein, 553 aa, Candidatus Protochlamydia amoebophila UWE25
MIMSIEVAMISFSPLQIHRLKYQPQLPLLLQDLSVIAANFEKSICLSDSALQEQFPQTFQQPIITFRRGNKKEATPLKVGVVLSGGQAPGGHNVIAGLFDALKQIHPESILLGFLDGPLGILKNTSIELTKMVIDSYRNQGGFDMIGSGRTKIETPAQLEAAMLTVQTLALDGLVIIGGDDSNTNAAILAEYFKQVGVKTSVIGVPKTIDGDLKNEFIDISFGFDTASKIYAECIGNILKDALSAKKYYHFIKLMGRSASHLALECALLTHPNLVFISEEVAEKKQTLQEIVGQITTMICKRAEKNLHYGVILIPEGLIESISEIGALIQKLNELLFSHSEKIEGLLITEEKDNYIISQLTSNEAKTFLALPKEVRDQLLLERDSHGNVQVSKIETERLLIKLVEKELKRLKQEGIYKGTFSPQPQFCGYEGRSGLPSNFDCQYCYALGFVATLLVQSGVTGYMSCLKKLSEPIERWSPMGVPIYRMLQIEKRQGKQKSVIRKFLVDLQGPFFKQYASVRDQWQITDDYRSPGPIQFEGPKNLTEVKPLSLLL

SEQ ID NO: 10707 - protein, 939 aa, Candidatus Protochlamydia amoebophila UWE25
MILIALNLMAQKPSFHSCQLCVSLIDLTCDAFIYQIQQLPSQVDLIEIRLDKLLKIDFAELDRLKEIAHRPLIWTLRKKSQGGNFLGNIQKQFLIFKELAKRQPDFVDIEADIPLEWLQELQKISPQTQWIISWHEVKETPHLKTCLDQLYALPGNYYKLACYTHSIIDSLKLLEMAQQENKHSRRLCTIGLGMKGQCTRILAPVTGQPFTFASLKEGLESAPGQISFQTLFQTYRFKKLSQQTEIFGLIGHPIDKSLSHLTHNAVLDHLNQNAVYIKFDVEETELELFFQHIQRFSVRGFSVTMPHKERVKKILALNMDDESHLACNTLLFSSSIINGTNTDGIGALKALKVEDLKDKKLILLGAGGTSQAIAYEAKKRGAEVTILNRTVLRAKDVAEKIQVKWGGFEQLKEAKKNECDILIQTTSVGMSPHVDALVVSADWIPQQITALDVISHPFETLFLQKARLKGCEIHHGIELFIHQAAFQFGFWFNKQFDQKLIEQTIREALPMPFNQKKVAVQKSALAGEISLPPSKSHSIRAILLGAMTQGISRVKNLLDSPDVEHAKLAAIALGAKIEQVQDEYLISGVAGQPKTPSGIIDVGNSGQVLRFAGAFAALNHGYTVITGDHSICSNRPAQPLLDGLRCLGAFAKSTRENGYAPLIIKGPIYEGTAELEGQDSQPVSALLMASAFIHGTTEIFVKYPGEKPWIDLTLHWLNRLGVSYINQNYEYFKIEGIQQRPHFEVNIPGDLSAAAFPVAAAILTQSKITLYNVDMSDVQGDKQVIHVLQEMGADIQIDQASHTLTVLPGALLKGTTIDVNPFIDAVPILAVLACFAKGETHLINAAIARQKESNRLSCITIELKKMGAQIMETDDGLLIRNSNLRGAIVESYDDHRLAMALIVAGLASEGITEVKGIDCIKKSFPNFIQDLKKLGARFT

SEQ ID NO: 10708 - protein, 699 aa, Oryza sativa
MDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 10709 - protein, 469 aa, Magnaporthe grisea 70-15
MSYIFSWARIASPWLKADFCHCLQAAKSARSRRPSRNATQWIVDHEELPKQVIVANYVLKMLVSPEIHRPRRSTLPTWLNRKVNWIVNLVPSKQAVIRGHARTFQTSRNYPTGSASSDVFLRFSGICQDFRYRRTNGPELHTKPGTYAVSWARLENHLYKARGPSGDILRGTFHVPKSQRYKRSSRLRSPFSGCIAFAAAMTPVVANMPPSEFNFPSVNNDTVLTVAYTFNGNTTVVDPGTMFGGNVARNQPQLAVDPTKFRSLADYTGQYVVIMIDPDAPSPDNPIRRSILHWLASGITQTLGGGSGRISGQRSLTNSTPATVPYAAPGPPPSSSAHRYFFYIWQQPPGFQVPSSFNPNNRANFDIENFVRETNLGAPAAANYIYVSRQDSVPMTFIASPGSEYPGGNGNAVFPRKGDGNGNGNGNGNDNGDPYNPNYPDEGAASGGIQMSNFAALISFVAMGLACLV

SEQ ID NO: 10710 - protein, 139 aa, Triticum aestivum
  misc_feature (72)..(72): Xaa can be any naturally occurring amino acid
  misc_feature (87)..(87): Xaa can be any naturally occurring amino acid
  misc_feature (97)..(97): Xaa can be any naturally occurring amino acid
  misc_feature (100)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (117)..(117): Xaa can be any naturally occurring amino acid
  misc_feature (123)..(123): Xaa can be any naturally occurring amino acid
  misc_feature (129)..(129): Xaa can be any naturally occurring amino acid
  misc_feature (134)..(134): Xaa can be any naturally occurring amino acid
MAPTVMASSATSVAPFQGLKSTAGLPVSRRSNGASLGSVSNGGRIRCMQVWPIRGHQEFETLSYLPPLNTEXLLKQVDYLIRSKWVXCLQFNKVGFXFPXXKAXPGYYNGXVLAMLXLPKFGXLTHKVXNEVEXVKKDT

SEQ ID NO: 10711 - protein, 174 aa, Glycine max
MVYHSSFVNEDGVSRACGCPLLPLKSHIKGPAPVSDQDRTDIVDEAITFFRANVFFRNFDIKSPADKLLIYLTFYINVALKRLEGCRTLAEGTKAIINLGLEKVPVPGESGFPFPGLFPLPQSHKEAELFRNYLKQIREETSGRLLSVAYRPNGTPNKWWLAFAKRKFMNIIIP

SEQ ID NO: 10712 - protein, 534 aa, Artemisia annua
MLSFWSLFWEIHNQNQELAHMILTVSIVVLVLLWYKWTIPYTRKEKTRLPPGPYGLPIVGYLPFLGSNLHEKFTNMADTYGPIFSLRLGTKLHVIVNSMDLAKVIAHDLDHTFANRVPPLTALTITYGASDVIWSNNNTHWRDMRKLLDSQVLSNTSINACQIFRTRAVRNMMNGVYAKIGTKVDINKIAFDTDLDLVTSMLWGCSEAGEGDDSIFTGGGFREVEYKIVELLGAPNISDYLPLLSCFDLHGRQREMQRQLEYVDRNFNNIIKERIKVNSRNIERGDKKDETKDFLQILLDIEDQKDTETSLNTDTATSFNIIHIKALLLDMVTAATDASSTMVEWVMAEIMHNPSVKKKVQDELTMVIGKNVVEESHLPKLSYLDAVIKETFRLHPPLPLLIQRSPDETCKVGGYTIPKGTSVSMNIWAIHRDPKNWSNPLEFKPERFLDGKWDYYVNNMKYVPFGSGRRICPGIVLGEKMLMYIVSSLLHSFDWRLPEDEVSDLSEEFGFVTKKKNSLMAIPSQRFDDDSLYI

SEQ ID NO: 10713 - protein, 268 aa, Brassica napus
TMASSRKKVLIPIAHGTEPLEALAMITVLRRSGAYVTVASVENQVGVDACHGIKMVADTLLSDITDSTFDLIMLPGGLPGGETLKNCKPLENMVKKQETDGRLNAAICCAPALALGTWGLLEGKKATCYPVFMEKLAATCATASESRVEIDGKIVTSRGPGTTIEFSLTLIEKLCGKQTAIDVSSILLPRPNPGEEFTFTELNQINWTFEDTPQILVPIAEGSDEIEAIAVVDTLRRAKANVVIASVGNSLEVVGSHKANLVADVLLD

SEQ ID NO: 10714 - protein, 64 aa, Cocos nucifera
GGKKDKMLVSYWGMAPAKVVKEDGTEWKWPCFKPWDSYTSNQSIDLHKHHVPMTWGEKLAYWIG

SEQ ID NO: 10715 - protein, 171 aa, Prochlorococcus marinus str. NATL2A
MNLNSAFEFQFIYILDNAVLAWGLAACGLAQFSKLLFELIFKQRWRPSVLIETGGMPSSHSALVTGTAAGIGLQLGFNDPVFALASTIAFIVMYDASGIRRSAGLTAAKVNQILKDNSNELSSETTLKESLGHTKIEVLVGSILGPIVALPGIFFIGSPLHILQMIGLVSL

SEQ ID NO: 10716 - protein, 392 aa, Zea luxurians
MRNGQIKNFTSNSGPQHPAAHGVSRSVLEMNGEVVERAEPHIGSLHRGTEKLIEYKTYLQALPYFDRSDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSVRIIVQCPNQMPSGMIKADDRKLCPPSRSRMKLSMESSIHHFELYTEGFSVPAPSTYTAVEAPKGEFGVFLVSNGSNRPYRCKIRAPGFAHSQGLDSMSKHHMPADVVTIIGTQDIVFGEVDR

SEQ ID NO: 10717 - protein, 289 aa, Brassica napus
  misc_feature (237)..(237): Xaa can be any naturally occurring amino acid
  misc_feature (242)..(242): Xaa can be any naturally occurring amino acid
  misc_feature (253)..(253): Xaa can be any naturally occurring amino acid
  misc_feature (255)..(255): Xaa can be any naturally occurring amino acid
  misc_feature (258)..(258): Xaa can be any naturally occurring amino acid
  misc_feature (261)..(261): Xaa can be any naturally occurring amino acid
  misc_feature (271)..(271): Xaa can be any naturally occurring amino acid
MVNGDDNGAEADRWLVTSKELLASRDFQGAKTLAIRACEDDSSRTHAADYIIAIADTLLAGESTVGDSKLPDWYAVLRLEKLTQSLERVAVQYRRLALLLNPTVNRLPFADQALKLVSEAWCVLSDPPRKSIYDHQLGQPQSQREQLAETSESPNAASFWTACPYCYALFEYPKGYEECALRCQQCGRAFEAVKTETPPVESNGQGVYFFCSWAMFPVGFSGDAKTSGSCWSPVSAXFHCPXVSADHHQANIXAXASXNYXDVDGDGDELXINISDDEEEDAKKNKKGG

SEQ ID NO: 10718 - protein, 463 aa, Listeria monocytogenes str. 1/2a F6854
MTKVNSFFRKKSFHNPATDKHHLNKSLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYDPSAGTYFDLLAFVVVMVIGILLSFGIRESTRVNNIMVLVKIAVVVLFILVGAFYVKPNNWTPFLPFGVQGVITGASTVFFAYIGFDAVSSAAEEVKNPQKNMPIGIISSLAVCTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFKTPFYPVVPALSFLLCVYLMINLSKTTWIAFGIWFVIGILVYTFYGRKHSALRIK

SEQ ID NO: 10719 - protein, 449 aa, Oryza sativa (indica cultivar-group)
MWEYHHQLSTHAALQPSSSFPYSYWSPYSGSTALAGSAFAADSSSSSTDVMRLPAAGEHAHGHGWSHGELSNSTTGGGYRENFLDLLASKNVTPEMFEEVPASEHYNVAPAGTTLTTTARSFDHHARSDVSPIKYEIAGSPLYLGGTNTVLQVQDMTMMSSTPACYGEHHHHHHHQLTKEGSCNHQQQEQHELAISPMASFLQQISSGSASVGVHNSSLDYSGLGDQPDKICCQDGREMEASPFGMRSLPDLGSFAGYTPAIESTSVQPYMRCANSSDSNRQEQETVPARSSSSGSGAAATDRKKRKSEERQESTVKKSKQEASKASPPKQPVPKVKLGEKITALQQIVSPFGKTDTASVLFETIKYIKFLHEQVQLLSEPYTNSSRSNKQGNSVPWGDQAEASKGETMEHDLRNRGLCLVPVSWTPEVYRDGNAMDYWTPAYRGCLYR

SEQ ID NO: 10720 - protein, 117 aa, Brassica napus
  misc_feature (35)..(35): Xaa can be any naturally occurring amino acid
GPGGFWLRKLKGVGTGLTDNSGDFLTKDIEVGVVXNKNGEPQGLNFNVGGGLGRTHKMEFIFAGLAKQLGFVPKEDILIAVKVMVVTQRDHGRGDNVNFSRMKFLVSSWGIEKFKDV

SEQ ID NO: 10721 - protein, 112 aa, Candidatus Protochlamydia amoebophila UWE25
MKKIFVGNLSWKTSEEQLKAHFEAFGKVVSAKIVTDQMTGKSKGFGFVEMESANDAENAIRELNGKPLVDRSLRVSLAQERDRSERREPRSFGGGDRDRSSFGGDRRSNYRS

SEQ ID NO: 10722 - protein, 1166 aa, Zea mays
MASDSRPPKRSPSARRVAPRHAHHHHSQSSGGSTSRAGAGGGGGGAAATESVSKAVAQYNLDARLHAVFEQSGASGRSFDYSQSLRAPPTPSSEQQIAAYLSRIQRGGHIQPLGCTLAVADDSSFRLLAFSENAADLLDLSPHHSVPSLDSVALPPVSLGADARLYFSPSSAVLLERAFAAREISLLNPLWIHSRASSKPFYAILHRIDVGVVIDLEPARTEDPALSIAGAVQSQKLAVRAISRLQALPGGDVKLLCDTVVEHVRELTGYDRVMVYKFHEDEHGEVVAESRRDNLEPYLGLHYPATDIPQASRFLFQQNRVRMIADCHAIPVRVIQDPGLSQQLCLVGSTLRAPHGCHAQYMANMGSIASLVMAVIISSGGDDERTGRGAISSSMKLWGLVVCHHTSPRCIPFPLRYACEFLMQAFGLQLNMELQLAHQLSEKHILRTQTLLCDMLLRDSPAGIITQSPSVMDLVKCDGAALYYRGKYYPLGVTPTESQIKDIIEWLTVCHGDSTGLSTDSLADAGYLGAVALGDAVCGMAVAYITPSDYLFWFRSHTAKEIKWGGAKHHPEDKDDGQRMHPRSSFKAFLEVVKSRSLSWENAEMDAIHSLQLILRDSFRDAAEGTSNSKAIVNGQRQLGELELRGINELSSVAREMVRLIETATVPIFAVDTDGCINGWNAKIAELTGLSVEEAMGKSLVNDLIFKECDDIVEKLLSRALRGEEDKNVEIKLKTFGSEQSKGAIFVIVNACSSRDYTQNIVGVCFVGQDVTGQKVVMDKFINIQGDYKAIVHNPNPLLPPIFASDENTSCSEWNTAMEKLTGWSREEVVGKFLIGEVFGNCCRLKGPDALTKFMVVIHNAIEGHDSEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETSSACEKQMSKIVKDASLKSIEDGSLVLEKSEFSLGDVMNAVVSQTMSLLRERDLQLIRDIPDEIKDASAYGDQFRIQQVLADFLLSMAQSAPSENGWVEIQVRPNVKQNYDGTDTELFIFRFACPGEGLPADIVQDMFSNSQWSTQEGVGLSTCRKILKLMGGEVQYIRESERSFFLIVLELPQPRLAAGRENQLIC

SEQ ID NO: 10723 - protein, 279 aa, Saccharum officinarum
DACEKWGFFEILNHGISTELMDEVEKLTKDHYKRVREQRFLEFASKTLKDAQDVKAAENLDWESTFFVRHLPESNIAEIPDLDEDYRRAMRQFTGELEALAERLLDLLCENLGLDRGYLARAFAGPRTGAPTFGTKVSSYPPCPRPDLVSGLRAHTDAGGIILLFQDDALGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKQYVRHKFEAKEPRFE

SEQ ID NO: 10724 - protein, 485 aa, Propionibacterium acnes KPA171202
MMTNDRSLPSDLPTQLLIDGEWVDAEASRTFDVINPATEKPLVAIADASVDQGTDALDAAVRAQHSWADTAPRERAEILRKTFNLVTERKDDFARLMTLEMGKPLAESYGEVTYGSEFLRWFSEEAVRIRGDYGLLPEGNIRQLVTKRPVGPCLFITPWNFPLAMATRKIAPALAAGCTVVIRPASATPLTTLLLAKTFLEAGLPAGVLNVITGLDHAVTDAILEDPRLRKLSFTGSTGVGANLLGKAAKHVLRTSMELGGNAPFIVFDDADLDQAIIGAKGAKMRNMGEVCIAANRFIVHESVAEEFTDKMIEMMSGLVVGDGLDEKSEVGPMITERDREKVDGLVRSAIEAGATLRCGGEIPEDKGWFYPPTVLSGVPADAEIMQTEIFGPVAPITTFRTEEEALALANSVPVGLAGYVFTSDTARILRMGQKLETGMIGANLGVFSNAAAPFGGVKESGLGREGSYQGIEEFLETIYVALPA

SEQ ID NO: 10725 - protein, 336 aa, Buchnera aphidicola str. APS (Acyrthosiphon pisum)
MVKNMTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 10726 - protein, 444 aa, Arabidopsis thaliana
MAAETSIRKLPSLSGLRHRRNPLEDNPYFHPSNGFYITPSDVILAQVAYDHSAHSQSRVAYHRAGPRREIMYEPSAVKAAIVTCGGLCPGMNTVIRELVVGLWELYGVREIYGIPAGYRGFYSMKAVKLDPKAVHDWHKKGGTVLATSRGGFHLQKIVDAIHLNGYNQVYIIGGDGTMRGAVEIFKEISLRKLEVGITVIPKTVDNDVGIIDRSFGFQTAVEMAQEAISAAHVEAESAVNGIGLVKLMGRSTGHIALHATLSSRDVDCCLIPEMDFYLEGKGGLFEFLEKRLKERGHAVLVVAEGAGQEMIPRNESQKQERDESGNAVFLDVGVWFKSVLKAWWEREHPDELFTVKYIDPTYMIRAVPANATDNLYCTLLAHSAIHGVMAGYTGFVPGPINGNYAYIPLEEVAQTKNQVNTRDHKWAWVRSVTNQPDFETNVKG

SEQ ID NO: 10727 - protein, 483 aa, Staphylococcus epidermidis RP62A
MGSFFNRMTRKENPTIYQNKDGHLKRTLRVRDFLALGVGTIVSTSIFTLPGVVAAEHAGPAVALSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRE

SEQ ID NO: 10728 - protein, 216 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKEPFVNIPDDKIREALKVVLDPRNQPLLIHCKRGKHRTGCVVGCLRKLQEWCLSSVLDEYHRFAAAKARITDQRFMELFDVSSLKHLTPSHC

SEQ ID NO: 10729 - protein, 445 aa, Staphylococcus epidermidis RP62A
MSKVNHLIVEDERYFAHSGRIKYYPLVIDHGYGATLIDVDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKHYGPLLNGFYHIPFPDKYRGMFEQAKPNTVEEYLAPLKEMFAKYVPAEEVACIVVETIQGDGGLLEPVPGYFEALQELCHAHNILIAVDDIQQGLGRTGKWSSVDHYYFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEQALEKLERGELNQYDISGQGW

SEQ ID NO: 10730 - protein, 236 aa, Frankia sp. CcI3
MSDESTASADLIPGAAGVPGGPGGQRRDAFGAGDSGDTSGFGGLVTPVPILSSTARPFGDADADAVYDALERAFPQLGDAVERVVVDRGELTVHVRRESLVAVGQTLRDDPDLRFELLSSLSGVDYPDDVTGRRLHSVAHLTSMTHRRRVRVEVSVTDADPTVPSLTSVWPTADWHERETYDMFGIVYTGHPGLTRIMMPDDWIGHPQRKDYPLGGIPVDYKGATIPPPDERRSYS

SEQ ID NO: 10731 - protein, 569 aa, Yarrowia lipolytica CLIB122
MNCPTKDTDKTWARPGYNQNPRRFDSNLISNVFFSSGNVPKPATGCDDEDGGKGIPLDAIEERSVNENGSGGSEGPKDQVINHACPSAPPPPPLAPTVLQTIQMAFLKYVRFLGPGLMVSVAYMDPGNYSTAVAGGANHQFALLFVILLSSIIALVLQSLAIKLGSVTGMDLARCCREYLPKWMSITLYIFAEIAIVATDIAEVIGTAIALDILLHIPLIAGVCMTIVDVLIVLFAYRPGGGMRVVRFFEYAVAALVLGVSICFIILLCRIPHQSVRKIFRGFAPSRALIQGTGIVDSAGILGATVMPHSLFLGSGLVQPRLREWDVANGTAPAPDSSKDSEEEYFAYKPTIGAIKYCLKYSIIELVTTLFTLALFVNSAILIVSGATLYGNSDASTADLYGIHSLLRQYISKGAGTIFMLALLLSGQSAGIVCTIAGQMVSEGFLRWTIRPWLRRIITRSIAVVPCVVVAAAVGKEGLNSALNYSQVALTLLLPFLTFPLIYFTNSKKLMKVARDPSVTADDASETTVLAQWLDYSNHWVLAIVCWALWLFIAILNVYLIVQLGMGNY

SEQ ID NO: 10732 - protein, 482 aa, Frankia sp. CcI3
MTTNTSTSSTTDDLTTGAPNGTGAPDGANGVGGPTGTVGGPGEHPAYEAGFTESANGRVYTVTGSDWEQILGVGEEENERIVVNMGPQHPSTHGVLRLVLEIEGETVTETRLVIGYLHTGIEKSCEYRTWTQAVTFLTRADYLSPLFNEAAYCLSVERLLGITEQVPERATVIRVMVMELQRIASHLVWLATGGMELGATTAMIFGFREREKVLDLLELITGLRMNHAYIRPGGLAQDLPDGAERAIRAFLADMPKRIREYHALLTGQPVWKARMVDVNVLDAAGCIALGTTGPVLRAAGLPWDLRKTMPYCGYETYEFDVPTALEGDSFARYLVRLEEMGESLKIVDQCLDRLRPGPVMVADKKIAWPSQLSVGSDGTGNSLAYIRKIMGTSMEALIHHFKLVTEGFRVPAGQVYTQIESPRGELGYHVVSDGGTRPFRVHVRDPSFVNLQAVPALTEGGQVADVIVGVASVDPVLGGVDR

SEQ ID NO: 10733 - protein, 267 aa, Oryza sativa
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEIKDGSVFFQKAKETQPCKEIPSLQVINQTLSYARELERIV

SEQ ID NO: 10734 - protein, 310 aa, Synechococcus sp. WH 7805
MASSVITAPSPPSRPAASHRAQALATLLRQPRNGETPAAPAEGLHWVTIGFMIVIHSLALLALLPMFWSWQAAASLLVLYWVTACLGVTIGYHRLLSHRSFQLPRWLERFFATCGALSCQHGPIDWVGLHRHHHKFSDTDADHHNSHRGFWWSHMGWMLQPVTAMQAVPRMTGDLVQDPYYRWLNNNFLLLQLPLAGLLFWIGTATGAGGWALVLWGIPLRLVLVYHVTWLVNSATHCWGTVAYDSGDASRNNKWVAALTFGEGWHNNHHAYPHSARHGLQQGQIDLTWEHIRLMRALGLATKVRLPVAS

SEQ ID NO: 10735 - protein, 217 aa, Frankia sp. CcI3
MGILDPYKGFGVTFGTMFKKPTTEQYPEEKKETAPRFHGRHQLNRHPDGLEKCVGCELCAWACPADAIYVEGADNTEAERYSPGERYGRVYQINYLRCILCGLCIEACPTRALTMSNDYELADDSRQDLIFTKEQLLAPLREGMEAPPHPMRLGSSETDYYTRDPDAPLPWQASGQEQVAGQAAELEAADVIARRTAGEHSRADEVPAHGAGSERPR

SEQ ID NO: 10736 - protein, 303 aa, Synechococcus sp. WH 7805
MVTTNPVDSGSQRDLRMRAAVMAPRAPLPQRQRRLKGGTTGFMVVMHVLATVALLPRFWSWQGIATFAVLYWMTVLGVTLGLHRLVAHRSFEVPSWLEKTLVLMGTLACQSGPIEWIALHRHHHRFSDQPNDHHDAGRGLWWSHSEWMLHEIPALEHKERFAGDLLSSPFYVWLDRWFLLLQIPLGLALYWYGNAADVHGGGLGLVLWAIPLRLVVVYHVTWLVNSATHAFGYRNFNCPDLSRNCWWVALLSFGEGWHNNHHAHPASARHGLRWFELDITWMHIRLLQKLGLTRRVRQARYPG

SEQ ID NO: 10737 - protein, 347 aa, Ehrlichia ewingii
FIDGNKGVLRYRGYDIADLVHSNKSFIEIVYLLFHGIFPDVHDLQDFILQISQKYMPPKIVNDVIKSFPQNSCPMAILIACFSALASYYHDQEYGDGLKYIELAVSQIAGIVAMIYRHITDQNFIQANTELSYSENFIHMMFDVSSYKFTKVVSKALDIIFILHADHEQNASTATVRLTGSARANLFACLAAGAATLWGPAHGGANEAVINMLMEIEKPSNVRQFVQKVKNRDKGIRLMGFGHRVYKNYDPRAKIICEICKEVLSDLKVSDPLLEIALELENIALQDSYFIERNLYPNVDFYSGIVLKAIGIPVRMFTTLFALARTSGWSAQWYEMIKGKDYKICRP

SEQ ID NO: 10738 - protein, 248 aa, Coccidioides immitis RS
MSPYRRIKLLLISVFLIVLLILYLTADQRRIQNQRIYQKTVEALDAKHARKVGQQEDDGVMFQKLKPGKLKPEDKQAIAVDRQRYESPVAPKGDSEGEQGGGSVAGRVKVPPSDEKGKDVPKQESDSKEVEIEAEFNSILKRSPIIIFSKSYCPYSRKAKYILLEKYSIVPAPFVVELDEHPLGQELQALLSSNTGRRTVPNVLINGKSIGGGDDIEALDISRELAPKIKQMVGRRLVEAKRIDDKPV

SEQ ID NO: 10739 - protein, 203 aa, Arabidopsis lyrata
SSAKFRRGYDTNVLKPLLSFLRSTSSPFVVNPYPFFGYSIETLDFALFRPNPGLFDQHTKLLYTNMLDAQLDSVYSAMDRLGFSDVEIVIGEIGWPSEGDIDQIGVDVATAAEFNKNLVTRVNSGTGTPLMPNRTFETYIFALFNENLKSGPTSERNFGIFRSDLSPIYDIGIFRPTFRSSNPENNPVSPEKRWCVTKAGAET

SEQ ID NO: 10740 - protein, 230 aa, Escherichia coli
RPVDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 10741 - protein, 272 aa, Oryza sativa
  misc_feature (56)..(56): Xaa can be any naturally occurring amino acid
  misc_feature (188)..(188): Xaa can be any naturally occurring amino acid
  misc_feature (195)..(195): Xaa can be any naturally occurring amino acid
  misc_feature (230)..(230): Xaa can be any naturally occurring amino acid
  misc_feature (248)..(248): Xaa can be any naturally occurring amino acid
  misc_feature (251)..(251): Xaa can be any naturally occurring amino acid
  misc_feature (260)..(260): Xaa can be any naturally occurring amino acid
  misc_feature (262)..(264): Xaa can be any naturally occurring amino acid
MCDDEVAALVVDNGSGMCKAGFAGDDAPRAVFPSIVGRPRHQGVMVGMGQKDSYVXGDEAQSKRGILTLKYPIEHGIITNWDDMEKIWHHTFYNELRVAPEEHPVLLTEAPLNPKANREKMTQIMFETFNSPAMYVAIQAVLSLYASGRTTGIVLDSGDGVSHTVPIYEGYALPHAILRLDLAGRDLXTDYLMKXILTERGYSFTTTAEREIGRDIKEKLCYVALDFEQXMATAAASTSLEKRYEYLXGKXHYGNERFRXPXXXFNIIPGYG

SEQ ID NO: 10742 - protein, 226 aa, Xanthomonas axonopodis pv. citri str. 306
MESLLEGFRHFRKEVYPRQSARFQELAGGQSPHTLFITCADSRVMPELIFSAQPGELFVYRNIGNVVPPYSQHVSGVVAAIEYAIAVLGVRHIVICGHTDCGAMKAVLKPESLEDVPSVAAWLKHTDAARHVTAHHGHDPQSPDALNCMTEENVVSQLDHLRTQPVVAARLAAGTLRIHGWIYDIAHGEIRAFDAEKGGFRPLLAESTPEATPRPRLQQVVRAELA

SEQ ID NO: 10743 - protein, 231 aa, Buchnera aphidicola str. APS (Acyrthosiphon pisum)
MKINQVVLIRHGQSEWNTLNKFTGWHDAELDKKGKDEAKFAAILLKKEKFFFDCAHTSLLKRAIHTLQYILDELNQTWLSVKKSWRLNERHYGALEGLNKDEVIEKYGQKQVLLWRRSFDISPPQINIKDKRFPGNDPRYSHLNIHDIPLGESLEKTAKRVIPYWNKIVYPELKNNKKILIVAHGNSLRALIQHLYKIDNKAILDLNIPTAQPIILDFDNEKNPIKWHYLT

SEQ ID NO: 10744 - protein, 320 aa, Buchnera aphidicola str. APS (Acyrthosiphon pisum)
MIKKIGVLTSGGDAPGMNAAIRGVVRTALSERLEVFGIYDGYLGLYENRMVQLDRYSVSDMINRGGTFLGSARFASFYQDKIRSIAVQNIKKRKIDALVVIGGDGSYIGAQKLTEMGIPCISIPGTIDNDVSGTDYTIGYFTALQTVVEAIDRLRDTSSSHQRISIVEVMGRHCGDLTLAAAIAGGCEFIVLPEIDYKKEDLVIEIQAGIAKGKKHAIVAITEYICDVEELAQYIEKKTNRETRATILGHIQRGGAPVVYDRILASRMGAYSVELLIKGYQGKCVGIQNEKMVFNDIKNALKNMKRTFKKDWLITAKKLY

SEQ ID NO: 10745 - protein, 180 aa, Liriodendron tulipifera
MFPMMTGFMNYGQQTVRAARYIGQSFMITLSHANRLPVTIQYPYEKSITSERFRGRIHFEFDKCIACEVCVRVCPIDLPVVDWRLETDIRKKRLLNYSIDFGICIFCGNCVEYCPTNCLSMTEEYELSTYDRHELNYNQIALGRLPMSVIGDYTIRTIMNSTQIKIATDNPLDSRTITNY

SEQ ID NO: 10746 - protein, 255 aa, Buchnera aphidicola str. APS (Acyrthosiphon pisum)
MKKFFITANWKLNGNIKMISSFFKYLKLYSSSYLEKNTVIIAPPTIYLERVCKNISNMNIFLGSQNVDINLNGAFTGETSILMLRDIGVKYVIIGHSERRFLHHETDDIIAKKFHLIKKSNLTPILCVGETEIEKKHNQTEQVIQRQLNLILKNLGTSAFKNIIIAYEPIWAIGTGVSADPEHVQLIHVFIKNYILKYSSINRNDIIIQYGGSINHTNVKKFIEQPDINGLLIGNSSLSAKEFLEIIKIAHEHYS

SEQ ID NO: 10747 - protein, 402 aa, Propionibacterium acnes KPA171202
MIATMDRSVVGAIHGRMGTTRHRSGVVMSKKKKVGILTAGGDCPGLNAAIRGFGKAAIRQHDMELIGIQDGFLGLAGNRTISLDPRALSGILTVGGTILGTSRDKVNHMIIDGEERDMVPTIVENYEKLGLDALVTLGGGGTAKNAYKLAKAGLNVLHLPKTIDNDIVGTDDSFGFSTALEIATEAIDRLHSTAHSHHRIILAEIMGHRAGWLALGSGIAGGADVILLPEVPYKLDSIVQAVENRQKQGLNFSVIAVAEGARDEADSAAMAGAQALVDASKTSETKAAAKKAKKDLEHSMRDNTLKLATQLEEATGLESRVSILGYVQRGGIPCAHDRLLATRLGTVGAKLVDDGEFGIMVAAQGGDATTVPLKDVAGKVKYVPADHPWVKAARQVGTGLGD

SEQ ID NO: 10748 - protein, 393 aa, Liriodendron tulipifera
MTVPDIRKDFMIVNMGPHHPSMHGVLRLIVTLDGEDVIDCEPVLGYLHRGMEKIAENRTIIQYLPYVTRWDYLATMFTEAITVNAPEQLGNIQVPKRASYIRVIMLELSRIASHLLWLGPFMADIGAQTPFFYIFRERELLYDLFEAATGMRMMHNYFRIGGVAADLPHGWIDKCLDFCDYSLTGVVEYQKLITRNPIFLERVEGVGIIGGEEAINWGLSGPMLRASGIQWDLRKIDHYECYDEFDWEVQWQKEGDSLARYLVRISEMAESIKIIQQVLEGIPGGPYENLEVRRFDKARDSEWNDFEYRFISKKPSPTFELSKQELYVRVEAPKGELGIFLIGDNSVFPWRWKIRPPGFINLQILPQLVKRMKLADIMTILGSIDIIMGEVDR

SEQ ID NO: 10749 - protein, 355 aa, Gibberella zeae PH-1
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 10750 - protein, 1135 aa, Zea mays
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSVALHKAAAFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFYEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPTELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKQISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREADTSSFIILMEFPVAQLSSKRSKPSTSKF

SEQ ID NO: 10751 - protein, 563 aa, Haemophilus influenzae 86-028NP
MRLKFQLFLMKGNTMKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRTTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 10752 - protein, 206 aa, Brassica napus
MQAVIRSFVSGGNVVRSSLLQHLRVVNPAIQPSVLSTRYESTQPARMEEHGFESTTISDVMNAKGKSADGSWLWCTTDDSVYDAVKSMTQHNVGALVVVKPGEQQSLAGIITERDYLRKIIVQGRSSKSTKVGDIMTEENKLITVTPETKVLVAMQLMTDNRIRHIPVIKDKGMIGMVSIGDVVRAVVTEHREELNRLNAFIQGGY

SEQ ID NO: 10753 - protein, 331 aa, Magnaporthe grisea 70-15
MEPASRRHFFKHGGQDPSIGLNSAEIQECHWCQLRSFANHEKYPISIINTTKDGASLPPDFRFISERILGEGVSRAEASFLSGCECTSNEDCMYGGCECLSDLPDSGLESDGDADFRRSRNNRIKKFAYYSSGERAGLLRESYLDTRTAIYECHEQCSCGPDCPNRVVERGRTLPLQIFRTDDGRGWGVRATVDIKCGQFVDTYIGEVITDSEAVERRKATRKKDLYLFDLDKFWEVIQDDQSRLVIDGEYRSGPSRFFNHSCDPNMRIFARVGAHAELNLHDLAFFAIRDISNGEELTFDYVDGQVLPDGESLDDECLCKSTNCRGVLWS

SEQ ID NO: 10754 - protein, 233 aa, Oryza sativa
  misc_feature (85)..(85): Xaa can be any naturally occurring amino acid
  misc_feature (108)..(108): Xaa can be any naturally occurring amino acid
MDAGDAWGRSSSSSSSAAAAARRLQARYDLYMGFDDADAAGVEEVEARGGGEAYNCPFCGEDFDFVAFCCHVDDEHAVEAKSGAXVRKISSGSHSLLSLLRKDLRDGXLPVAEPSKDLHSDSSDNNFLLNKFPDDKTAERAEPSLSEKDQKERAQRSKFVRGLVLSTIFEDDNFAATPPHAWTHRLRLDLLLPYARRRHGRRRCHRCNDDEDDLYDDGEDMRWESMFQDLKPT

SEQ ID NO: 10755 - protein, 453 aa, Staphylococcus epidermidis RP62A
MKYIVVGTSHSGYEVIQTLLKEDENADIQVFESADQPSFLSCGIQSYLEDISSSLDDLHYASVDSYKAQGVNIHTNSTVTDLDTDNKTVVVEHQGQTATYSYDKLFLSPGGKPVTPPVDGIEKYKHVLFMRGRDWANQIKERMKYAKKAVVVGGGYIGIEAAEAFAKAGIDTTIVDVADRILNTYLDKEFTDVLETNAQQHGLHFKGGETVQSLSGNQNGEVTTVVTDKNEYDADTVLFAVGVEPATEWLKDKIDLGKKGIININHQQQTSAKDVYAGGDATLVPFAPVSEDRYIALATNSRRQGVVAAKNMLGKEMTMPRVSGTSGLQLFDYKFGQTGIHGTEIDNYDGNLGQTYVEELIRPQFMQDDTKIHMKIIYDKDTHRILGGQVMSKEDITASINTISVVISAGFTLEQLAVQDFFFQPDYDRPWHYLNVLAQQALGDTFGSDKMLF

SEQ ID NO: 10756 - protein, 338 aa, Frankia sp. CcI3
MSAIGLDVVGIRTDPDLEKAVRVGLARVEDLLRESVRSESAFVTETSRHLVDAGGKRFRPIVVLLAAQFADPEAVGVVPAAVAIELTHLSTLYHDDVMDEAPRRRGAASANTRWTNTVAILTGDYLFARASDITADLGPEATRILARTIATLCEGQIRETVGPAPGQDPVEHYLRVITDKTASLIATSGRLGAMLAGADPITVDTLATFGELFGVAFQLSDDIIDVASDPVDSGKTPGTDLREGIPTLPVLYALQADDRAAGRLRELITTGFAPGDGNTEDRVGEALDLLRGHVGMARARAELISWSSRARECLASLPDNPAKTALESLADFVVDRTG

SEQ ID NO: 10757 - protein, 185 aa, Arabidopsis thaliana
MISCGEDTSQGLCELPDLGSLQSGQQLLDKAFYECEQDLMMKSAMESPFSDVLDIKNISVVTTINENQDMQKSVSSGNLSSMDWSHAQQETVMIQNFPDFDFGYGMRRAFSEGDIQKLGAGLVQSPLDRIIVSCTSEDRREKLSRYKNKKSRRNFGRKIKYACRKALADSQPRVRGRFAKTEERK

SEQ ID NO: 10758 - protein, 230 aa, Methylobacillus flagellatus KT
MNDKQLVAIQAAQHVQDGMVVGLGTGSTANYFIEELARRHRDEGLHITAAASSVASTIQAQTHGLPLVALEHLGRLDLYVDGADEVTTNLALLKGRGYDLVREKLLARASERFIVLVDKSKLVGHLGEKFPIPLEVIPFAWQLVQASLQQLGIASSLRQNAAKDGWAITSHGSLVLELTLPKTFKSDELNRLLNDIPGIVEHGVFDELADAVFVADNGQVEEIWKRPGNI

SEQ ID NO: 10759 - protein, 381 aa, Lactobacillus acidophilus NCFM
MSTEMLGLILAGGKGTRLGKLTSDQAKPAVPFGGRYRIIDFTLSNCANSGVKNIGIITQYQPLLLNEHIGNGVSWGLDGLNASATILQPYTDNSGSKWFEGTAHAIYQNIDYIDSKDPEYVLILSGDHIYKMDYESMLEEHIKNGASLTVAVIDVPMKEASRFGIMNTDVSGRITEFEEKPEHPKSNHASMGIYIFNWKRLREVLTTGFTTNDDMVDFGKNVIPYYLKSDERVFAYHFSGYWKDVGTIDSLWAANMEFLDGSDGLNLYDRSWRIYSKNPIDPAQVITENAEVNNSMIVDGCYVDGTINHSILSTDVDVQRGSEITDSVIMPGVKIGKDVVIKHAIVGENAQIGDGAVVEGNKDNIKVIGNSERIGVLPNED

SEQ ID NO: 10760 - protein, 347 aa, Salmonella typhimurium LT2
MKLALVNRQVILPESGTESFQCHASTLVRLPCGTLVAAWFAGLREGSEDTAIWLSRYEHNIWTTPQRVAAREGEAHWNPVLFYPSDKLWLFYKVGSDVHVWKTWFITSSDRGFTWSTPAPLVNDDILPRGPVKNKLLLASNGAWIAPGSIESPERWRAFVDRSSDEGKHWSISFVPLEPDNAISGTNVALWDGIKKGRLWECCLENLLRWDGVIQPTLWESSPGHIHMLLRSTRGAIFRSDSIDYGATWSVARATSLPNNNSGIDLVSMQDGTLILALNPVNGNWGKRYPLSLIASQDNGESWLPLLDLESDHGEYSYPAIISEGGIVHITYTWNRKNIVYCRLQTV

SEQ ID NO: 10761 - protein, 351 aa, Arabidopsis thaliana
MDEKDILRNLREEEEEEEENQSEETKILISSLPWEIDYLGNKLFKYQGYWYYEDVLQSIPNIHSSFQPQETDIVVASFYKSGTTWLKALTFALVQRSKHSLEDHHHPLLSHNPHEIVPYLELDLYLNSSKPDLTKFLSSSSSSSSPRLFSTHMSLDALKLPLKKSPCKVVYVCRNVKDVLVSLWCFLNANKGVEWGDFSQNEKIIRAENYSFKAIFESFCNGVTLHGPFWDHAQSYWRGSLEDPKHFLFMRYEELKAEPRTQVKRLAEFLDCPFTKEEEDSGTVDKILELCSLSNLSSLEINKTGSLGGVDYKTYFRKGQVGDWKSYMTSEMVNKIDMIVEEKLKGSGLKF

SEQ ID NO: 10762 - protein, 403 aa, Arabidopsis thaliana
MATTISNLPRELIEEILSRVPLRAMKAMRLTCKSWNNLSKSESFMKMHIGKAATREEKTMMVAVMPHTLALVSVVVDGVNPSTELKGQFSFLDKEFFIYRVIHYEGLLLCILKDATRIVVWNPYLGQERWIQIRYSHRPHGVDHFKYAVGYADKVSCRSVKLLRFLDYFHKASDKPFFWYEIYDFDSCLWTTLDITPHWGISWTYPRVSLKGNTYWPAREMNTKGFQDHIICFDFTSERFGPLLPLPRAQGCHVSLSCVKEEKLAVLLKHRLHHDSYEYEFEIWITTKIDVEMVSWSKFLRMDMRPKIKLPLSFYVDEEKKVFMGFDHGEYPKLFLNIIGETGFLRKLDLGVHEGHRSPCSYVPSLVQIKHPAGDKMIKQSSLEDRRFAQNSLRLAAIEKLIN

SEQ ID NO: 10763 - protein, 422 aa, Agrobacterium tumefaciens str. C58
MNHFGYIDGVLHAENVPVPEIAKAVGTPFYVYSTATLERHYKVFSGAFADVDAMVCYAMKANSNQAVLKTLAKLGAGIDVVSGGELRRALAAGVPASRIMFSGVGKTVAEMDYALEAGIYCFNIESEPELEVLNLRAVKAGKRAHVSFRINPDVDARTHAKISTGKKENKFGISYERARAVYAHAATLPGIEVTGIDMHIGSQITELQPFEDAFRLLRELVEVLRTDGHAISHVDIGGGLGIPYRDDNNPPPLPDAYAHIVKNELKSLNCKIVTEPGRLIVGNAGILVTEVIYVKDGGDKTFVIVDGAMNDLIRPTLYEAYHGIRPVVQPSENAPRIKADIVGPVCETGDYLALDREMAAPQPGDLIAVSSAGAYGAVQAGTYNSRLLVPEVLVKGDRFHVIRPRGTYEELIALDSVPAWLD

SEQ ID NO: 10764 - protein, 238 aa, Oryza sativa (japonica cultivar-group)
MEDYHVAEYKYDKSHELGLFAIFDGHLGDSVPSYLKANLFCNILKEPIFWTNPQEAIKNAYRSTNKYILENAKQLGPGGSTAVTAIVVDGKDMWVANVGDSRAVVCERGAANQLTVDHEPHTTNERQRIEKQGGFVTTFPGDVPRVNGQLAVARAFGDQSLKAHLSSEPDVRHVPINSSIEFVILASDGLWKVMKNQEAVDLVKSIKDPQAAAKRLTTEALARKSKDDISCIVIRFRC

SEQ ID NO: 10765 - protein, 466 aa, Escherichia coli
MGQSSQPHELGGGLKSRHVTMLSIAGVIGASLFVGSSVAIAEAGPAVLLAYLFAGLLVVMIMRMLAEMAVARPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIGKILRAEGSEIRLRMWLYPWLTWLVIGFITFVLVVMLFRPAQQLEVISTGLLAIGIICTVPIMARWKKLVLWQKTPVHNTR

SEQ ID NO: 10766 - protein, 296 aa, Pichia jadinii
MSTPEYSTSAKSRFDITNLTTDPFVVATWSVAMISWVIAFIGSIVANIEGSFPRFTWWGLVFQLLMLVFLPAVYCFDVVEWYRLFLTCGYSIAFIYTTNSATNLVWSGGSATGAASAGVILLSMVNLIWVFYYGSDNASPINQWIDSFSLRGPKRSSVSPFHNSRPISHDKYSGSENDEFKHSSWNNQRYMSSTALSGLENVSQGDTLETTPFNSPDHDGLGTNITAGGTNITIDEFPYTARALYNYQKSPDDENEISFEKDEILKVNDIHSRWWQAKRANGEIGICPSNYVELIE

SEQ ID NO: 10767 - protein, 356 aa, Dehalococcoides ethenogenes 195
MANKRDYYEVLGIERSASDEDIKKAFRKMAMKHHPDRNHEDGAAEKFKEINEAYEVLSNPEKRAAYDRFGFSAGSDAFGQGGFENFDFGGLGSIFETFFGGATQSAKRGPRRGPDMSYDIRITLEEAATGVEKEITTERLEYCSECSGTGAKAGTSLVKCTNCNGTGQVYQVQKSVFGRFTSVTPCPKCRGEGTIIGEPCAKCRGTGKEYVKRTVQVKIPAGVADGNQIRLNGYGGVGDKGASAGDVYINVSIASHADFKRDGDDVIYELEINFAQAALGTEVNVPGLSTSHKLKIPSGSQNGKYFVLKGKGIPHLNRFGSGDEMVHLNVVTPEKLSRKQKQLFEELEKSFAEDKK

SEQ ID NO: 10768 - protein, 329 aa, Schizosaccharomyces pombe 972h-
MSSLRLRLKYENQSAVETVEANATVGSFLDLVAAKFSLPRNSIALKFGFPPQDIPLVNSDVPLSTLVSSGQQILVLKNAATSFSTNEPAKPPIPNAATKPTFPPQTEISNPPAVSHQSKNTSQDPPYVSTPIGDIALRVMPDDNSCLFRALSKPLGFSPYELREIVANQVLSNPDIYSTAILGKPSIEYASWIRKETSWGGYIELSILSSHFGVEICSVDVKTGRVDSYNPQPATGQRTYIVYSGIHYDLAALAAVLWDTDVDVVLFDASDVTITPYVQQLASLLKNMHYYTDTASFSIRCTICGTGLVGEKDATAHALATGHTQFGEY

SEQ ID NO: 10769 - protein, 339 aa, Cryptococcus gattii
MSVPCISLHNFDKRRDEIIKELMDASMNVGFFTLCNHGISPEDVQAAFDLSREFFALPDEIKSKTPLNGKNAGWEKNTQVRPSTGTADQKESMQLQFARMEGLWPSDEDVPGFRARAEKFMNQVQALSVNVMECFADGLGLPHDIFTDGTVECGENDCQNVLRLLLYHATEGKHFGPNFWRAGAHADFDILTILFQRDGEGGLEVCPGRKVVGDFGMGQTWIPVEARQDKIVCNIGDQLMRWSDDRLKSTYHRVRLPEGNERQGPRFSIAFFNQSRTNTVIQGPQKKYPPITGGEFIAEAIAKNRMQSAEIARQAALENAEKVATEVHFVPKHLSAAAA

SEQ ID NO: 10770 - protein, 177 aa, Triticum aestivum
  misc_feature (12)..(12): Xaa can be any naturally occurring amino acid
  misc_feature (64)..(64): Xaa can be any naturally occurring amino acid
  misc_feature (96)..(96): Xaa can be any naturally occurring amino acid
  misc_feature (162)..(162): Xaa can be any naturally occurring amino acid
MGPPVMASLATXRGRFQGCKSSAALPVSARSNGASLGGVSNGGRIRCMQVWPIEGIKKFETLSXYLPPLSTEALLKQVDYLIRSKWVPCLEFSKVXGFIFREHNTSPGYYDGRYWTMWKLPMFGCTDATQVINEVEEVKKEYPDAYVRIIGFDNMRQVQCVXLIAFTPPPSEESGKA

SEQ ID NO: 10771 - protein, 315 aa, Bacillus clausii KSM-K16
MDVVSIGETMVLFASKEDGQLRYASNFSARVAGAETNTLIGLAKLGHKTGWISRVGADELGAKIIQSVRGEGVDTTYVAMDEQAPTGLFLKEQTTVKTANILYYRKGSAASRLEPADINEDYVKNAKFLYLTGITPLLSKSCEQTTFVLIEMAKKHHVKIVFDPNIRKKLLTEEKQKHLLERLIGTADIVLPGYGEGHYLFGTNNSEEIADRCLQLGAQLTVVKLGEKGAYYKSTDQSGYVAPIPVKEVVDPIGAGDGFAAGVLSGLLDGLAIKEAVGRGCAIGAFVTQVHGDIEGLPSRQTLHAFQQNREDVNR

SEQ ID NO: 10772 - protein, 361 aa, Oryza sativa (indica cultivar-group)
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNNQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIQ

SEQ ID NO: 10773 - protein, 313 aa, Triticum aestivum
MVDRPNKPSALASTPAAPPQAVADITHDNSRVKAVLPSGESVEVLLHGATVISWKDASGAEKLWVSETAALDGSAPVRGGIPIVFPVFGTAPDHEPVAKLPQHGFARNSRWEFLGKSTSEGSSSSVKLDFGLSSESISDDFKALWPYKFALIYSVSLDSESLNTSIVITNDGDAAFDFQTLLHTYFKISDIASTEVTGLEDSVYLSKVSGSEATQSGAITFSGETDSVYTPANGPKHPVVISESGSPRYRIVRDNLDQVVVWNPWVDKSAGIKDFSPKDGWKNMLCVEPGSVKGRQKLEKGDAFEAAQTITLA

SEQ ID NO: 10774 - protein, 887 aa, Oryza sativa (japonica cultivar-group)
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 10775 - protein, 288 aa, Oryza sativa (japonica cultivar-group)
MVGGGGGGEAAMSPPSGGGKRGRDPEEDVYVDNLHSHKRYLSEIMASSLNGLSVGDSLVDNIMESPARSENTSYFRDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVSYQMPENSYGRPEHDIDYIEDCTPHGCLSDLKFKQEDKDCSKLTSMDKNR

SEQ ID NO: 10776 - protein, 471 aa, Mycoplasma mycoides subsp. mycoides SC str. PG1
MYKFKALLDGKLFDNNRILEIINPVDFSVAGQVVSLTKQDINDAFIAAKSSQKAWENTDLEKRISILDKWKQLIDQNKEELAQIIMSETAKPYKDCLTEVIRSVEYIDQTFYEVRNLKTLIIDGAKYGAKNKIGTFMRVAKGVGVAISPFNYPINLAVSKIFPCLVTGNTIVFKPATQGSLIGAKLGELAYQANLPKGIFNVVTGRGREIGDDIITNKLADFISFTGSVEVGKRLLEISSTKDVVLELGGKDPAIVLDDLDLEKYAKEIISGAFSYSGQRCTAIKRVITTDKIADQLVPLLKEKINKLTVGLPKDNCDITPLIDQKTADFVYGLIDDAKKKGAKIIIGDKQEKNLIYPTLVDHVTSDMRLAWEEPFGPVLPIIRTNSVDQMIELANKSNFGLQASVYTKNLDQALTIAQKLEVGTVNINGKSQRGPDVFPFLGVKDSGFGVQGIVDTLLFLTRYKGIVINN

SEQ ID NO: 10777 - protein, 251 aa, Glycine max
MKSGLKNGWPSVVRLRLRDKSVTPFCIFSKVKSAGNIPGNTPVYLNVYDLTTVNGYMYWAGIGIFHSGVEVYGVEYAFGAHDYPTSGVFEVEPRQCPGFKFRKSIFMGTTNLDPFQIREFMERQSANYNGDTYHLIVKNCNHFCEDICYKLTGNSIPKWVNRLARIGSFCNCILPDALKTSTVQHDDPNFQGCDSEKRRLRTAFSCLSSISMPQKEVSMSSLFMHSHYKGCLPPWELKKSKKGSLKQKLED

SEQ ID NO: 10778 - protein, 237 aa, Triticum aestivum
  misc_feature (198)..(198): Xaa can be any naturally occurring amino acid
  misc_feature (211)..(211): Xaa can be any naturally occurring amino acid
  misc_feature (214)..(216): Xaa can be any naturally occurring amino acid
  misc_feature (221)..(221): Xaa can be any naturally occurring amino acid
  misc_feature (228)..(228): Xaa can be any naturally occurring amino acid
MAAANLLSRSLVPSLTPNPGSQPSRSRAASVSLRRRHGPAAPLRASLSTASPSTRVAMGEAPKHCFQRGADGHLYCEGVRVEDAMAAADRTPFYLYSKPQVVRNFTAYDKALQGLRSIVGYAVKANNNLSVLQLLRGLGCGAVLVSGNELRLALRAGFDPTRCIFNGNGKTLEDLILAAESGVFVNIDSEFDLGDIAXSARVAGRPVPVLXNIXXXVDPQXHPYVAIXNKPSKFGIR

SEQ ID NO: 10779 - protein, 165 aa, Oryza sativa (indica cultivar-group)
MAWTAAAATVTRAAATPAAELRLPLAAGLGRASFAVTGRLRRAVSASLSTAAAAVKKEAVQTEKAPAALGPYSQAIKANNMVFVSGVLGLNPEVMKNMGEILKASGASYSSVVKTTIMLADLQDFKKVNEIYAKYFPAPAPARSTYQVAALPLNARIEIECIAAL

SEQ ID NO: 10780 - protein, 115 aa, Streptococcus mutans UA159
MNPLIQSLTESQLRTDIPNFRPGDTVRVHAKVVEGNRERVQIFEGVVISRKGQGISEMYTVRKISSGVGVERTFPTHTPRVEKIEVTRHGKVRRAKLYYLRALQGKAARIKEVRQ

SEQ ID NO: 10781 - protein, 192 aa, Arabidopsis thaliana
MFAVENGLQGDPRLKAISDAIRVIPHFPKTGIMFQDITTLLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 10782 - protein, 484 aa, Arabidopsis thaliana
MAESSEEPKVSLRLFIDEEKNKVVLAEASKAFVDVLFSLLTLPMGTIIRLLEEHRESQPITVGCFSNLYRSVAEMGIDNFKTDVCKHILLHPRSVRDLQYKRLMLNINPTEVKLFKCPISCNFYSHFSTSRCQCGSSMNKEFQEPRVVPVASSIQNDVNGVFIITDDLKVAVRSTDVVLNELKSLGSGDISKLREMLVYIGFEEVLTLLECMFSSKAPLTNTFLNKQTFQGQGVTKVYETLSPCMETNGDTFLTLDVIVRKQDMEILYVECGEDFVDLLFTFLAVPLEYVVGISGNSCSFVCIRNLIRSFKDLNAAEVSTSKSAIHHFYTCQKQLLNIITDQPPLYHRYNYYSLKECSGSTPLILIDPEGSGFVKRETKFTVSDDLIVTAMNSSSPICLLQKFQIHADDLEVQQISYEFAESFLGNILCIENFFKELDFEEPRGRDLKKQREILASLMRASLLTSSALNSALWNLIAKKIKDET

SEQ ID NO: 10783 - protein, 415 aa, Eremothecium gossypii
MSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 10784 - protein, 511 aa, Cryptococcus gattii
MFARQPLSQHLLRPLSRPSSSFSRPSTLPKLAFLQSARGFASASEPYDVVIIGGGPGGYVAAIKAAQLGFKTACIEKRGALGGTCLNVGCIPSKAMLNNSHIFHQTQHDLKNRGIDVSGVQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGSIGAGMDGEVGKQFQRILTKQGFKFKLNTKVVSGHREGDIVKLKVDSAKGGKEETIEADVVLVAIGRRPVTKGLNLEAIGVETDKKGRIVIDNEFNTSAKGVKCIGDVTFGPMLAHKAEEEGIAAVEILKTGHGHVNYDAIPSVVYTHPEVAWVGKNEEELKAAGIQYKIGKFPFAANSRAKTNQDSEGFVKFIVEKDTDQVLGCHIIGPAAGELIAPAVLAMEYKASAEDIARTCHAHPTLSEAFKEAALSSYDKPINF

SEQ ID NO: 10785 - protein, 519 aa, Medicago sativa
MDSLLKFPIMVNLKEEPFLMAIMVIVPLTLLLGLMSRILKRPRYPPGPKGLPIIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDYAVRTVSDNIGNPVNIGELVFNLTKNIIYRAAFGSSSREGQDEFIGILQEFSKLFGAFNISDFVPCFGAIDPQGLNARLVKARKDLDSFIDKIIDEHVEKKKSVVDEETDMVDELLAFYSEEAKLNNESDDLHNSIKLTKDNIKAIIMDVMFGGTETVASAIEWVMAELMKSPEDLKKVQQELAEVVGLSRQVEEPDFEKLTYLKCALKETLRLHPPIPLLLHETAEEATVNGYFIPKQARVMINAWAIGRDANCWDEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 10786 - protein, 496 aa, Arabidopsis thaliana
MGEMIDLFLLALMAGFIAVAYVFRSKQKKNLPPNPVGFPVIGHLHLLKEPVHRSLRDLSRNLGIDVFILRLGSRRAVVVTSASAAEEFLSQQNDVVFANRPLATLTEYMGYNNTLVSTAPYGEHWRRLRRFCAVDILSTARLRDFSDIRRDEVRAMIRKINVELVTSGGSVRLKLQPFLYGLTYNILMSMVAGKREEDEETKEVRKLIREVFDFAGVNYVGDFLPTLKLFDLDGYRKRAKKLASKLDKFMQKLVDEHRKNRGKAELEKTMITRLLSLQESEPECYTDDIIKGLVQVMLLAGTDTTAVTLEWAMANLLNHPEVLRKLKTELNEVSKEGRVFEESDTGKCPYLNNVISETLRLFPAAPLLVPHASSTDCEVAGFDIPRRTWLFINAWAIQRDPNVWDDPETFKPERFESETHRGKFLPFGIGRRACPGMGLAQLVLSLALGSLIQCFDWERDNDVAVDMSEGKGLTMPKSVPLVAKCKSLPILDKLVL

SEQ ID NO: 10787 - protein, 519 aa, Medicago sativa
MDSLLKYPIMENFKEEPFLMAIMFILPLILLLGLVSRILKRPRYPPGPKGLPVIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDHAIRTVSDNIGNPVNIGELVFNLTKNIIYRAAFGSSSREGQDEFIGILQEFSKLFGAFNISDFVPCFGAIDPQGLNARLVKARKDLDSFIDKIIDEHVQKKKSVVDEETDMVDELLAFYSEEAKLNNESDDLHNSIKLTKDNIKAIIMDVMFGGTETVASAIEWAMAELMKSPEDLKKVQQELAEVVGLSRQVEEPDFEKLTYLKCALKETLRLHPPIPLLLHETAEEATVNGYFIPKQARVMINAWAIGRDANCWEEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 10788 - protein, 128 aa, Triticum aestivum
  misc_feature (10)..(10): Xaa can be any naturally occurring amino acid
  misc_feature (20)..(20): Xaa can be any naturally occurring amino acid
  misc_feature (57)..(57): Xaa can be any naturally occurring amino acid
  misc_feature (73)..(73): Xaa can be any naturally occurring amino acid
  misc_feature (86)..(87): Xaa can be any naturally occurring amino acid
  misc_feature (100)..(100): Xaa can be any naturally occurring amino acid
  misc_feature (104)..(104): Xaa can be any naturally occurring amino acid
  misc_feature (107)..(107): Xaa can be any naturally occurring amino acid
  misc_feature (114)..(114): Xaa can be any naturally occurring amino acid
  misc_feature (116)..(116): Xaa can be any naturally occurring amino acid
  misc_feature (118)..(118): Xaa can be any naturally occurring amino acid
  misc_feature (120)..(120): Xaa can be any naturally occurring amino acid
VISLIPYTFXALVIKSAIRXKKNVVTTSYVSPAMLELDEEAKLAGITVLNEIGLRSXGLDHLYAIKTIEEVHXAGGKINSFNSNCXXGYLHLRRLDNPIXYKFXSWXSRGVLLXLXNXAXIPRKGQNL

SEQ ID NO: 10789 - protein, 375 aa, Prunus salicina
MTVRLRKKEILIDILVRLPAKSLVRFLCTSKSWSDLIGSSSFVSTHLHRNDTIHAHVYLLCLHPSNFEWAVDPDDPYVKQELQWSLFSNETFEKCFELRHPLGSTEHYGIYGSSNGLVCISDEILNFDSPIHIWNPSIRKFRTPPMSTNINIKYSYVALQFGFHPRVNDYKIIRMMRTNKDAFTVEVYSLGTDSWKMIEAIPPWLKCTWQHQMGTFSNGVAYHIIQKGPIFSVISFDSDSEEFQEFIAPDAICSSWGLCINVYKEQICLLFRFYGCEEEGMEQVDFWVLQEKRWNQLCPFIYPRSCYRIMGISINNELILQKRDLNKGVAYLYLCNYKSKQVLETGITLAIVTYDDIEFLFSITYIQSLVLLNNY

SEQ ID NO: 10790 - protein, 1362 aa, Ustilago maydis 521
MNPSYTERRASAHPTMSSSAHHASSTPSAASIDPTTSHAISSGIPITSPAALSYFAAHPRRQQVHFGNYLLLQTLGEGEFGKVKLGVHKEWGEEVAVKLIKRDKVANDAAPLHLDDSAQKDPAKMSKVEREIQVLKDVRHPNIVRLYEVIESDRYIGIVLEYASGGELFDHILAHKYLKEEHACRLFAQLISGVSYLHHKKIVHRDLKLENLLLDRNRNVIITDFGFANNFEHKRNDLMATSCGSPCYAAPELVVQDGLYAGSAVDVWSCGVILYAMLAGYLPFDDDPANPDGDNINLLYKYILATPLSFPEYITAQPRDLLSKMLVPDPTRRATLEQVMQHSWLRHYRELFKFSVDDLERAAMEQQTKKRQMYRQQMMYQQQLQEQQRRQQMERSQSVRHNVSHLPVGTAYTANTAVSAVSAANVAHRQTLPISATVPDRLYEPIGSASRGADHSVTPQRAPTASSHQPPVAPTASADAAIAPLPRASTHNNVAAAADAAAAVAAAPSPVDPVTALGNARGEPRTRLDDAVPTIAAAYETEPRQLAAQKVQRHTIQLEYGGDERPRKESAPGSRQASQTQRNASASSTSSKLAEIERTKTAADKPAANANAIVPPSVLQSTSVQVPATSVVVPESEKANISKAGAPDMMRSVSASAASRVSVPPPIMEQTQPSVSAHRSTQPTSSSRVRAPSSASRNNADSGSTGHATRIPTSASQRVVSTSSAASEPVGFPSSATERTIPSADADAAAGRISASRRASNGAEITEPSHRSPSATRHATADNAPVTSASASARHRKGMSTDKFFLSRLLGSNSANQPNGAGVAGDKVSANGSDAAGDKTKRDSMNRPAPERAPSSSSTGKNGRRKAMSLVVGHASGEASSAAADRNRALKAGMPHSATRATFGTQVSGKADDSVSSAQKQRKGSASLASQTTSTSRAAQSSTRPQPLQPSLQQQQQQQDKAFNDGSTIASSSTAGPSSNAAKKVMDWFRKKSLSRGTFNEQPPLGLFERSPTSSYMHGSASQTPSVIVTSAPNGTSRHAEAPSGGSSVPSSRSTSGTHSENSEATEMTQLTNLSDASHQEGDGLKSSASTVQQQATPKASLSAVSNVSDASAAGSLVSTRSQQQQRPQPRVATATSASTTPARFNEARLRYHLGAVDQSALTSRSPIEVLKEVQRVLYEMGIDVRTEKDEDFKLECVRRKRAKTLMSATHGFGMSIRSSVFPPTQADVERSSRMSHRDSLTPSASSPGGGSLRSFLKRSSLQPGATSPKMGSSTLPSSATVTSNLGGAVHDENQPPPLYGDASVDGGQEIRFSVEVTRIKNLTGLYSLDIRRMKGNLWAYKFVYQALLDRCQLGSSTAAVG

SEQ ID NO: 10791 - protein, 325 aa, Prunus salicina
VRFLCTCKSWSDLIGSSSFVSIHLNRNVTKHVHVYLLCLHHPNFERQNDNDDPYDKEELQWSLFANETFKHFSNLSHPLESTEHYMIYGSSNGLVCISDEIMNFDSPIYIWNPSVRKFRTTQMSTNINIKFSHVALQFGFHPGVNDYKAVRMMRTNKGAFVVEVYSLRTDSWKMIEAIPPWLKCTWQQLKGTFFNGVAYHIIEKGPIISVISFDSGSEKFEEFIAPDAICDTWGLCIDMYREQICLLCRCYGCEEEGMEKVDLWVLQEKRWKQLCPFTFPLDEWNVTIGITKDYELLMEIRDFDNGVADLYLCNYDSKEVLKTGI

SEQ ID NO: 10792 - protein, 676 aa, Kluyveromyces lactis NRRL Y-1140
MALGRYSALLFMVPRIFALPIFKRSVLSVLQKEAPPAEDEATFTTFLVISMILVLLGGIFAGLTLGLMGQDEVYLKVMQTSGTASEKYHANRVLSLLNRGKHWVLVTLLLSNVITNETLPIVLDRCLGGGWQAVVMSTVLIVIFGEIIPQSVCVRFGLQVGSLFSPFVLFLMYAMYPIAYPIALLLDWLLGEDHGTIYKKSGLKTLVHLHRTMGMERLTLDEVTIISAVLDLKEKKVSEIMTPIDAVFTLSADKILDEKTVEDIFNSGFSRIPIYLPGQPTNYIGMLLVRVLISYDPDDCLPVSHFPLATLPETAPQTSCLNILNYFQEGKSHMCVVSRDPGSSSGAIGLVTLEDVIEELIGEEIVDESDVFVDIHQRIMRDQPGPLSKRHITSYLHSLYTRKPSETQPLVNENAESSEASGKNETTNYLSVGATNFQPANPAANPLDIKKPFVTIKRQSYGGMSRTPPRLSSEPISPATSVIETTSPIRREPDAISPVGSAPTTDEKRKYVSHHNHRHRSNSSRRSNSAMVQQQQPRPTSNKSNDKLITTIPAQNDKDHQTVISSSYKSTRNGIVESIITVKGVSKTIIEPASDWDDSKKVTINETENIAEEHNESSSIDSNTTNTHAHPRSPSSRRGSRFSLWSSKSSQNDQDSNAKQLSKSQESFNLESRSKD

SEQ ID NO: 10793 - protein, 224 aa, Oryza sativa (indica cultivar-group)
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMACDPAVGGGEDDNDGEVQLWSY

SEQ ID NO: 10794 - protein, 480 aa, Polytomella sp. Pringsheim 198.80
MLSFKSDTSIFSGRKGPCANLFPPVSRKLNNAKPILMKAASKLVTTKSEEIFNEALELLPGGVNSPVRAFRSVGGKPIVFSKVKGARCYDVDGNSFLDYVGSWGPAIVGHAHDEVNAAIIDQVSRGTSFGAPGPLENELAKVVISRVPAVEMVRFVSSGTEACLSVLRLMRAATGRDGLIKFAGCYHGHADSFLVKAGSGVATLGLPDSPGVPASTTASTFTATFNDLDSVEKIFAAHPTEIAGIIVEPVVGNGGFIPPSPTFLRGLRALCDKYKALLCFDEVMTGFRVHKNCAQKLFGVTPDLVTLGKVIGGGLPVGAYGGRKDLMLHVAPAGTMYQAGTLSGNPLAMAAGLKTLEILDRPGAYEHLDRISKKLVEGVVAAGRAAGHPLVGGSFGGMFGFFLLKQEELGKEVEKKAPQSFEEAQSRADTAKFARFHRLMLEEGVYLAPSQFEAGFTSLAHTDEDIEFTISAAANAFKRL

SEQ ID NO: 10795 - protein, 345 aa, Prunus salicina
MTFTPRKKKILIDILARLPAKSLVRFLCTCKSWSDLIGSSSFVSTHLHRNVTKHAHVYMLCLHHPNFERHNDTDDPYDIEELQWSLFSNETFEQFSKLSHPLGSTEHYGVYGSSNGLVCISDEILNFDSPIHIWNPSISKFRTPPMSTNINLKFAYVALQFGFHPGVNDYKAVRMMRTNKDAFAVEVYSLQTDSWKMIEAIPPWLKCTWKHHQGTFFNGVAYHIIEKGPLFSIMSFDSGSEEFKEFIAPDAICSPSDLCIDVYKEQICLLLMFYSCEEGMEKIDLWVLQENRWKQLCPFIYPSDYYYRTIGISIDSKILMLRADHIRGILDMHLCDCESKKVLET

SEQ ID NO: 10796 - protein, 144 aa, Escherichia coli
AYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 10797 - protein, 220 aa, Xanthomonas axonopodis pv. citri str. 306
MNELNHLLENNRAWSERIRREDPEFFSKLSTQQTPEYLWIGCSDSRVPANQIIDMAPGEVFVHRNIANVVVHTDLNCLSVIQFAVDVLKVKHVLVVGHYGCGGVFASLTQKRMGLVDNWIRHVTDVADKHEACLHNAGELSVQHARLCELNVLEQVVNVCRTTIVHDAWERGQQLSVHGWVYSLRDGRAHDLGMSIDRPELLQERYDAALAQIQADQTER

SEQ ID NO: 10798 - protein, 392 aa, Kineococcus radiotolerans SRS30216
MRLAQRARTVQPFHALAFGQQAADLEARGEHVVRLSIGEPDFGAPPAVREAMREVMDGRPLPYTPSTGAPALRRAIAGFYRDRHGVEVDPERIVVTSGASSALLLVLAATVDPGSEVVVADPSYPCNRQLVETFGGVVAAVATTAASRYQLDPASVERAWSERTAAVMVATPSNPTGTSVPPGQLAEICALARARGAWRIVDEIYLDLADPSPGGAAPRTVLAVDPDAVVVNSFSKYFGMTGWRLGWAVLPAELVPAVEKLAMNYFLCASAPAQQAALACFTPESLALCEERRVELAARRRAVLDGLAGLGLPVPVEPDGAFYVYFDVSGTGLGSWEFCERALREAHVALTPGRDFGVDTAETHVRLSYAASRAEIAEGLRRLGAFLAGLRP

SEQ ID NO: 10799 - protein, 184 aa, Brassica napus
  misc_feature (71)..(71): Xaa can be any naturally occurring amino acid
MQDQLVCHGCRNTLLYPRGATNVRCALCNTVNMIPHHPSPHARAGMDMAHIVCGGCRTMLMYTRGGTSVRXSCCQTLNLVPAPTPSNQFAHINCGNCRTTLMYPYGASSVKCAVCQFVTNVNLMGNGRVPNMQNGAASPRTISTSTQSTPPSKTRTVVVENPMSVNESGKLVSNVVVGVTTCKK

SEQ ID NO: 10800 - protein, 169 aa, Triticum aestivum
  misc_feature (62)..(62): Xaa can be any naturally occurring amino acid
  misc_feature (72)..(72): Xaa can be any naturally occurring amino acid
  misc_feature (89)..(90): Xaa can be any naturally occurring amino acid
  misc_feature (95)..(95): Xaa can be any naturally occurring amino acid
  misc_feature (99)..(99): Xaa can be any naturally occurring amino acid
  misc_feature (108)..(108): Xaa can be any naturally occurring amino acid
  misc_feature (110)..(110): Xaa can be any naturally occurring amino acid
  misc_feature (113)..(113): Xaa can be any naturally occurring amino acid
  misc_feature (115)..(115): Xaa can be any naturally occurring amino acid
  misc_feature (125)..(125): Xaa can be any naturally occurring amino acid
  misc_feature (133)..(133): Xaa can be any naturally occurring amino acid
  misc_feature (138)..(138): Xaa can be any naturally occurring amino acid
  misc_feature (141)..(141): Xaa can be any naturally occurring amino acid
MAPTVMASSATSVAPFQGLKSTAGLPVSRRSNGASLGSVSNGGRIRCMQVWPIRGHQEFETXSYLPPLNTEXLLKQVDTDSVQWGAFLXXNKVGXIFRXHNALPGYNXGXYWXCXNCLFPGGTDXQSDQRVGXRPRRXPDXYSHQIAMHAQLMPPRQDRKAKVYRHINA

SEQ ID NO: 10801 - protein, 326 aa, Oryza sativa (indica cultivar-group)
MELANIQQHPNQALGPGGKQRTSSLEAPIMLLTGHQSAVYCMKFNPAGTVIASGSHDKDIFLWYVHGDCKNYMVLRGHKNAVLDLQWTTDGTQIISASPDKTVRVWDVETGKQVKKMAEHSSFVNSCCPARKWPPLVVSGSDDGTAKLWDLRQRGAIQTLPDKYQITAVSFSEAADKVFTGGLDNDVKWWDLRKNEVTEYLKGHQDMITGMQLSPDGSYLLTNAMDNELKIWDLRPYAPENRNIKTLTGHQHNFEKNLLKCSWSPDNRKVTAGSADRMVYIWDTTSRRILYKLPGHNGSVNETAFHPTEPVIGSCGSDKQIYLGEL

SEQ ID NO: 10802 - protein, 439 aa, uncultured bacterium 581
MAAPEYPGLDTLALHAGSQPDPATGARATPIYQSASFCFPDSDYAASLFNIERAGHVYSRLSNPTNAVLEERIAALEDGVGAIATASGQAALTLAIMTLMGAGSHIVAAAALYGGSHNLLAYTLPRLGIETTFVDARDPQAFAAAIQDNTRLVFAETVGNPGLDVLNIPEVAAVAHQAGLPLMVDSTFTTPYLIKPFEHGADIIMHSATKFLSGHGIVIGGLLVDGGRFDWDAFGKFPTLTEPYAGFHNLVFSEEFGPAAFIQRARKEGLRDFGACMSPTTAFHILQGVETLGIRMHRHVENTRRIVEFLNQHEQVSRVGYPELEGHPDQALASALLPKGCSAVFSFDLVGGREAGIAFVDALNLFSHLANVGDAKSLVIHPASTTHHRMDAAALAAGGIGEGTIRLSIGLEDAKDLIADLKQGLRAAGKVAAKQSVTP

SEQ ID NO: 10803 - protein, 403 aa, Lactobacillus acidophilus NCFM
MAKLIISDLDVKGKKVLVRVDFNVPIKDGVIGDDNRIVAALPTIKYIIEHGGKAILLSHLGRVKSDADKKELSLKPVAERLSELLDKPVTFVPSNEGKEVEEAIDNMKDGDVVVLENTRFQDIDNDFGKRESGNDPKLGEYWASLGDIFVNDAFGTAHRSHASNVGIATAMKENGKPAAAGYLLEKEIKYLGDAVDNPVHPFVTILGGAKVSDKIGVIENLIPKSDHILIGGGMAYTFLAAQGHKIGKSLFEADKVDLAKELLEKAGDKIVLPVDNVAATEFSNDASREVVGDDIPDNMMGLDIGPKTIAKFKDILKDAKTVVWNGPMGAFEMPNFAEGTLEVGRALANLTDATTIIGGGDSTAAAKQLGIAPKISHISTGGGASLNYLEGKVLPGIACVSDK

SEQ ID NO: 10804 - protein, 252 aa, Lactobacillus acidophilus NCFM
MSRTPIIAGNWKLHMNPEQTTEFVDAVKGKLPDPSKVESLICAPAVDLDALRKAAEGSNLHIGAENCYFEDEGAYTGETSPKVLKEMGIDYVIIGHSERRGYFHETDEDINKKAKAIFANGMKPIICCGESLETREANKQEDWVVAQIKAALDGLTAEQVSSLVIAYEPIWAIGTGKTASSDQAEEMCKTIRETVKDLYNEETAENVRIQYGGSVKPANVKELMSKPDIDGGLVGGASLDPESFLALVNYQD

SEQ ID NO: 10805 - protein, 416 aa, Pichia pastoris
MSLSNKLSVKDLDVAGKRVFIRVDFNVPLDGDKITNNQRIVAALPTIQYVLDHKPKVVVLASHLGRPNGEVNPKFSLKPVAAELSSLLGKKVTFLNDSVGPEVEKAVNSASNGEVILLENLRFHIEEEGSQKKDGQKIKADKEAVARFRKQLTALADVYVNDAFGTAHRAHSSMVGFELEQRAAGFLMAKELTYFAKALENPVRPFLAILGGAKVSDKIQLIDNLLDKVDSIIIGGGMAFTFIKVLDNVAIGNSLFDEAGAKLVPGLVEKAKKNNVKLVLPVDFVTADAFSKDAKVGEATVESGIPDGLQGLDAGPKSRELFAATIAEAKTIVWNGPPGVFEFDKFAEGTKSMLAAAIKNAQNGGTVIVGGGDTATVAKKFGGADKLSHVSTGGGASLELLEGKELPGVVYLSKKA

SEQ ID NO: 10806 - protein, 432 aa, Pseudomonas syringae pv. tomato str. DC3000
MTHRIVIVGGGAGGLELATSLGKTLGKKGTASVTLVDANLTHIWKPLLHEVAAGSLNSYEDELNYVAQAKWNHFQFQLGRMTGLDRASRQIHLAATLDETGAELVPARSLGYDSLVIAVGSTTNDFGTTGAAEHCLFLDSRKQAERFHQQLLNHYLRAHAGQADSAQEITVAIVGAGATGVELAAELHNAAHELAAYGLGQIKPENLRITVIEAGPRVLPALPERIGAPVHKTLEKLGVTVLTNAAVSEVTADGLITATGQVIPASLKVWAAGIRAPAFLHELDGLESNRINQLQVLPTLQTTRDENIFAFGDCAACPQKGTDRNVPPRAQAAHQQASLLAKSLRLRIEGKTLPEYTYKDYGSLISLSSFSAVGNLMGNLMGSVMLEGWLARMFYVSLYRMHQMALYGTFRTLMLMLGSKIGKGTEPRMKLH

SEQ ID NO: 10807 - protein, 325 aa, Prunus salicina
LVRFLCTSKSWSDLIGGSSFVSAHLNRNATKHAHVCLLCLHHPNFERLVNRDDPYFKKEFQWSLYSNETFEEFSKLSHPVGSTEHYVIYGSSNGLVCISDEILNFDSPIYIWNPSVRKFRTTPMSTNINIKFSYVALQFGFHPRVNDYKAVRMMRTNKNALAVEVYSLRTDSWKMIEAIPPWLKCTWQHYKGTFFDGVAYHVIQKGPIFSILSFNSGNEEFEEFIAPDAICGTFGLCIDIYKEQICLLFRCYGCEEEGMNKVDLWVLQEKRWKQLCPFIFPLDEWSGAIGISIDDELLMAITDFDKGVADLYLCNYECQDVLETG

SEQ ID NO: 10808 - protein, 987 aa, Glycine max
  misc_feature (20)..(20): Xaa can be any naturally occurring amino acid
  misc_feature (119)..(119): Xaa can be any naturally occurring amino acid
  misc_feature (180)..(180): Xaa can be any naturally occurring amino acid
  misc_feature (258)..(258): Xaa can be any naturally occurring amino acid
  misc_feature (321)..(321): Xaa can be any naturally occurring amino acid
  misc_feature (340)..(340): Xaa can be any naturally occurring amino acid
  misc_feature (464)..(464): Xaa can be any naturally occurring amino acid
  misc_feature (804)..(804): Xaa can be any naturally occurring amino acid
  misc_feature (816)..(816): Xaa can be any naturally occurring amino acid
  misc_feature (822)..(822): Xaa can be any naturally occurring amino acid
  misc_feature (842)..(842): Xaa can be any naturally occurring amino acid
SARALSLTQDSLFLFEARRXLSDPENALSSWDSSAANPCRWRGVTCDPLTATITAVSLPSASLSGPFPAILCRIVSLTTLNLTTNLISSTLSAVVAAVCRNLVVLDLSQNNLVGPIPPXLQHLDLSGNIPPSLAALSRLKTLNLVSNLLTEAIPSSLRNLTSLKHLQLTYKLFLPSRIPXQLGNLRNLETLFLSGCNLVGPIPDTLSNLSHLTNLDFLKNGITAHIPQWFTRLKRVTQIQLFKNKHSRELPKGIWNMXSLRFFDASVNELAGTILTELCELPLASLNLYNNKLEGVLPPILAHSPNLYELKLFSNKLIGTXPRDSGSNLPLNHIDIWFDXFSSEILAIICQRGEFEELILMCNYFSGKILASLGDCRSLKRVRLKSNNLSGSVPDGVWGLPHLNLLELSENSLSGKISKAISGAYNLSNLLLSNNMFSGSIPEEIGMLDNLVEFAASNNNLSGXIPESVMKLSQLVNVDLSYNQLSGELNLGGIGELSKVTDLNLSHNRFDGSVPSELGKFPVLNNLDLSWNKFSGEIPMMLQNLKLTGLNLSYNQLSGDIPPFFANDKYKTSFIGNPGLCGHQLGLCDCHCHGKSKNRRYVWILWSIFALAGVVFIIGVAWFYFRYRKAKKLKVLSVSRWKSFHKLGFSKFEVSKLLSEDNVIGSGASGKVYKVVLSNGEVVAVKRLCGAPMNVDGNVGARKDEFDAEVETQGRIRHKNIMRWLWCCCNSEDQRLLVYEYMPNGSLADLLKGNNKSLLDLPTRYKIAVDAAEGLSYLHHDCVIRLVQDVKSNNILVDAEFVAXIADFGVAKMVTXSAKGHXSMSVIAGSYGYIAPEYAYTXRVNEKCDIYSFGVVLLELVTGRPPIDPEYGESDLVKWVSSMLEHEGLDHVIDPTLDSKYREEISKVLSVGLHCTSSIPITRPTMRNVVKMLQEVTTIPKCRSVNDGNVPCFHEGASHNISEMKCSLSNNVLKVNILDSLTFSIAL

SEQ ID NO: 10809 - protein, 326 aa, Prunus salicina
VVRFLCTCKSWSDLIGSSSFVSIHLKRNVTKHAHVYLLCLHHPNFERQNDNDDPYDIEELQWSLFSNETFEQFSNLSHPLENTEHYRIYGSSNGLVCISDEILNFDSPIHIWNPSVRKFKTPPMSTNINMKFSHVALQFGFHPGVNDYKTVRMMRTNKGALAVEVYSLRTDSWKMIEAIPPWLKCTWQHYKGTFFNGVAYHIIKKGPIFSVISFDSGSEEFEEFIVPDAITSSWGLCIDVYNQQICLLLKFYSCEEEGMDKIDSWVLQEKRWKQLCPFIFPLDDYYSTIGISIDNKLLMQRTDYNMGIADLHLCDYESKQVLETRI

SEQ ID NO: 10810 - protein, 435 aa, Candidatus Protochlamydia amoebophila UWE25
MATNKMGLMSAILLGINMILGSGIFLLPGKVSELTGASSLYVYVFVSLLILSIAWCFAQCAALFDRNGGAYLYAKEAFGDFIGFEIGFMRWIAGAMAWASLIVGFVTALSSIWPNALTEPLRGFLILIFLALLILFNMGGTEKLKNINNVVTIAKVLPLLFFVLIGFFYTKGNFQAIDVSLSHLDSISFGNAAIVIFYAFGGFETLVIAAGEIKNPHRNLPIAVMAVISFCSFLYFLIQIIAMEILGPHLAESSIPLADATEQMIGSAGRWIVTLGMIISIGGVNLTASFITPRSGAALAEDGLVPRWIAKNNKAGVPVVAIFLTASLTTIAALSGSFTQLAVISVVSRFVQYGATCLAVFVLYYRNRATLKMLKKISLVIIPSLSLIGLIWMLFQASSSQLYWGLGALLPGIPIYFFQKWKNNLTLATVSEMGD

SEQ ID NO: 10811 - protein, 1186 aa, Cryptococcus gattii
MSVARPTPNLRTPRFPLDHRASLSDGHTNTSSSSRDDALSSHSTGTAFHKFQSYSSFAPHYLNAPPGLAFKTYLDKWGPEQVMGFLAIHGCEHHSGIFIKHSIDGKLLLDFDMSVLTSLGITKVGERIRLMGGIKCLRQRVAHEAKKHNIRSARICDGSLGTDQAKVMIHPKRSASLYAHCQNPFDSDGQSTACRSRLTPSSPADRESDPSPMQRSMNRSIITTFSRRQIIGSLPSEQIHNQSVDSSPTSSLCPPALQRLSPRSTGVSYSDITPKGTPPLITQSTNGAFDHTFSVTGPRDTTSPLGGHLHRPNFFYSTNDISQTCNRPANNTISEQPQRDRESSPSERKENGVICEDEAMGDNSLFAPTFANHPFAISITESNVLEYPRNLSIKNCLPLTSFPSPDKPAAEDTSVMNPSAPSLDDLRRQLIKFVNADDGTTRTVNVMEVTSGAEVLERALKKFGKTGSGRASFLDEDIYGDGKHEGFLCIDGWGVFAENLSGEEMGPMTEGDLLDICSSLRSGAAIQRDALVLRQTSKPQKRKDMRLYLGNTSVLPTPVNLPISFSSPYSGQFVQNSTLQYPAQHQPLLSTNRSRASMMSIMSGLGVSHPGIEKPTDESVQSSTSVTMPSSKKKSMYNFFGHRPPSELISSHLADYFPSAKKRDVAKARGSMLRLNTSHSTEGDPRDVETRPMIEVDDIFFPSTEESSTERRDHYFDPSTFQQRDTSSPRHVGNFTSNRGGSSKGNCKPHSDQKALSTLKTQELHSVNSVTPLLGASPPEVPLTYQPAWLTDFDRDPSFSQLQPLQHSSASSSKQPSSSNRRTMDEITAEMQHRQTSLSCDRPPSKVDSDISAPPSDSETSLGHSSDASDVLESSSGYSDDRSSVSSEDSEEDMAVHTRAFTSNGSKRNIKWIKGALIGAGSFGSVFLGMDAHSGLLMAVKQVELPRGIAKMEARRRDMLSALEREIELLKDLQHDNIVQYLDSSTDANHLNIFLEYVPGGSVAALLSNYGAFEEALAGNFVRQILTGLNYLHKRDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSCTFALDYRMRPSAASLLEHTFIIHDGRLNQEM

SEQ ID NO: 10812 - protein, 577 aa, Ustilago maydis 521
MPTLAERLGSSAANASGSDKSSHDREQELRSRLFASKQTSRNTAHQDLASSERRSIDRELPLASRHRSRSPLSSPQNGSSPRRQRGSPSYENQPSTVSARMPPPPQPYIHPDRRPPRPQADRWVPPPREDVQSDRSPRSYPRRRDDQRWQANERRANQDDSRRAWTSSRSGDRRRYFDSNDDRNPRQEDREAPSEYGAAQWKRLQRDPYASSMSSGGNQGDGNGGFFSSRNEQRKKSTISIWPPSPPHPTLDSDEEREKRKRHRDSSSRHRDKDKDKDRDKDKGKRDRKHSSSDKHHSSSRSHRHHSSTSRRRRSSRHSEDDKASRHRHTRSSRSHHRDDDDDDDDEDVDVDGRRKSKRSRTKVSDGSDSGRSESETDSDSDARSSRHRRRHHKSDRSSTHRRRESEKRHRSSGQRSESESSLHSEHNQKETAKSRRDSVSASASDSDVEVGPTLPTVAADGKPVDPRAYGGALLPGEGSAMASYVQDGKRIPRRGEIGLTSDQIEAYEKAGYVMSGSRHHRMNAVRMRKENQVISAEEKRTMLRLQAEEKAKKEREIVSQFKELVDTLQPGSSEAK

SEQ ID NO: 10813 - protein, 324 aa, Prunus salicina
LIRFLCTCKSWCDLIGSSGFISTHLNRNVRKHAHVCLLCLHHPSFERLVNRDDPYVKKEFQWSLFSNETFEECYKLSHPLGSTEHYVIYGSSNGLVCISDEILNFDSPIHIWNPSVRKFKTPPISNNINIKFSCVALHFGFHPGVNDYKAVRMLRTNKDAFAVEVYSLGTNCWKMIEAIPAWLKCTWRHHDRTFFNGVAYHIIEKGPIFSIMSFDSGSEEFEEFIAPDAICNPCTLCIDVYKEQICLLFSFYSCEEEDMGKRDLWVLREKRWKQLCPFIYPFDGYDTIGISIDNELLMERRDYDKGVADLHLCNYESKQVIETG

SEQ ID NO: 10814 - protein, 216 aa, Candidatus Protochlamydia amoebophila UWE25
MKKLIQGIADFRQGLTEESRHLFANLALGQTPDVLFIACSDSRVVPNLFASTNPGDLFVLRNIGNLIPPFSVDSDNSALAAIEFSIFSLNVPDIIVCGHSECGAMRALVEGIQGNCCSHLQSWLKHGENSLNLVRNGMTINPSLSEHNQISQINVLQQIEHIKSYPFIRERLDKNELRIHGWWFDIAHADVYCYKEDFNQFVLIDEKEAQLILART

SEQ ID NO: 10815 - protein, 347 aa, Prunus salicina
MTFTLRKKEILIDILVRLPAKSLIRFLCTCKSWSDLIGSSIFVGTHLCRNVTKHTHVYLLCLHHPNFERLVDPNDPYLKKEFQWSFFPNETFEECYKLRHPLGITEHYGIYGSSNGLVCISDEILNFDSPIHIWNPSVRKIRTPPMSTNINIKFSSFALQFGFHPGVNDYKAVRMLRTNKNALAVEVYSLRTDCWKMIEAIPPWLKCTWQHHKGTFFNGVAYHIIQKGPLFSIMSFDSGSEEFQEFIAPDAICRPSELCIDVYKEQICLLFGFYGCEEEGMDKIDLWVLQEKRWKQLCPFMFPLDRCHRTISISADNELLMERRDFIKGITYLCLCNYESKQVLETG

SEQ ID NO: 10816 - protein, 376 aa, Prunus salicina
MTFRLHKKEILIDILVRLPAKSLVRFLCTCKSWSDLLGSSSFGSTHLHRNVTKLAHVYLLCLHHPNFERQNDTDDPNDIEQLQWSLFSNETFEQFSELSPPLENKEHYRIYGSSNGLVCISDEILNFDSPIHIWNPSVRKFRIPPISTNNIKFSYVALQFGFHPGVSDYKAVRMMHTNKDVFAVEVYSLRTNSWKMIETIPPWLRCTWQQHQGIFFNGVAYHVINKGHIFSIMSFDSGSEEFQEFIAPDAICSLWGFCIDVYKEQICLLSGYYGCEEEGMDKIDLWVLQEKRWKQLCPFTYPLDYYYYRTIGISIDNKLLMLRRNDISGIADLHLCDYESKQVLKTGIKLATMKYGEMEFLFSITYIESLVLLNYY

SEQ ID NO: 10817 - protein, 286 aa, Kluyveromyces lactis NRRL Y-1140
MRLYVLRHGQSEVNQRNIFGGWVDVHLTEKGLDQARNSAILIKAYCQSQGLELPKLGYTSRLIRTEETMNEILKEFGKQPEFRIVSGELPPQQTSDNGKFPVYQSWRLNERHYGSWQGQSKHKMLEEYGEEQYMYIRRDYLGKPPKADLNREMVQDFDQGDTGYEFKEPNRHVKYLEEEITHDELPNGESLCDVVQRLKPLLENMILPNLKERGDSLIVGHGSTVRSLLKILEGISDTDIKEVNIPNAIPSVIELDDNFRFIRKFYLDPESAKVNAELVRQEGFKE

SEQ ID NO: 10818 - protein, 236 aa, Arabidopsis thaliana
MVLEDEMKKGEASGETSEKMGLSRKNSGSSLSPTEDDEEDEDKKLELGPMIALKEQLERDKDDESLRRWKEQLLGVVDLEDVGGKPNSLLDLDSMVQTPDPVVKILDLTIRSPDREEMVLTIPEDGLPNPKGPWFTIKEGSKYTLVFNFRVTNNIVSGLRYNNTVWKTGVKVDSTKAMLGTFSPQAESYQHVMPEEMTPSGMFARGSYSARTKFIDDDNKCYLEINYTFDIRKSWQ

SEQ ID NO: 10819 - protein, 322 aa, Thermus aquaticus
MKRIGVFTSGGDAPGMNAAIRAVVRQAHALGVEVIGIRRGYAGMIQGEMVPLGVRDVANIIQRGGTILLTARSQEFLTEEGRAKAYAKLQAAGIEGLVAIGGDGTFRGALFLVEEHGMPVVGVPGTIDNDLYGTDYTIGFDTAVNTALEAIDRIRDTAASHERVFFIEVMGRHAGFIALDVGLAGGAEVIAVPEEPVDPKAVAEVLEASQRRGKKSSIVVVAEGAYPGGAAGLLAAIREHLQVEARVTVLGHIQRGGSPTAKDRILASRLGAPAVEALVGGASGVMVGEVEGEVDLTPLKEAVERRKDINRALLRLSQVLAL

SEQ ID NO: 10820 - protein, 516 aa, Magnetospirillum magnetotacticum MS-1
MLADTEEEAVRAARRALGVRPVFKRIDTCAAEFKAPTAYMYSTYVAPFAGSVADEAQPSDRKKVIILGGGPNRIGQGIEFDYCCCHACFALTEAGYETIMVNCNPETVSTDYDTSDRLYFEPLTAEDVLEIIETERQAGQLHGVIVQFGGQTPLKLARALEGAGVPILGTSPDAIDLAEDRDQFKRLLDKLGLKQPKNGIAYSVEQSRLVAAELGLPFVVRPSYVLGGRAMAIIRDEAQFAEYLLGTLPSLIPSDIKARYPNDKTGQINTVLGKNPLLFDRYLSDATEVDVDAVCDGESVFIAGIMEHIEEAGIHSGDSACSLPPRTLSPEIVAELERQTKAMALALKVGGLMNVQYAIKDGAIYVLEVNPRASRTVPFVAKVIGEPIAKIAARIMAGEKLDTFGLKPKRLDHIAVKEAVFPFARFPGVDVLLGPEMRSTGEVIGLDAGFGVAFAKSQLGSGTAVPGTGTVFVSVRDDDKPPGVPAIRQLHELGFTIIATAARSATSPRRHPDPAH

SEQ ID NO: 10821 - protein, 180 aa, Dehalococcoides sp. CBDB1
MSRFAVLLAEGFEEIEFCTITDILRRADLEVKIVGLKNDLTGGSRGIRIMPDMHIDDLKTTDYEVLVLPGGNPGFINMGKDQRVLELIRTAHAENKYLAAICAGPAVLSRAGVIDGKEVAIYPGVKHLLKNCTACDLRVKVEGRLITGRSPQAAMDFALTLMDMFAKPQSAKVVRDEMLV

SEQ ID NO: 10822 - protein, 495 aa, Oryza sativa (japonica cultivar-group)
MASSAASSLLVAVVVLVLVAAAEAAAANETSSSATAALRAGRELRRYRRVQALLRRVNKPARLLQEEALRVSVSVYSELEGGSLPIDVFILARERHRQREEEEEEAPLLLMASSAASSLLVAVVVLVLVAAAEAAAANETSSSATAALRAGRELRRYRRVQALLRRVNKPAVRTIESPDGDLIDCVAAHLQPAFDHPRLRGQRPLRGPPERPRGLPAAAGAERHGGGRSRRPAVGVVRRRRVVPGGHAVGYVAGEEYYGAKASINVWAPKVSTPEEFSLSQIWVIAGSFGNDLNTIEAGWQVSPQLYGDNSPRFFTYWTTDAYQTTGCYNLLCSGFVQTNSRIAMGAAISPTSGYKGGQFDISLLVWKDPNHGNWWLEFGNGELVGYWPSFLFSHLASHASMVQFGGEVVNTRADGGAHTATQMGSGHFAGEGFGGASYFRNLEVVDWDNSLVPLAAGFHVTADHPDCYDIQGGVNAVWGNYFYYGGPGKNVKCT

SEQ ID NO: 10823 - protein, 281 aa, Arabidopsis thaliana
  misc_feature (114)..(114): Xaa can be any naturally occurring amino acid
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWXKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 10824 - protein, 446 aa, Staphylococcus epidermidis RP62A
MKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 10825 - protein, 591 aa, uncultured bacterium 581
MSNLTGSPRMIYAATLILAACSLLYELLIAQALATFAANTVTWYSVTVGLYLAGMGLGALLHDQHPTDNLWARFFKVEIALSAAGAIAVPLLHFSHTGALLLELYGLTFLGKVLFFGTGFLSITTIGILTGFELPVLIDLANTAKDKKRLTNRVLASDYTGSLLGGLAFPLILLPKLSLVAIGLIAATLNVFLATLALYFFLPKLHRSSFGFIVSGSLIIMLGLGLSFAPSLDRYFTKLYYFYWDQSEDFKQLFASMDNTEDVFRVRSPYQRIDLVHDKNGSGPSPVDDFYSSKFVDNPQQPKNYSLFLNGDFQLASNYEEYYHEFFAHIPIMTNGAVPRHVLVMGGGDGLLLRELVKYSDIKTIVHVDLDRELIEQATTHPVLLAMNEGSLSDPRITRHFDDAYRFIRNSSDQFDAIYLDFPDPRDYNLSKLYSREFYHFVRQRLTSDGFIALDSPGLRHNKERREIYTSTLAAAGYQFVTPYISKIETINEAAYEFLLASGYEEEKARRLLASHAASMRLGFITARDNWPDRPIYQDPRVKLHVINDTRLYLTLRNLIPSLAPTDPDKINSIFRPTLPSGNIWHVRDPW

SEQ ID NO: 10826 - protein, 446 aa, uncultured bacterium 581
MSFSTLGLSESLLKAVADEGYTTPSPIQAQAIPAVLEGRDVMAAAQTGTGKTAGFTLPLLHGLSKGQSAKANQVRALVLTPTRELAAQVAESVDIYGKYLNLRSAVVFGGVKINPQMMRLRKGVDILIATPGRLLDLYQQNAMSFQKLEVLILDEADRMLDMGFIHDIRRIMKALPNKRQNLMFSATFSEDIRDLAKTIVNNPVEISVTPRNSTAVSVTQWIHPVDKNQKRHLLVELINQHNWEQVLVFSRTKRGANRLAEFLEKKDIQAAAIHGNKSQGARTRALSEFKSGKLRVLVATDIAARGLDIEQLPQVVNLDLPEVAQDYVHRIGRTGRAGATGQAISLVSADEAQLLQDIERLIQTLLPRKLVAGYEPESPLPELALRPPAKPKKPKKPKESTPPRTASEKSPTATDKKRHPNDAHSPKRRRSNHRSSPKSARPTGNQ

SEQ ID NO: 10827 - protein, 556 aa, Oryza sativa (indica cultivar-group)
MAAAAEAAQEEETVVFRSKLPDIEIPSHLTLQAYCFEKLPEVAARPCLIDGQTGAVYSYGEVEELSRRAAAGLRRLGVGKGDVVMSLLRNCPEFAFTFLGAARLGAATTTANPFYTPHEIHRQASAAGARVIVTEACAVEKVRGFAADRGIPVVAVDGDFEGCVGFGEAMLDASIEPLDADEEVHPDDVVALPYSSGTTGLPKGVMLTHRSLVTSVAQQVDGENPNLYFRREDVVLCLLPLFHIYSLNSVLLAGLRAGSAIVIMRKFDLGALVDLTRRHGVTVAPFVPPIVVEIAKSPRVTADDLASIRMVMSGAAPMGKDLQDAFMAKIPNAVLGQGYGMTEAGPVLAMCLAFAKEPFEVKSGSCGTVVRNAELKIVDPDTGATLGRNQSGEICIRGEQIMKGYLNDPESTKNTIDKGGWLHTGDIGYVDDDDEIFIVDRLKEIIKYKGFQVPPAELEALLITHPDIKDAAVVPMIDEIAGEVPVAFIVRIEGSAISENEIKQFVAKEVVFYKRLNKVLFADSIPKSPSGKILRKDLRAKLAAGIPTNDNTQLKS

SEQ ID NO: 10828 - protein, 160 aa, Glycine max
MNALAATNRNFQRAARILGLDSKLEKSLLIPFREIKVECTIPKDDGTLVSYVGFRIQHDNARGPMKGGIRYHPEVDPDEVNALAQLMTWKTAVADIPYGGAKGGIGCNPRDLSISELERLTRVFTQKIHDLIGVQRDVPAPDMGTNAIIKTFHIDIRVIL

SEQ ID NO: 10829 - protein, 125 aa, Streptococcus mutans UA159
MKKIHTDKAPAAIGPYVQGKIVGNLLFASGQVPLSPETGQVIGTTIEEQTQQVLKNISAILTEAGTDFDHVVKTTCFLSDIDDFVPFNEVYATAFKSDFPARSAVEVARLPKDVKIEIEVIAELI

SEQ ID NO: 10830 - protein, 469 aa, Oryza sativa (japonica cultivar-group)
MSTAAAGRKKKGGTPEASDAAAAAPARTLGCGVGSATAALPFSRGGRGVGLAPPPRSLGRGGGPAVAAIPPGGFPSYSASMDGFPFPPPFDGSYRGGFPSSSAWLDASGGDESSPGSCDKDVHPRGGFMSYFGNHAQNSHLVGAPIYIADASSPPEVEILQGNDDGNGNGNVRTEKRILWTEEEDIRLMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNENMRNARKRKSFHLEGDSEEADDTFDEMPKRPMGQKAAKKAALDAKIKSNGLGSSDDGHSKESPIQLDKFDRYSKFQEENNDKRMKLLDRQEKISSEKLEATKIAHLTAQEYKEGRKLEKESKMMETYNSLISQDTSSMSAEEKAQRVSMMKCLMKTLFPESD

SEQ ID NO: 10831 - protein, 411 aa, Brassica napus
  misc_feature (344)..(344): Xaa can be any naturally occurring amino acid
  misc_feature (394)..(394): Xaa can be any naturally occurring amino acid
MRRSFSFFERFSKAFQDYPSLSRIIVVSTISGGGLIAYSEANGTNGVVETGTKKKKVVLLGTGWAGTSFLKNLNNSQYEVQIISPRNYFAFTPLLPSVTCGTVEARSVVEPIRNIGRKKNVDTSYLEAECFKIDPASKKVFCRSKQGVSSGKKEEFSVDYDYLVIATGAQSNTFNIPGVEENCHFLKEVEDAQGIRKKVIDSFEKASLPELSEEERKRILHFVVVGGGPTGVEFAAELHDFVREDLVTLYPKAKDLVRITLLEAADHILTMFDKRITEFAEEKFSRDGIDVKLGSMVTKVNEKDISAKTKGGGVSSIPYGMIVWSTGIGTRPVIKDFMKQIGQXGNRRALATDEWLRVEGCDNIYALGDCATINRRKVMEDVSAIFSKADKDKXPGTLTLKEFQEGKWMTF

SEQ ID NO: 10832 - protein, 620 aa, Yarrowia lipolytica CLIB122
MSDVEMVEGQGYSDSDESTGYDHVHPASYSGIGIPAHTHDHAQAQGATPSNSAFFSPSSSTRQTGMGAYNEPSSVSSSYKSGVASSAFAGSFSANSFTNTNTNTNAGSFTNSFAASSGGPNANPTAPSVSGTGASVQTGFFPSSLTSSIQQQRTSSYQSFVQPPTVQGSRLTSFATQTFEPDHSPEGQAHSPNIDAPAHWRSSSFGEAVEFQPSVRTSNLTSKLAGSNSNSASASKAGSASGSVDSTVAPPSSSFGGFSDYGSSDTAAASYSGYTTAPSSRRDSTGEKSLFARRKPSSGRMQQIDDVKGKGVGEEEDEDDHDDKKVKVGEVSEQVEVKEEGDEVDVVKKETAVVEGGDKTEATAPTDPTSGPEHVMDSIGNVSVPVSETEDDVHLDIANYPVNDLLLMLTALLQKIIEANDSLHPHHYHHASQNYVSNKFTANVLAFHGRNIPAISLHSYLLRILKYCPTTNEVFLSLLVYFDRIAKRANAGEFTGAHAAASNDGTSSTASSLLAKQVPPPSDIPATQLFVMDSYNIHRLIIAGITVSSKFFSDVFYKNSRYAKVGGLPVEELNHLELQFLLLTDFHLMIPLEVLQRYGNLLLRFWKREGEAANEQTNSS

SEQ ID NO: 10833 - protein, 56 aa, Brassica napus
RSSPSVRPLRVTDSPFPIGEDGDVANGHVDKAADEFIKKFYKNLNQQKKMIEFSPY

SEQ ID NO: 10834 - protein, 393 aa, Streptococcus mutans UA159
MTKLSRRVLEMEESVTLATSARAKTLKAQGRDVLELSLGQPDFVTPKNIQEAAMKSIRDGRASFYTIASGLPELKDAISQYFEKFYGYSVERKQIVVGTGAKFILYALFAAVINPKDEVIIPTPFWVSYADQIKMNDGVPVFIRTSEENHFKATVEQLEAARTNKTKMIVLNSPSNPTGMIYSKKELEAIGNWAVKHDILILSDDIYGRLVYNGARFTPISTISQPICQQTIVINGVSKTYSMTGWRVGYAVGDPEIIGAMSKIVSQTTSNLTTAAQYAAIEALIGNQDTVEVMRQAFEERLNTIYPLLAKVPGFHVVKPEGAFYFFPNVKKAMEMKGYTDVTEFTTALLEETGVALVTGAGFGAPENVRLSYATDMVTLKEAINRIQAFMEK

SEQ ID NO: 10835 - protein, 187 aa, Synechococcus sp. WH 7805
MSELRRSRRSFLQWVDQGEKQVAILLTVITAVVIVAALIQLTVKVTMALITTDQDAYWLGDGLIRILGDLLTVLIALEVLQNITSYLRRHVVQIELVLVTALTAVARKVIVLPAGSENKPQLLIGLGISSIALAGAYWLVKRSIQPAHGSSRHHHSSTEPTRSYLDKDQSSRPDADDQPATTADHQH

SEQ ID NO: 10836 - protein, 308 aa, Prochlorococcus marinus str. NATL2A
MVRLNEIKMQDGKIFLITGANSGLGYETSKFLLERGATVIMCCRDLLKGEKAKKELLKFKFSGKIELVELDLSDLINVKKFAESIKNTFDHLDVLINNAGIMAPPKTLSKQGFEIQFAVNHLAHMFLTLELLPMLEEKNNSRVVTVTSGVQYFGKIQWEDLQGNLKYDRWASYAQSKLANVMFGLELDSKLKETNSKTSSLLAHPGFARTNLQPKSVEANQSWQEELAYKLMDPMFQSAKMGALPQITAATLTSASGGEQYGPRFNFRGFPKICRNAPKALNQTSRKKLWDISEKLIKDFDTLSKQSK

SEQ ID NO: 10837 - protein, 471 aa, Candida glabrata CBS 138
MGKVTTSRAKKQRHDPLVKDLKEAEGRLKKVRKDEGDDNTNGEEFIDDKASRKILQLAKAQQEEIEEENEKESQDAKFQNARFKVITYDNDDEEEEEEEEDFGENISDFEPEEGEYVEEEEVVEIDEEDAAMFEQYFKKADDFNSVNGSYNLADKIMASIREKEMELSNKGMDEDDNEGGFAEPAPRVQEGVELPEKVIRAYTTVGSILKTWTHGKLPKLFKVIPSLKNWQDVLYVTNPEEWSPHIVYEATKLFVSNLQAKEAQKFINMVLLDRFRENIETTPDHSLNYHIYRAIKKSLYKPSAFFKGFLFPLVESGCNIREATIAGSVLAKVSVPVLHSSAALSYLLRLPFTPATTVFIKILLDKKYALPYQTVDDCVYYFMRFRILDDGSNGDDATRTLPVIWHKAFLVFAQRYKNDITQDQRDFLIETVRQRGHRDIGPEIRRELLAGSSREFDSEQPPKDDIMVDVR

SEQ ID NO: 10838 - protein, 193 aa, Zea mays
MATKRDTESDGEGSNPVGGGATPPPLAAAPVVCLLRSAGDFGGGAFVGSIFGYGQGLITKKGFKGSFSNAGSSAKTFAILSGVQSLVLCLLRRLRGKDDIVNAGIAGCCTGLALGFPGAPQALLQSCATFAAFSCIMEGLNKQQAAMARTLGGTAAMAVHEKCGVLPPFTLPPILDASDALASCCLALVKPKH

SEQ ID NO: 10839 - protein, 343 aa, Brassica napus
MGEKPISGNLKKLTIETGRSETLVVCFGEMLIDFVPTVGGVSLAEAPAFKKAPGGAPANVAVGVSRLGGSSAFVGKVGDDEFGKMLAEILKLNNVDNSGMRFDHKARTALAFVTLRADGEREFLFFRHPSADMLLTESELDKNLIQKAKIFHYGSISLIKEPCRSTHLAAMKIAKAAGSLLSYDPNLRLPLWPSEEAARKEIMSIWELADVIKISEDEITFLTGGDDPYSDEVVLQKLFHPNLKLLVVSEGPNGCRYYTKEFKGRVGGVKVKAVDTTGAGDAFVSGLLNSLASDLTLLTDEKKLREALLFANACGAITVTERGAIPAMPTMDAVQELLKSSGS

SEQ ID NO: 10840 - protein, 364 aa, Aspergillus fumigatus
MKALILVGGFGTRLRPLTLTLPKPLVEFGNRPMILHQVESLAAAGVTDIVLAVNYRPDVMVAALKKYEEQYNVRIEFSVESEPLGTAGPLKLAEKILGKDDSPFFVLNSDIICDYPFKQLAEFHKKHGDEGTIVVTKVDEPSKYGVVVHKPNHPSRIDRFVEKPVEFVGNRINAGIYILNPSVLKRIELRPTSIEQETFPAICSDGQLHSFDLEGFWMDVGQPKDFLTGTCLYLTSLAKRNSKLLAPNSEPYVYGGNVMVDPSAKIGKNCRIGPNVVIGPNVVVGDGVRLQRCVLLENSKVKDHAWIKSTIVGWNSSVGKWARLENVTVLGDDVTIADEVYVNGGSILPHKSIKQNIDVPAIIM

SEQ ID NO: 10841 - protein, 263 aa, Lotus japonicus
MAKHSPDQLAIEELKKLIREKEELNESADTKIEDVIAELQLQGCHPTPETAEQRIIDGFTYFKIHNFDKNPDLYKELAKGQSPKFLIFACSDSRVSPTTILNFQPGEAFMVRNIANMVPPFNQLRYSGVGAAIEYAILELKVPNILIIGHSRCGGIARLMSHPEDDSPSFEFIDDWVKIGLPAKIKVLKEHASCDSLEQRTLCEKESVNNSLVNLHTYPFVDEQIRSKGLGLFGVYYDFVNGEFKLWKYESHVTKHISIPHCH

SEQ ID NO: 10842 - protein, 917 aa, Neurospora terricola
MNTIPTRHFGDIAPRDPLSLPPISSSVASGMKRSFTTMAMLYANDSDTGNSDDANARRPPRPLSNSPSTSNYRVGSWSAPNSPPRRALPHHPTTANYDPDASIVIAGIRGAGKSTLAIMASTAMKRKIVDLESEFHHLTGLSSSNYKKRHGLADYGRRHITILQNILNLHRTRAILVCSWLERDVQAMLQDFSTSNPVIYVLRDAKAIEAHLKGYDKSKVGALLDATSAVLRRCTRFEFFNVSEENLDTHSGSASPPAVPDQRHTAPYLTLKRAERHFLKFLSLILPKGTIPFVESAFPLASVPVEQRRFTYALALPISAFLDKGVDIQEFDAGVDAIEIIVDDLATSESGPTSPLGLAPHRASEISRVVGEIRRDTVIPIILHVVFPERALYEEALLALYMAYLSHALRLAPDYLTVDLRLDSGLLGQLTAVKGITKAIGNKQLAQVNSPLWGDPSWLQAYQKAQNTGCDLVRLTRPASGSGDNTDIRQLQVAVEAAGGPRLPLIAYNTGRLGRTSMCFNEILTPVTPEPFKEDTLGLQNSAHRHLQPPLTALEATQALYSAFVHDPMKLYVFGANVGYSLSPAMHNAALKACGISHHYRPLSTTNIGTLREVISDPQFAGASVGLPFKVEIISLTHSLSRHAKAIGAVNTLIPVRHLTADGGIPDEVSMFNNISQAGPVKALYGENTDWIGIRACLRRGLSPANAVRSTSTGLVIGAGGMARAAVYAMLQLGVKKILIFNRTFANAEKLVLHFENLLARDALPLLSTGPRSDDNTCFHIIRSRDEPLPENFKNPTMIVSCIPTHTVDNTPDPEFTVPLHWLDNPTGGIVLELDYKCLTSPLLEQTRREAHRGWVAMDGLDLLPEQGFAQFELFTGRRAPRRLMRREVLRAYPDDQEQSHTAQLQPRLNKIATQIS

SEQ ID NO: 10843 - protein, 420 aa, Oryza sativa (japonica cultivar-group)
MAGEGSGGEGGAGAFEDEAEPTVTIGEYIEGIEAEELEADLVLGGDDGKECTYGGGYLKRQAVFSCLTCVPAGVAGVCTACSLACHDGHEVVELWTKRKFRCDCGNSKFGSHVCKLCPEKDPENPVNSYNHNFKGSYCTCGRPYPDPEAEKQVEMIQCCICEDWFHEDHIGLNSIEEIPRDEEGEPLYEDFICPKCSPKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLETFDSSKPVTSEDIRAVFENLAKKKKQRLS

SEQ ID NO: 10844 - protein, 536 aa, Neurospora terricola
MTLLALKEDRPTPKAVYNWRVYTCAAIASFASCMIGYDSAFIGTTLALPSFKKEFDFASYTPGALALLQSNIVSVYQAGAFFGSLFAFATSYFLGRRKSLIAFSVVFIIGAAIMLAADGQGRGIAPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLFANGKREEAMKVLCWMRNLEPTDRYIVEEVSYIDADLERYAREVGKGFWKPFLSLKQRKVQWRFFLGGMLFLWQNGSGINAINYYSPTVFRSIGITGTNTGFLTTGIFGVVKMVLTIVWLLWLVDLVGRRRMLFIGATGGSLCMWFIGAYIKIAGPGSTKAEDAKLTSGGIAAIFFFYLWTAFYTPSWNGTPWVINSEMFDQNTRSLGQASAAANNWFWNFIISRFTPQMFIKMEYGVYFFFASLMLLSIVFIYFFIPETKSIPLEAMDRLFEIKPVHNANKILMAELNFDRNPEREESSLDEKDRVTQTENAV

SEQ ID NO: 10845 - protein, 651 aa, Oryza sativa (indica cultivar-group)
MTPRRRLALPALLLWCLCALPAPARSQSAATPAPASNEGFNCTANATYPCPAYALYRAGFGGVPLEFAAIGDLFAASRFMVAHANNLSTSAVLAARQPLLVPLQCGCPSRSPNAYAPMQYQINAGDTYWIVSTTKLQNLTQYQAVERVNPTLVPTNLDIGQIVTFPIFCQCPTAEDNATALVTYVMQPGDTYASIATAFAVDAQSLVSLNGPEQGTRNLSSPEILVPLRRQVPEWLPPIVRVNNISTTPASPPPSNTPAPTVVSNNRDGVVTGLAIGLGVVGGLWLLQMLLLGCLWRRLKARGRRAEAVASGDGGEGGRFTKAASGGGGGGGGGRFLVSDISEWLDKYKVFKVEELESGTGGFDDEHLIQGSVYKAYIDGEVFAVKKMKWDACEELKILQKVNHSNLVKLEGFCINSETGDCYLVYEYVENGSLDLWLMDRDRARRLDWRARLHIALDLAHGLQYIHEHTWPRVVHKDIKSSNVLLDDRMRAKIANFGLAKTGHNAVTTHIVGTQGYIAPEYLADGLVTTKMDVFAYGVVLLELVSGREAVSDDSGEPLWADADERLFRGREERLEARVAAWMDPALAEQTCPPGSVASVVSVAKACLHRDPAKRPSMVDVAYTLSKADESFGDYSGESVSVASSGGIAAR

SEQ ID NO: 10846 - protein, 919 aa, Neurospora africana
MNNIPARHVGDVAARDPLPLPHKSSSVASGMKRSFATMAMLYANDSDTGNSDDAGSNARRPPRPLSNSPSTSNYRVGSWSAPNSPPRRALPYYPITASFDADASIVVAGIRGAGKSTLAIMASTAMKRKIVDLESEFHHLTGLSSSTYKKRHGPADYGRRQITILQNILNLHRTRAILVCSWLERDVQALLQDFSTSNPVIYVLRDAKAIEAHLKGYDKSKVGTLLDATSAVLRRCTRFEFFNVSEENLDTHSGSASPPAVPDQRHTAPYLTLKRAERHFLKFLSLILPKGTIPFVESAFPLASVPVEQRRFTYALALSISAFLDKGVDIQELDAGVDAIEIIVDDLATSESGPASPLGLAPHRASDISRVVGEIRRDTVIPIILHVVFPERALHEEALLVLYMAYLTHALRLAPDYLTVDLRLDSGLLGQLTAVKGITKVIGNKQLADANSPLWGDPSWLLAYQKAQNTGCDLVRLTRPASNSRDNTDIRQFQVAVEAVGGPRLPFISYNTGRLGRTSMCFNEILTPVTPEPFKEDTLGLQNSANRHLQPPLTALEATQALYSAFVHDPMKLYVFGANVGYSLSPAMHNAALKACGIPHHYRPLSTANIGTLREVISDPQFAGASVGLPFKVEIISLTHSLSRHAKAIGAVNTLIPVRHLSADGGIPDEVSMFNNISQAGPVKALYGENTDWIGIRACLRRGLSPANAVRSTSTGLVIGAGGMARAAVYAMLQLGVKKILIFNRTFANAEKLVLHFENLLARDALPLLSTGPRSHDNTSFHIIRSRDELLPENFKNPTMIVSCIPTHTVDNTPDPEFTVPLHWLDNPTGGIVLELDYKCLTSPLLEQTRREAHRGWVAMDGLDLLPEQGFAQFELFTGRRAPRRLMRREVLRAYPDDQEKSYTAQLQPRLNKIATQIS

SEQ ID NO: 10847 - protein, 536 aa, Neurospora africana
MTLLALKEDRPTPKAVYNWRVYTCAAIASFASCMIGYDSSFIGTTLALPSFTKEFDFASYTPGALALLQSNIVSVYQAGAFFGSLFAFATSYFLGRRRSLIAFSVVFIIGAAIMLAADGQRRGVDPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLFANGRREEAIKVLCWIRNLEPTDRYIVEEISYIDADLQRYAREVGKGFWKPFLSLKQPKVRWRFFLGGMLFLWQNGSGINAINYYSPTVFRSIGITGTNTGFLTTGIFGVVKMVLTIIWLLWLVDLVGRRRILFVGATGGSLCMWFIGAYIKIAGPGTTKTEEAKLTSGGIAAIFFFYLWTAFYTPSWNGTPWVINSEMFDQNTRSLGQASAAANNWFWNFIISRFTPQMFIKMEYGVYFFFASLMLLSVVFIYFFIPETKSIPLEAMDRLFAIKSVHNANKILMDELNFDRNPEREQSSLDEKDRVTQTENAV

SEQ ID NO: 10848 - protein, 302 aa, Oryza sativa (indica cultivar-group)
MADGTTTELNITPANMLPSRNISAKALQLVRLSKNSQAPPSSVGVRLLSSSPAPARMLSVAASDALVEIKPGEISMVSGIPKEHLRRKVLLWTYSDLCSVDRFASPHRSVWESLEMSKFELGRNVLVRARPRRSAGSSLRNTLFTSARPHNDVMLKKLGGISPMRLFCDKANMRSAGRRDKPSGMELSRRFWSNSSCTIFVRFASNGGMWPESELWLSRSTVRFGNASSHRGTLPTIEVVVVERERLAVETVKLFSPVMNQQDRSFWSYLIGYNCGALIILGNANRELDQRAKALAEEREAL

SEQ ID NO: 10849 - protein, 294 aa, Salmonella typhimurium LT2
MINKIFALPVIEQLTPVLSRRQLDDLDLIVVDHPQVKASFALQGAHLLSWKPVGEEEVLWLSNNTPFKTGVALRGGVPICWPWFGPAAQQGLPSHGFARNLPWALKAHNEDDNGVMLTFELQSSEATRKYWPHDFTLLARFKVGKTCEIELEAHGEFATTSALHSYFNVGDIANVKVSGLGDRFIDKVNDAKEGVLTDGIQTFPDRTDRVYLNPEACSVIHDATLNRTIDVVHHHHLNVVGWNPGPALSVSMGDMPDDGYKTFVCVETVYATAPQQATEEKPSRLAQTICVAKR

SEQ ID NO: 10850 - protein, 374 aa, Coprinopsis cinerea okayama7#130
MASERPIVYFDISIGGQAAGRVVFSLYNDLVPKTAENFRALCTGEHGVGKLGKPLTYKGSKFHRVIKGFMCQGGDFTAGNGTGGESIYGEKFEDEAFPVNHSKPFLLSMANAGPNTNGSQFFITVAPTPHLDGKHVVFGEVIKGKSIVRAIENNPTASGDVPIEPVVIEDCGVLSPDDPSLAESTAEAQDGDPYEDYPEDEDRDLNDAKAVLDIAKLIREVGNRLFKEGKVDQASNKYQKALRYLDLHWPLPEDASEELQAGYKELFTPVLLNSALAAIRVEPRSTVNSTIAITNTTRAINYFDLKPADKAKAYYRRALARLQLKDEDKAEADLVEASKLAPEDAAIAGELNKIKQAQKALREKEKKAYKKLFG

SEQ ID NO: 10851 - protein, 316 aa, Vibrio angustum S14
MSTKLEQLRALTTVVADTGDIKDIKKYQPEDATTNPSLILKAAQIAEYAPLIDASIAYAKSQGDDKAQQVQDTCDMLAVSIGKEILNVVPGRISTEVDARLSYDTEGSVNKARQLIKMYNDAGISNDRILIKLASTWEGIRAAEILEKEGINCNLTLLFSFAQARACAEAGVFLISPFVGRIMDWYKAKEGRDFAPQEDPGVISVTNIYNYYKEHGYNTVVMGASFRNTGEILELAGCDRLTISPQLLQELEEAQGDVVEKLKASTDLKDRPAAMTHAEFLWEHNQDPMAVEKLAEGIRNFAIDQGKLEAMIAERL

SEQ ID NO: 10852 - protein, 664 aa, Vibrio angustum S14
MEHKMLANAIRALSMDGVQQANSGHPGAPMGMADIAEVLWRGHMNHNPQNPQWADRDRFVLSNGHGSMLIYSLLHLTGYDLSIDDLKNFRQLHSKTPGHPEYGYAPGVETTTGPLGQGITNAVGMALAEKAMAAQFNREGHDVVDHYTYSFLGDGCLMEGVSHEACSLAGTLGLGKLIAFWDDNGISIDGHVEGWFTDNTPERFESYGWHVIPAVDGHDAAAINAAIEAAKAETGKPTLICCKTIIGFGSPNKSGSHDCHGAPLGADEIKAAREFLGWTYGAFEIPAEIYAEWDAKEAGKVKEAAWDEKFAAYAAAYPELAAEFKRRMNGELPANWEQVTSEVIADLQANPANIASRKASQNALEAFGKILPEFMGGSADLAPSNLTMWSGSKSVTPTDASGNYIHYGVREFGMTAMINGIALHGGFVPYGATFLMFMEYARNAMRMAALMKIQNIQVYTHDSIGLGEDGPTHQPVEQIASLRLTPNMSTWRPCDQVESAVAWKYAIERKDGPTSLIFSRQNLTQQDRDAAQVANIAKGGYILKDCEGKPELILIATGSEVGIAAEAYAQLTAEGRKVRLVSMPATDLFDKQDAAYRESVLPSDVTARIAIEAGIADYWYKYVGFDGRIIGMTTFGESAPAEELFKMFGFTTDNIVETAKELLA

SEQ ID NO: 10853 - protein, 283 aa, Oryza sativa
MDNTGTPKRTRWSENKAQQDGKDETTKLTYSIERDALECPICFVPFEDRVYMCKNGHAACGSCYAKMNTMCPCCIEPIGNIRCRPLEKVLAAMSAPCRFSTSAYMRLIRASGCTEIVAYTERRNHEASCPHAPCVCPFDGCNYQGHLLYSHIQDEHATDAAVVATGCLRGTGTTVTLHKSKPFHVLLHRGGSRVFLLLNGDNVLSGRSLSLVCISPPPPLPNCELLYKIELGAVSRAPGELGLSMSGTVPCVRRLEGFDAKAFLFVPDSYWGSSGTISVTVHL

SEQ ID NO: 10854 - protein, 356 aa, Yarrowia lipolytica CLIB122
MTTYLSLGLEGSANKLGVGVIKHTVTDANAENGFSTDILSNIRDTYITPPGEGFLPRDTARHHRNWVVRIIKRALDEAKISDPTKLHCISFTQGPGMGAPLQSVVIAARTIAQMWGVPLVGVNHCVGHIEMGRTITGATNPVVLYVSGGNTQVIAYSKQRYRIFGETLDIAVGNCLDRFARVLKIPNAPSPGYNIEQLAKKGKKYVPLPYTVKGMDLSMSGVLQFVESLAKRFQAGDLVVDGHQVTAEDLCFSLQETLFAMLVEITERAMAHVNSQQVLIVGGVGCNERLQEMMGIMARDRNGSVYATDERFCIDNGIMIAHAGLLAWRQGFETKMEKTQCTQRFRTDEVLVDWRV

SEQ ID NO: 10855 - protein, 425 aa, Oryza sativa (indica cultivar-group)
MGRSKQEVVLPPPPSPSQASPGSFASGMMLPGSLGSGAWQGPAPPQPPHPLLYAYGAAASAFPMAQMKQGLDRSAIDLSDLQERGMDFHPPGGFLSYFQDPSILQNHRPFVPPNYYPAEQVAPCSKLRPGAQQPVNIDSGDEEAPTVRTEKRLTWSTEEDIRLVSAWLNNSNDSISGNFKKNDCYWGDVTVEYNSTTPKNRTRQEKQIKDRFHKIKKNVGRFCCVYKEVKSIYVSGQNDMQLKEKAEAAYQADYKEGPFSFLQCWNILRDQPKWHAYLEELEKPNKPKMDDEVEVMEQMSTPNSPEDIKRLVGTKTAKAQCNGKGKRKRKAKVYLSDTDDEIDKLKEVQEMANKGRDELLETQRRVASDNLESKKLAHLAAMEHKEAVMLETYRSLMLQHTKDMPDDVRSEHSMALKCMREKLFP

SEQ ID NO: 10856 - protein, 339 aa, Cryptococcus gattii
MSVPCISLHNFDKRRDEIIKELMDASMNVGFFTLCNHGISPEDVQAAFDLSREFFALPDEIKSKTPLNGKNAGWEKNTQVRPSTGTADQKESMQLQFARMEGLWPSDEDVPGFRARAEKFMNQVQALSVNVMECFADGLGLPHDIFTDGTVECGENDCQNVLRLLHYHATEGKHFGPNFWRAGAHADFDILTILFQRDGEGGLEVCPGRKVVGDFGMGQTWIPVEARQDKIVCNIGDQLMRWSDDRLKSTYHRVRLPEGNERQGPRFSIAFFNQSRTNTVIQGPQKKYPPITGGEFIAEAIAKNRMQSAEIARQAALENAEKVATEVHFVPKHLSAAAA

SEQ ID NO: 10857 - protein, 222 aa, Synechococcus sp. WH 7805
MQPLTPAFLDQLRFNEAGLIPAIAQDWLDGAVLMVAWMNRGSLELTLSSGEAHYWSRSRKELWHKGATSGHTQTVRNIRYDCDADVILLTIEQRGDVACHTGARSCFFEDGDHRSEGGPQALPPPADACTELMRVIEDRRENPDEGSYTNKLLSGGDNRILKKIGEESAEFVMACKDDNPEEIAGEAADILFHLQVALAHHGVSWRQVQEVLAARRGAPRRH

SEQ ID NO: 10858 - protein, 380 aa, Oryza sativa (indica cultivar-group)
MGRSKQEVVLPPPPSPSQASPGSFASGMMLPGSLGSGAWQGPAPPQPPHPLLYAFGAAASAFPMAQMKQGLDRSAIDLSDLQERGAQQPVNIDSGDEEAPTVRTEKRLTWSTEEDIRLVSAWLINSNDSISGNFKKNDRYWGDVTAEYNSTTPKNRTRQEKQIKDRFHKIKKNVGRFCCVYKEVKSIYVSGQNDMQLREKAEAAYQADYKEGPFSFLHCWNILRDQPKWHAYLEELEKPNKPKMDDEVEVMEQMSTPNSPEDIKRPIGTKTAKAQRNGKGKRKRKAKVYLSDTDDEIDKLKEVQEMANKGRDELLETQRRVASDNLESKKLAHLAAMEHKEAVMLETYRSLMLQDTKDMPDDVRSEHLMALKCMREKLFP

SEQ ID NO: 10859 - protein, 511 aa, Cryptococcus gattii
MFARQPLSQHLLRPLSRPSSSFSRSSTLPKLAFLQSARGFASASEPYDVVIIGGGPGGYVAAIKAAQLGFKTACIEKRGALGGTCLNVGCIPSKAMLNNSHIFHQTQHDLKNRGIDVSGVQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGSIGAGMDGEVGKQFQRILTKQGFKFKLNTKVVSGHREGDIVKLKVDSAKGGKEETIEADVVLVAIGRRPVTKGLNLEAIGVETDKKGRIVIDNEFNTSAKGVKCIGDVTFGPMLAHKAEEEGIAAVEILKTGHGHVNYDAIPSVVYTHPEVAWVGKNEEELKAAGIQYKIGKFPFAANSRAKTNQDSEGFVKFIVEKETDQVLGCHIIGPAAGELIAPAVLAMEYKASAEDIARTCHAHPTLSEAFKEAALSSYDKPINF

SEQ ID NO: 10860 - protein, 137 aa, Zea mays
MAAASPPPSPPHDWARAARTDKGVSAAAQVVSGRFYVDPPGFIDRLNAQLAPQIRAYGYVRVTNSFNAKKFCDRRRYLYLLPVFALDPSAHPDREAVMASMGSGSELTKCLECSERGRKIPGVMGRDGKLPSPGRMV

SEQ ID NO: 10861 - protein, 485 aa, Candida glabrata CBS 138
MTATESLMGNTRRKIELTSSLILAVLVSCLGTIQFGYHIAELNAPQQFLTCSEVKYPHGDPDIPYDETLFGRHGLVQCIPMTTEQFGVVTSVLSVGGLIGSYIAGQLAAKYGKKKISQGTAFVYFIGSLMLTMANGYWTMIFGRLLVGMASGISIVVIPVYINEITPAEYKGAMGTMNQLSINIGILFTQTIALVFTNSYYWRWILLIGTAIALVNFVAWSTIDESPKWLLKRGLTSEAEMVVYKLHGGTYQDAKDQIQTWQTDMNSHHEHADFAGREPTLWEFVTREEYKKPRNVIFMILCAQQFCGINSIIFYGVKVISNSLPNSAVLVNFGISVLNVLMTFVASVIIDSLGRKPLLLSSSALMAGTSFLISIGISKDVPILLVIAVFAYIASFAIGVGPIPLMIISELTTHEAAAKAQSFGTICNWLATFLVGFLFPSFHEVMGGAVYCIFSIVAIGFVIYIKYRVPETKNKTSYSDVWRGY

SEQ ID NO: 10862 - protein, 355 aa, Oryza sativa (indica cultivar-group)
MEQPKPPSVAASAAEAQNPNAFTCELPHSVYALAFSPSAPVLAAGSFLEDLHNRVSLLSFDPVHPTAASFRALPALSFDHPYPPTKLQFHPRAASAPHLLASSSDALRLWLAPLDDLAATATAAAPELRSVLDNRKTSASEFCAPLTSFDWNEAEPRRIGTASIDTTCTIWDIERGVVETQLIAHDKAVHDIAWGENGIFASVSADGSVRVFDLRDKEHSTIFYESPRPDTPLLRLAWNRYDFHYMATLLMDSSAVVVLDMRAPGVPVAELHRHRACANAVAWAPQATRHLCSAGDDGQALIWELPATPGAVPAEGIDPVMVYDAGAEINQLQWAAAYPEWISIAFENKVQLLRV

SEQ ID NO: 10863 - protein, 568 aa, Zea mays
  misc_feature (79)..(79): Xaa can be any naturally occurring amino acid
  misc_feature (99)..(99): Xaa can be any naturally occurring amino acid
  misc_feature (124)..(124): Xaa can be any naturally occurring amino acid
  misc_feature (156)..(156): Xaa can be any naturally occurring amino acid
  misc_feature (174)..(174): Xaa can be any naturally occurring amino acid
  misc_feature (183)..(183): Xaa can be any naturally occurring amino acid
MSFGSCPAVAGGATAEELLERARGLVPPALAAARAATGFGGRWKAIAARLGRLPQCLSDLSSHPCFSKNSLCRELLAVXVLATLAEGPPQLGAGRCPRXPPRRGRPCSMQSDLSTRLAAGKLGXLTIRDCSLLVADPVCVCDATVPAAPRLRPSVXAGAQVDVRELLARLQIGXAEAKHRGCXDALLDALREDEKSVLSALGRGNVAALVQLLTATTPKVREKAATVLCLLAESGSCEGLLVSEGALPPLIRLAESGSLVGREKAVITLQRLSMSADIARAIVGHSGFRALIDMCQTGDSITQSAASGALKNISAVPEVRQALAEEGVVRVMINILDSGVVLGSKEYAAECLQNLTSSNDNLRRAVVSEGGLRSLLAYLDGPLPQEPPVAALRNLVTVVPPDSLVSLCVLPRLAHVLRDGSVGAQQAAAATICKVSGSMDMKRLVGEHGCVLLLVRLLEAKSNGAREAAAQAVASLMGCPANARDVKKDEKSVPNLVQLLDPSPQNTAKKYAISCLLALSASKRCKKLMVSHGAIGYLKKLSEKDVAGARKLLEKLDRGRLRSLFSRK

SEQ ID NO: 10864 - protein, 288 aa, Candidatus Protochlamydia amoebophila UWE25
MIEKQKEKTFPPQKQTPPGEQFKMYPLPKDEKKDLKGSGKLFDQVAIITGGDSGIGRAVAISFAKEGADIVVVYLNEHKDAEETKKLVEEKGRKCLLIAGDIGQNSFCQSAIKETIQAFGKLNILVNNAAEQHPQVSIEDITEEQLEKTFRTNIYSLFFMTKAALPHLEKVKGTIINTTSVTAYKGKKTLIDYSATKGAIVAFTRSLSLSLVEKGIRVNGVAPGPIWTPLITSTFSEEKVSVFGSNVPMKRAGQPDEVAPCYVFLASQDSSYISGQILHPNGGEIING

SEQ ID NO: 10865 - protein, 114 aa, Buchnera aphidicola str. APS (Acyrthosiphon pisum)
MQDNSIFKNIIQRKIPANIVYQDKKITAFEDIKPKAPVHILIIPNFFISSSNDINKKNKWIMSHMFYIAVKIAKQKKINQEGYRIIINCNEYGGQEINYLHMHLLGGKKLKSFS

SEQ ID NO: 10866 - protein, 320 aa, Geobacillus stearothermophilus
MKLKAMYSFLSDDLAAVEEELERAVQSEYGPLGEAALHLLQAGGKRIRPVFVLLAARFGQYDLERMKHVAVALELIHMASLVHDDVIDDADLRRGRPTIKAKWSNRFAMYTGDYLFARSLERMAELGNPRAHQVLAKTIVEVCRGEIEQIKDKYRFDQPLRTYLRRIRRKTALLIAASCQLGALAAGAPEPIVKRLYWFGHYVGMSFQITDDILDFTGTEEQLGKPAGSDLLQGNVTLPVLYALSDERVKAAIAAVGPETDVAEMAAVISAIKRTDAIERSYALSDRYLDKALHLLDGLPMNEARGLLRDLALYIGKRDY

SEQ ID NO: 10867 - protein, 978 aa, Coccidioides immitis RS
MIRRNSDVEFSLPNSGVDGRVTPTNVPNEGDVEMISEDTPSPLTLPPHLIARLYPIPKDRRRPSASSSRRSSISSLHSVVSTHGSSHSDHMAQHLRRASIIESRKARLADRAAHVEKVRLRAALAKNATKNALKEERALAAQQAREKLLADIAAKCEEEVRRAKKKAEDIKERKAAEHARLRVEMAEKFAEVERRRLLYQQTLRRPRRTSSVEGKPPKQMPVKKLSQNAAVCIIQKAWRNHRARTTINLFRSLDLSLERIRNLSFEEVGALLSEENVLNVTTKVLRLCGLQDLGESSMSGRGAVRVFLSSYLILSHPAQALSSNGEQEQDLITKAQDLLVIFEQVITQLSSIGVSPVSLSSDLQTLSQSYNTFFSAFHAWKTHDSTVLIEIMLAQFVELELIWQTVKDDRDGGVADDYQKGIRHNQILLLARLKRLAGRDKAMEMVKQALKKAKREKRRNGASSEAIPRAVTDQPSATNGPPEDVHSPLGEVFSADTERWPQDSLENQLSPQDRFVKLLTALPDNRTLVHELLINREYKIDQGSYTEVRGRVMKHMCETMRRDAEVGLGTSLTVAMATVIQDRLLRSLKPGNSLHNLISEVLDPIHIANQCKAGKFSYDAFFDFMSTILPKLCAPFRDPDVKAFAEDTSGDAIDRLARLMGIIDLLSLDHTNFMLQMAAPQLIREGPGYEQRAFSKEVENGTITLEKTRQFWRSNRDSIIEELKKRDPGSSGVTPPVAKIYAQGLVNLVLSNGRLSHDQVPETLSLDHSRLEALRSQSFKIAATAAILLSAKNLLKRDVRCQWKGEAERILSLDFGEIKPERVQSILDSTHPMPAATRSQLFATIKRVLMPASAASATASSSSAPGVMATSGPAASSFIQSSNAPTEIATCARYFTDPVAKLMLSRLRAHVLARLSAASAKERVRTTSTASQSLAAAGMPEFVNEVGKLVDSLNRIREVDWMCHGMTYENIWSEDADE

SEQ ID NO: 10868 - protein, 416 aa, Medicago truncatula
MGASGKWFKSLLSNKKSDQEKKCSSTKKKWKIWKTSSSSSSSSTINKTVSDSSITDTAAAVAVVVRAAPKDFILIRQEWAAIRIQALFRAFLARRALRALRAVVRLQAIFRGRQVRKQAAVTLRCMQALVRVQARVRARNVRKSPEGKAVQQLLDDHRNHADSAKLVEQGWCEIPGTADEVKAKLRMRQEGAIKRDRAMAYSLSTQSRISASPNSKSTKSVSLFKHHHNLDNKSLGNNLLERWMANKPCPWESPISSRKSEELVPTFQSRRNGVTTRISALKICQQTPSSSTLSSEYMNDDSILSTSCTSGSPSMPEATEEKDAHLPSYMNLTESTKAKLKTYRSSSQSSKRLVMDDCMSHNTSTTFLNGDNSINSSGSEPSVNLWKDHCATPLRASLVKNSVTEAELRLLLDINK

SEQ ID NO: 10869 - protein, 415 aa, Thermotoga maritima
PEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRRELERLSRRFFREIQVIIGPYNDIPAPDVNTNADVIAWYMDEYEMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 10870 - protein, 422 aa, Staphylococcus aureus subsp. aureus COL
MKNLILSVQHLLAMYAGAILVPIIVGTSLKFTPEQIAYLVTVDIFMCGVATFLQANKVTGTGLPIVLGCTFTAVAPMILIGQTKGIDVLYGSLFLSGILVIIIAPFFSHLVKFFPPVVTGSVVTIIGINLMPVAMNYLAGGQGAKDYGDVKNILLGLMTLIIILLLQRFTTGFIKSIAILIGLVLGTIGAGLLGMVDINQVNHAGWLGIPVPFRFSGFSFDVTSTLVFFIVAIVSLIESTGVYHALSEITGKKLERKDFRKGYTAEGLAIVLGSIFNSFPYTAYSQNVGLVSLSGAKKNNVIYGMVVLLLICGCIPKLGALANIIPLPVLGGAMIAMFGMVMAYGVSILGHIDFKNQNNLLIIAVSVGLGTGISAVPQAFKGLGEQFAWLTQNGIVLGAISAIILNFFFNGIKYKQTEENVK

SEQ ID NO: 10871 - protein, 91 aa, Arabidopsis thaliana
  misc_feature (16)..(16): Xaa can be any naturally occurring amino acid
KWIHIEKAKILRDQAXWWYRDCRVIHYQKCGHPAHQYLDVTRGVGLAKRYRPVCLRGLNLVARAAHADVVCVIDLWSVIALIAIHGWSLRS

SEQ ID NO: 10872 - protein, 198 aa, Brassica napus
LPLGIGLSLLLCCLLYMMVSVVIVGLVPYYAMDPDTPISSAFATHGIQWAAYLIALGAIMALSSTLMGSILPQPRILMAMARDGLLPSFFSDVNQRTQVPVKGTISTGFCAALLAFFMDVSQLAGMVSVGTLVAFTMVAVSVLILRYVPPDEVPLPSSLQERICSAPFLRCEENSSSHVGTSISTKQPLLCEPDDSTV

SEQ ID NO: 10873 - protein, 513 aa, Staphylococcus aureus subsp. aureus COL
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCDCRGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 10874 - protein, 447 aa, Salmonella typhimurium LT2
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSSCVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 10875 - protein, 265 aa, Oryza sativa (japonica cultivar-group)
MALLSPRVPRLPLASASAAGAGLRCCVSGGRAGDELYKECAAALDGGAVLSTKNLDAITDSIQRAFATVDANLSTWLEQMDKEDESGATATAMFLRNDVLVVSHIGDSCLVVSRGGRPQAVTNFHRPYGNKKASLEEVKRIRAAGDLIVSSPDVSLVELGPDVEFVLLATDGLWDYIKSSEAVALVRDQLRQHGDVQVACEALGQIALDRRSQDNISIVIADLGRTNWKELPAQRPNLFLELTQAVATVGAVSLGIYISSLLALQ

SEQ ID NO: 10876 - protein, 120 aa, Synechococcus sp. WH 7805
MLNPTSFLALLLSIGLGLMSAMPASALSSPDPEHGAQLFSANCAACHMGGGNVISASRTLSQTDLQAHLESYGMDPLEAIEHQIENGKNAMPAYEGKLSDQDIADVAAYVERQAEHGWSR

SEQ ID NO: 10877 - protein, 264 aa, Sulfolobus acidocaldarius
MPISLIERNGLRLRLVLENYPLEFVNSIRRASILYVPVMAVDEVYFIENNSPLYDEILAHRLALVPFVSDEALEHYRPPEECAECKENCDGCYNRVYLDVEAKDQSLMIYSRDLKSEDQMITPVSGAIPIVLLGSKQKISLEARLRLGYGKEHIKYSPVSVSIVRYYPKVTVLGNCEKAVEVCPEGVFAMENNKLVVKNELSCILCEECLKYCAGSVSIESVENKFILEIESVGSLKPERILIEASKSLLRKLSELKSKLEAGK

SEQ ID NO: 10878 - protein, 335 aa, Glycine max
MPTEAESSVTPKYLQENELSQECKEVISTLPMERGWVASHLHQYQGFWHTTRQLQGVLSCQKHFKALDTDVLIVSTPKSGTTWLKAWTFSLLHRNQHDPNTQNQNHPLLFNNPHFLVPFLELDLYIDDNTLPDLTSLITSPRLFSTHLPYVSLPKSVQESACKIIYLCRDPKDAFISLWHFTNMLRPKSRGMNSLQEAFDKFCRGVSLYGPFWAHVLDYWQKSLSEPNKIMFMRFEEMKMKLRLVLQELATFVGCPFSKEEEEAGVVNHILKLCSFDNLSNLQVNKNGKLSSGEEHKAFFRCGQIGDCKNHLTAEMIQQLNTITQEKLAEHGLRF

SEQ ID NO: 10879 - protein, 771 aa, Ustilago maydis 521
MSKQELLLQVTTDVICPWCFVGSRRLKAFLNSEDYKTQIAPHVRLVLKLEPYILDPRLPATSYDTPDKYYDAIETTPYDKNVPPTKKFYYGSKFGGGLDAFDAKISAAASELGMPKFDWTSEGKVGATWNAHRLVLKAGQLDEQNNSRADRDDLETALQSLQMRFMDRFYQDFHSNSKDMSDNTYLAGVAEELGLFDAQEAALTWLESDDLEYELGNKLQQAEMNGVQSIPFYIVNDGADHMSETGSHGSFLKMMQMAVAPYLSELSAERDEPDKPTRLGFAVVSNDDFSTLTFCVTRTATCGRLSGVPIAARVSLCLLAYIAPQETFTNVRYKEFAIRRGNKYLIEPLLRVGLFLVTVISSWAHCHCDYAHRLAEMTRATSVPSVYDTHCDGPGLLPVTKPWSQYYCQLRKYTSDVYATLKFPDFKHADYDCTGKTVLISGSNSGIGKQAALYFARAGATVVMACRFTATHEQNPEEARKEIVATAGVDDSKVELWEIDCSSLANIEKFGIKWRESGRTLDILVNNAGLSAGKRRITDEGFELTHVINLLSHCLLTFYLLPSLNKSAAPRIINTCSCFHAGGKLDFANMDNEKLTSLGPDCVQAYCDTKLWFLMWSVELQDRLSRSDDYRHVIVHGIHPGFVGSNIWHNPDTRIPYPLRIIFQSAISKLSINSEQGSYAIIHAALEPSLGLPKKLTSARNKLAVGESAKFGGKFINRNFVDIRRPEVDDVLARSRLWQRVLEDVAAAKRGVAADLPDHYESVKLLGQSTK

SEQ ID NO: 10880 - protein, 164 aa, Oryza sativa
MSRANASRPPPPPPPASGSGGRLAVLVSHLSQSSRTAGEKEAALAAGPSDGPTIFDKILRKEIPSQVVYEDEKTLAFRDISPQAPVHIIIIPKVKDGLSRLSKAEERHVEVMGHLLYAAKTIAKQENLDDGFRIVINDGPNGCQSVYHLHIHLLGGRQMNWPPG

SEQ ID NO: 10881 - protein, 380 aa, Pisum sativum
MAIECITSSAKLMTQKSDKNENEGSSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 10882 - protein, 82 aa, Triticum aestivum
DWGIGQPLSSWGEVSDLQGPYYQGTFHQSVTCPGFIAAQAVSSLQIREESSEITSPSQGAAAATVVNRMLGGTNRLNLYREI

SEQ ID NO: 10883 - protein, 609 aa, Dehalococcoides ethenogenes 195
MENYQRTDIRNIAIIAHVDHGKTSLVDVMLKQSRIFRENQHVGELIMDRNTLEREKGITILAKNTAITYRGVKINIIDTPGHADFSGEVERVLNMADGCLLVIDSIDGPMPQTRFVLKEAMQKKLKPIVVINKIDRENARPEIVLGLVQDLFLELATTEEQLDFPVVYTSAREGYAVNTPGTKSTDLIPLFECILDKIPPPSIAQGEFQMLISNLDYDTHKGRIAIGRIQRGKICSHDRVVNIDSQNKAHPFEVGQVFTFMGLGKQEVECAEAGEIVAITGLENASIGDTVTSPLQPEALPRIEIGEPTVRMTFGVNTSPFGGREGKFCTSRQLRERLFRELETNIGLRVEETDSPDSFLISGRGELHLSILVETMRREGYEFEISKPEAITKDINGKVYEPVETLTIDVREDFVGEVTELLGKRQARMTDMHNDGEGNVRLEYNIPTRGLIGFRNSFLTATRGTGVLNSQFLDFQPWCGEIEQSRTGALVAAEAGLSCTYGLNNSQERGILMIDANVPVYEGMIVGLHARGLDLAVNVCKQKKMTNIRSSTSDIAIKLVPPMKLSLEQSMDFIAEDELVEVTPKSIRLRKKILDTEMRLRARKRTESN

SEQ ID NO: 10884 - protein, 126 aa, Brassica napus
IDDLTDDYKVVKLVADGDNVLKSSVYSLKSDSWRWIRDLSYEHKDCFSSGVTLRAAVHWVFANENKRVVLAFDFKTEEFREMLLPGEEAEDCGHSYRNFVVGVINGRLCLVNNCYKVHDYVWVMDE

SEQ ID NO: 10885 - protein, 169 aa, Oryza sativa (japonica cultivar-group)
METELCSSRVLSPPRYESGDEELSVLPRHTKVIVTGNNRTKSVLVGLQGVVKKAVGLGGWHWLVLKNGVEVKLQRNALSVLEPPTESKPDKTWNSYAVEILEAFQSCKHEPQSIKGTALPWGPAAFSVSVLTSGSNLFQMLNKKQQLDELQVILGFIQAAKRLKTLYRS

SEQ ID NO: 10886 - protein, 335 aa, Kluyveromyces lactis NRRL Y-1140
MAFQAGSRGGRGGSRGGFGGGSRGGSRGGFGGGRGGFGGSRGGSRGGFGGGRGGPRGGARGGSRGGFGGARGGSRGGPRGGARGGARGGARGGAKVVIEPHKHAGVFIARGKEDLLVTKNIAPGESVYGEKRVSVEEPSTEEGVPPTKVEYRVWNPFRSKLAAGIMGGLDELFIAPGKKVLYLGAASGTSVSHVSDVVGPEGLVYAVEFSHRPGRELISMAKKRPNVIPIIEDARHPQKYRMLIGMVDAVFADVAQPDQARIIALNSHMFLKDQGGVVISIKANCIDSTVDAETVFAREVQKLREEKIKPLEQLTLEPYERDHCIVIGKYMRSGL

SEQ ID NO: 10887 - protein, 120 aa, Glycine max
  misc_feature (2)..(2): Xaa can be any naturally occurring amino acid
  misc_feature (9)..(9): Xaa can be any naturally occurring amino acid
  misc_feature (15)..(15): Xaa can be any naturally occurring amino acid
  misc_feature (19)..(19): Xaa can be any naturally occurring amino acid
  misc_feature (23)..(23): Xaa can be any naturally occurring amino acid
  misc_feature (26)..(27): Xaa can be any naturally occurring amino acid
  misc_feature (39)..(39): Xaa can be any naturally occurring amino acid
  misc_feature (42)..(45): Xaa can be any naturally occurring amino acid
  misc_feature (47)..(47): Xaa can be any naturally occurring amino acid
  misc_feature (55)..(55): Xaa can be any naturally occurring amino acid
  misc_feature (60)..(60): Xaa can be any naturally occurring amino acid
  misc_feature (64)..(65): Xaa can be any naturally occurring amino acid
  misc_feature (67)..(67): Xaa can be any naturally occurring amino acid
  misc_feature (69)..(70): Xaa can be any naturally occurring amino acid
  misc_feature (81)..(82): Xaa can be any naturally occurring amino acid
  misc_feature (84)..(84): Xaa can be any naturally occurring amino acid
  misc_feature (94)..(94): Xaa can be any naturally occurring amino acid
  misc_feature (97)..(97): Xaa can be any naturally occurring amino acid
  misc_feature (101)..(101): Xaa can be any naturally occurring amino acid
  misc_feature (109)..(109): Xaa can be any naturally occurring amino acid
  misc_feature (111)..(112): Xaa can be any naturally occurring amino acid
MXTLDSDVXMVPAGXEPSXSAGXSSXXPKRFEIKKWNAXALXXXXIXGDNCAICXNHIMXLCIXXQXNXXSATSEECTVAXXVXNHAFHFHCIXRWXKTRXVCPLDNRXWXXQKYGHIDT

SEQ ID NO: 10888 - protein, 128 aa, Buchnera aphidicola str. APS (Acyrthosiphon pisum)
MNHIIETKDAPKPIGPYSQALKIDNFIILSGQIPIDVISNQIPENIAEQTYLVLKNIKLILVHAKFQVHNIIKTTVFTTDLKKINIINEIYKKFFIDNKSNFPARSCVEVQKLPKNVKIEIEAMAFKK

SEQ ID NO: 10889 - protein, 902 aa, Erwinia carotovora subsp. atroseptica SCRI1043
MNAHVCRTTCPYCGVGCGVLAEHDGQGEVKISGDPAHPANFGRLCVKGSALGETLDLKGRLLWPLVEGRRVSWDQALDAVAERLLATMQQHGPQSVAFYGSGQLLTEDYYVANKLMKGFIGVANMDTNSRLCMASAVIGYKRGLGADAVPCNYEDIEQADVVVLVGSNTAWAHPVVYQRLAQAKQQRPQMQVVVIDPRRTATCDIADLHLPLQPGSDAGLFNGLLQWIAQDPRINLTELAERFSGVEAALQSAQAWSVAQVADFCQLDDADIECFYHLFSTSEKVVTLYSQGVNQSSSGSDKCNAIINAHLLSGKIGVPGSGPFSITGQPNAMGGREVGGLANQLASHMGLTPQDIERVGRFWQSDNVATQPGLNAVDLFHAIERGDIKAVWIMGTNPVVSMPDADRVKQALECCPLVIVSEVMRHTDTAETADILLPALGWGEKDGTVTNSERRLSRQRAFLPAPGEAKADWWMLSQVAQRMGFAEAFAYQHPADIFREHAALSGFENNGSRAFDISGLATLSNQQWQQLEPIQWPVNAAFPNGRARLGDDGRFWHTDGKAHLVAVTPSLPQSPWSAAYPLVLNTGRIRDQWHTMTRTGKAARLMRHISEPYCELHPQDAQMHDIQAGDLVRLSSVHGWMLARARLDAGQARGSVFVPMHWNQQFSAQARADSLVAPITDPYSGQPESKHSRVRIQPWHTAWQATLFFADEPMSSPLALPDEHDVLPPPATYWSKIPHEGVTQYLFADRTPVDDWQAWLAEHYGLENMQCQIAQGKGIFHLIGWREGRVALACYVSAQALHIDSDTIRQAFITPPQLPHERNALLAGQAPQGQVTQGATICSCYSVGEAIIVGAIRKGCHSVAALGGALKCGTNCGSCIPELKALLSQHVPITVNELKKAG

SEQ ID NO: 10890 - protein, 632 aa, Hordeum vulgare subsp. vulgare
MRVHHKNIVRFVGYCHEIRHKCVEHNGKYVLATVEDRALCFEYLEGGSLDKHLSDESCGFGWHTRYKIIKGICEGLNYLHNGSKESIFHLDLKPANILLDRNMMPKIGDFGLSRLFDSTETYSTKGIIGTPGYMPPEYINRSQITPKFDVFSLGVTIIKIMAGQEGYSKFADMSSQEFVQLVLENWEKALQTTVLSQTSHGVKKCIEIASRCVEADRVKRPTIAEVVDELNKIDTTIIDELNKIDAARSSPTEQVTNLRSNQAFNPCVHSGMLGGRKDGSIKCQILPLASVKVFSYDNLRSATRKFHVGCVIGEGGFGTVYKGWIDENTLSSGKSCTSIPVAVKRLNHEGVQGHREWLAEVNYLGHLSHPNLVKLFGYCLEDKHRLLVYEFLPRGSLEEHLFGRGSCQPLAWNLRTKVALGAAKAIAYLHSTEAKIIVRDVKSSNILLDSDYTAKLSDFGFATDGPVGEKSHVSTMVVGTYGYAAPEYITTGHLTQKCDTYGFGVVLLEMLSGRRVIDRNRPREEQKLVEWARPYLKHKHKIRCVIDASLGGLYSFTAVQKIAALAFECLCLDPKKRPTMDSVVSVLEGVQEDEEPEAEERQEFQVAGKKVITASASRKNKSRWNIFGGWRS

SEQ ID NO: 10891 - protein, 462 aa, Zea mays
MEIFYFVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKVLMVGRVLGGIATSLLFSAFESWLVAEHNKRGFEQQWLSVTFSKAIFLGNGLVAIIAGLFGNYLVDSLSLGPVAPFDAAACFLAIGMAVIISSWSENYGDPSENKDLLTQFKNAASAIASDEKIALLGAIQSLFEGSMYTFVFLWTPALSPNEEDIPHGFIFATFMLASMLGSSIASRLLAHSSPKVESYMQIVFVISSAALMLPVVTSFLVAPSGVKGGSISFSGCIQLMGFCTFEACVGIFWPSIMKMRSQYIPEEARSTIMNFFRIPLNIFVCLVLYNVDAFPMTVMFGICSVFLFVASILQRRLMNVAEIHKSRSQEWSAEKEMTSEADPLNP

SEQ ID NO: 10892 - protein, 393 aa, Rubrobacter xylanophilus DSM 9941
MRLAGRMRRLGTESAFAVLARARELEAQGRDIIHLEIGEPDFDTPPHIVEAGCRALREGHTHYTPAAGIPELREAIAEEVSRSRGVPVHPSQVVVTPGGKPVMFFAILVLVEPGDEVLLPNPAFPIYESMVNFVGGRPVFVPLRQENGFRFDPEEFGERLGPKTRLVILNSPANPTGGVLTPEDTRALAEILRERPDVYVLSDEIYSRLVYPEASFASIASEPGLGPDGRTIILDGFSKTYAMTGWRLGYGVMPRRLAGEFAKLQVNSSSCANAAAQRAGLAALEGPQEPVEEMVREFGARRDMIVAGLNELPGVECRTPHGAFYAFPRVTGTGRSAGELARLLLEEAGVACLSGDGFGRYGEGHLRFSYANSRENISRALERVAKTLAGAAR

SEQ ID NO: 10893 - protein, 428 aa, Vibrio angustum S14
MSNNKLDETYKRLRWQIIITTFLTYTVMYISRKAFAAAAPLLMTDLGMTTVQFGLASSIYYILYGISKFSSGLLADKINPRLFLAPVLVVIAIINVGIGMTDSVTMLLSLYCLTAVVQGCGFPPIAKAISQWYSKSERGGWYSLWNTSHNVGGALAPLIASAVIAYTGNWRYAFYVPAVITAVQSIIAAVLMRGKPENYGLPNVGVWRNDTKQLEINKRSEAGLTMWVMFKRYILTNPIIWLAIGGDLCIYVIRTVSSDWVSVYFVDVLHWDLVKANSLVAWFEAGGILGGLTSGIISDKFFGADRWKTILIYCFVLIGGMIGVAFTLHIDYMLVALCFFIIGAGIYAPQMLFALGIIEASHADGAGAATGLKGGVTYIGAALAGAPIAMIQTSYSWNGVFVLLAAIAVVLVLLTCTIIRVDRKRLPM

SEQ ID NO: 10894 - protein, 156 aa, Lophopyrum elongatum
MEYQGQQQHDQATTNRVDEYGNPVAGHGVGTGMGAHGGVGTGAAAGGHFQPTREEHKAGGILQRSGSSSSSSSSEDDGMGGRRKKGIKDKIKEKLPGGHGDQQQTAGTYGQQGHTGMAGTGGNYGQPGHTGMAGTDGTGEKKGIMDKIKEKLPGQH

SEQ ID NO: 10895 - protein, 955 aa, Pseudomonas syringae pv. tomato str. DC3000
MLELTLGQISMAQSAVDKTAALKLLADHLVADGLVAEGYLTGLMNREQQGSTFLGQGIAIPHGTPETRDLVFTTGVRLMQFPEGVDWGDGQMVYLAIGIAAKSDEHLRLLQLLTRALGEEDLGQALREAKSPEDLLKLLQGAPQELALDAQMISLGVSADDFEELVWRGARLLRKADCVSNGFAAVLQQVEALSLGDGLWWLHSEQTVKRPGLAFVTPDKPIRYLGQPLTGLFCLASLGEAHQALLERLCLLLIEGRGHELGHATNSRVVLEALGGEVPAEWPTQQIQLANAHGLHARPAKILAQLAKEFEGEVRVRVLETGESAVSAKSLSKLLSLGVRRGQTLEFIAEPSIAADALPALIAAVEQGLGEEVEPLPAASEPEAAPTPVAVAKPINAPAAGSVLSAVPASPGIAIGPAHVQVLQTFDYPQKGESVAAERERLQTAIGEVRRDIENLIQRSKSKAIREIFITHQEMLDDPELIREVEQRLNDNESAAAAWATVIEAAAVQQEQLKDALLAERAADLRDVGRRVLAQICGVETVAAPDEPYILVMDEVGPSDVARLDPAQVAGILTARGGATAHSAIVARALGIPALVGAGDEVLLLKPGTVLLLDSQRGRLTVAPDQATLQRAVEDRDAREQRLKAAAAARMEPAVTRDGHAVEVFANIGDSTGTPAAVEQGAEGVGLLRTELLFMAHSQAPDEATQEAEYRRVLTDLGGRPLVVRTLDVGGDKPLPYWPIAKEENPFLGVRGIRLTLQRPDVMESQLRALLRAADSGPLRIMFPMIGTLEEWREARAMTERLRAEIPVSDLQLGIMIEVPSAALIAPVLAREVDFFSIGTNDLTQYTMAIDRGHPTLSAQADGLHPSVLQLIDMTVRAAHANGKWVGVCGELAADPLAVPVLVGLGVDELSVSARSIGEVKACVRELTLSSAQQLAQKALTAGSAAEVRALVEAV

SEQ ID NO: 10896 - protein, 294 aa, Coprinopsis cinerea okayama7#130
MSDVASALQRLASYRANHSRASQDVFKKGDIVLKSGKAPKGEEGWAFLEQLALAAIDLDRLEVADACIAQLANKFPDSPRVDVLTGIRIEATEPLDIVLSYYRELLQKDSTNAAAWKRKISVLRQKGGIDQATEELIQYLDTFYTDPEAWLELADIYVTNRQYTSGLQALSHALALNPQNPFTFVQFAETAYSAGDLPLALKMFLVAVDMIERDLDSPQTTPPTGLAIRAWWGVKLCSRHLLETPSLSTSPSNTKVPKSLSAIDELATERVLVAYKGEEAAPQRRLVEKWLSSK

SEQ ID NO: 10897 - protein, 1225 aa, Cryptococcus gattii
MSGFTPALGLHHTHSSSVLPTISNDAEPNPPTSSQPHQLAAYSHLYTTSPNYASKITNESSYSSSTTHHGFKYVRPSTSPLLKPPKGNSFSAYLGDWGSQELFTFLDIHKCGQCLAIFQKNDINGKLLLDLDVAALKSMGIDKISERVRLISGIKDLRRRVTDESVRAPFTLCSCPPERTLLPILPSHSNVLLDRWDCSSSTSCLGKREITFRPPPLDLRGHMPPRLSNHSSQSIASIDTHDVHTTNPQIGAVQQYPLDQPQSVPTNRSDSLTLRAPPSRNIGRRSPSPRHFEGCESQTDRFTTLNVASDQQVLSSTVNSLTLREDCHLQREEGLPSFLQVPHFRNTFTSSHKTLLSRRSDLARDDTTSHQPFGPAIAEQDNHIRCRIPDTITNIRETSQGDPNHPFAVKSSKSQSGMLDGVCDMVHGPMADGTKPKGKASVPLTGMSSPNIFPVNANSAALSLADLRRQLVKFINTEDDTIRTVNVMHVTSGIEILERALKKFGKWGTGMHSGPDVYSDDDVNGTLEIDGWGVYTESNPDESSKPLSESSLLQKCTFHREGTAIPDKGLFLHKKKRSQKRKNIHDFFGETPPPLMSPTLPTLFTGPHLGLVQGKSQPASESAPFSSTRLSTSANKGPNRASMISVMSGLGVPITCTLPSPQGNGLRLTGQVNSHKKKSMYNFFGHRPPSELISNHLADYFPSAKKSDVEKARHSLLRLSGGNSAYQGSWIDQGDNAPDHRSKPGSSQPPSLPPFEPSRDTLSDSLQAYASTAIHLSRPKHSTALRRRRDSDSSSRSHMSELMQTRLNRDHSDTASLLTVDEITAEVENRRTSAVLKGNCIEEAEDPPSIERDMLPKYEESKGLLHAVCSDGNSNVDDGMSYRGNSDLDPEEEEEEEEEEEEEEEGEEEEDEENEQGKAFTSTGSKRIIKWIKGALIGAGSFGSVYLGMDAQSGLLMAVKQVELSAGSAKTEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADVWSVGCLVVEMLTGTHPWADLTQMQAIFRIGSLARPAPPSDISVQADEFLRKTFEIEHTKRPTAAQLLKHPFIGSPRVRATSSNFINGAIVSEKMQVQIVKEM

SEQ ID NO: 10898 - protein, 554 aa, Pseudomonas syringae pv. tomato str. DC3000
MAYYRNPSDVTAMPAWQALTKHRQAMQDFSMREAFTDDPKRFSQFTLSSAGLFLDYSKNLITAETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFDQNMPVLLALLGVWYGNFWNAQSHAILPYDHYLRNITKHLQQLDMESNGKSVRQDGTPALTDTGPVIWGGVGANGQHAYHQLLHQGTQMIPADFIVPIVSFNPVADHHQWLYANCLSQSQALMMGKTRAEAEAELRDKGMSEEEVQKLAPHKVIPGNRPSNTLVVERISPRRLGALVAMYEHKVFVQSVIWGTNAFDQWGVELGKEMGKAVYQRLTGGTEEPADDASTQGLINYFRGRHRG

SEQ ID NO: 10899 - protein, 645 aa, Cryptococcus gattii
MAFSPSLTPSRPAPVPPRRAAGTAPHTIGVTDTAAAPQSNFSSTSYSPSFSYTNPSIQSTKIADTTRSRTIRSGAASIKEEGLRAFMWSKRWLVLGSAELRIYKNESSSSPVYTVSLEDIQDVQRVDLKPYCVEIETSDKLLYFAFRSDNEVYGWMDDINSRTPRLGVSQPTNFVHQVHVGCDPKSGGFTGLPPQWSKLLTSSAITEEEAARNPEAVLDVLQFYTQQQASDVLEGYQKFPLPSVSNQFLTTGAAATRFEGVGLGGQQQQQQQQRLRSAPFTATGSLATTVASGQRSFNTETKTLAQKEKEIVLNPQRQLLDSVTRPPIGKNDKEMIMRSPGPTVEKRISTMNEVQIMEKLRSVVSAKDPSQLYSKIRKVGQGASGMVFVAKTLSNGKKVAIKQMDLSQQPRKELIVNEIIVMRESQHPNVVNFLDAFLVRGSELWVVMEYMEGGALTDVIENNKLEENQIAAICLETCRGLQHLHSRSIIHRDIKSDNLLMNTQGEVKITDFGFCAKLTDQKSKRATMVGTPYWMAPEVVKQKEYGAKVDIWSLGIMAIEMIENEPPYLDEEPLKALYLITTNGTPTLKSPEKLSQDLKHFLSVCLCVDVAFRATSTELLKHEFLQLACSVQDLAPLLRFKQDTL

SEQ ID NO: 10900 - protein, 376 aa, Synechococcus sp. WH 7805
MPFNGTIFTLGIDARHHPMAAKTFLAGDLGGTKTLLAIYSETDRGLNKKHSHRYASAEWNDLESMLGDFLKTLPPGVSKPETSCIAVAGPVQNGTAKLTNLPWSMSESSLCDATGLQRLELVNDFAVLIHGLPHLNASQQVVLQTGSGRDTPTESGHDGGAVAILGAGTGLGMARGLPAARGWLALPSEGGHREFAPRTEDEWHLAQWMRRDLDLDRLSIERVVSGTGLGYVMCWMLSTHDNADHPLQAKAKAWRTLPADHPEHEDLPAHTSQAAVSGDPLAQAAMTLWLGAYGSAAGDLALQELCIGGLWIGGGTAEKVIDGLRSPQFLEPLRRKGRFRPLIESITIRAVTDPEAGLFSSACRARDLAESGGTLA

SEQ ID NO: 10901 - protein, 1253 aa, Kluyveromyces lactis NRRL Y-1140
MLENELSFVSLTRVSLNVIELNIHAKDATIVNNVSFSLPNGQLMAIIGGSGSGKTTMLNVLAGKTNSSINYDGEIQYSRDAAKEGSKADEKVTTAYLTQHDALAARLTCRETLRIAADLKLHLPKQERYSLVEELIAELGLRDCSETFVGDSINKGLSGGEKRRLSIAVQMIANPSVLFLDEPTTGLDAYSAFLLIKTLKKLCEHGGRTIIMSIHQPRSDILFALDQVCLLSKGFPMYCGAVVGMVEYFSSMGYTVPERCNPADYLIDICSVDNRTEKSTLDSEGRWNMFASEWQERCSTKYDTSKETAVISVDPSPPSVSILQQTFILTKRNFLLSSRDRLTLFAVQFEPVIVGIVVGWIFYKPDQTSESGLRTIAGALYIVGSIQGYLLLLLETYRLSELDIKIYDRERSEGCVTAFSYLMARRLSNLVQEDILIPLLFAIITYFMFGLEANAGRFFTYFGCTLVSHQTSVAVAYMAVSISRDFSKAGLVGNLTFTLQSMACGFFVNAEKMPVYVRWTKYIAYLWYTFSALMSNTFSNFGCHQINGSEVCTGDQYIDTFGIPKNWISVPIIITFCWAIGFYLVGLLFFQFKTVDVTLAKQVSTKKKNSNEEKDISVDTSNESVIVEEKLSNESITEGSEISIDLQDISLSVRQIQLFEISKKKLIGHSHKDILCSVNASFRPNAINAIMGPSGSGKTSLLNLISDRVCSNFFTKFNESGRIIFNQQPVMKSMFKSVCCYVSQDDNHLLPNLTVYETLKYAARLRLSHHNESRIETRVRTLISDLGLKNCANTLVGNDLIKGISGGEKRRVSIGIQLLTDPSVLLLDEPTSGLDSFTSSTIIELLKKLCQQGKTIILTIHQPRAEVFADFGNVLLLAKGGRVAFNGYPSAMIEYFNKEGFTCPQLTNIADYLLDVISVNIQNYENEVSSKERVNALIEKWRVISSKDVRNVNPTMTHSEFTSLFAQHIRHHASVLVAYKVCLSRQFKVMTRNIDSCFARLAQVPGMAAILTIYFAPLKNNFTGVMNRLGLTQQYTSLYFCGMLLNLAVYPAERDNFYQEFHDNIYGIGPFLCAYMTLEFPMAVLSAILFSVLTVMGIGLPRTAQMLFISMYCSFIITTCGEAWGIVVNTLFNRPGFVVNVVSIILSISSIMSGILSLNMPKFWKGLNYVSPVHYTSMILINYSFPDQMKFTCNDGGRNSDGSCLFNNGRDVIDNYGLHVNTSVYLGVLAAVWVVYRIIPYLILKADLELFKR

SEQ ID NO: 10902 - protein, 493 aa, Xanthomonas campestris pv. vesicatoria str. 85-10
MNALTSATAAATDSPAWHGCIFNGDWVPGRGGSVPIHEPATGALLHEVGKADLADVAAAIAQAKQAQRAWAATPPRERAAVFHRAAQAMQARSAEATLLIARETGGILPKAQREVDESVVFYQQAAAMPLQASGQMLPTASGQLSLARRLPLGVIGVISPFNFPLILSLRSVAPALAMGNAVILKPDPRTPYTGGVIIAQVLEEAGLPKGLLHVLHGDAQIGQALVESPDVPMIAFTGSTAAGRRIGEIAGRHLKKVSLELGGNNAVIVLDDADLDKAASAVAFGAYMHQGQICMATGRVLVHRSVAQALTQRLAEKARHLPVGDPVSGIVALGPIIDQRQLQRVVDIVNDSVAAGAVVEAGATHEGLFYAPTVLSNVRPGMRAFDEEVFGPVINITVFDTGDDAAELANQGEYGLAAGILSASVSRALALGEKLHTGLLHINDQTVADEVVNPFGGAGASGNGTSVGGPADWEQYTHWQWLTIKSEVPQYPF

SEQ ID NO: 10903 - protein, 197 aa, Kluyveromyces lactis NRRL Y-1140
MDTLFNSAKTNPRGIPEAPFVEKVEQYVKSPEDFDMCFSKFQEHLSKYKYMQESKLANIKQLKSKIPDIENTLNMCALLKQKRETEVDEDDEEEDDSLLINYQLNETLFSKASVNPKDPELKVGLWLGADVMLEYPLDEAIELLAQKLADAKQNLDISQQDVEFLRENITTMEVNCARLYNWDVQRRQQMKKEGSSG

SEQ ID NO: 10904 - protein, 199 aa, Zea mays
  misc_feature (139)..(139): Xaa can be any naturally occurring amino acid
  misc_feature (164)..(164): Xaa can be any naturally occurring amino acid
  misc_feature (171)..(171): Xaa can be any naturally occurring amino acid
MTTAPFVSPSLPRLHSARASPFPKPSVGSGGGVAFPARTYGSSLRLRSAVMSASGVGGNGSPMAPEESTVSSRLGEVKRVTKETNVHVKINLDGTGVANSSTGIPFLDHMLDQLASHGLFDVYVKATGDTHIDDHHSNXDIALAIGTALLQALGDRKEFTRFGXFTAPLDXAAVEVILDLSGRPSLSCGLASYRKSGHM

SEQ ID NO: 10905 - protein, 253 aa, Arabidopsis thaliana
VLFLALLLLASPLLQVARCQSDAEDHSSLVDDVVGENTDDAVEEDDHDLDMNLSSFPGVETVCVFPKNSAKLVPAGEETELLVGLKNEGKTRVGVMGIRASVHLPYDHKLLVQNLTMLRLNNASIPTSLQATFPYIFAVSQYLQPGAFDLVGYIIYDVEGKPYQSVFYNGTIEVVESGGLLSGESVFLLTLGIGLLLLLGLWAYSQVQRLTKKTKKVSKVEVGTRSTEASLDEWLEGTTLAKTSSGKTKNKKN

SEQ ID NO: 10906 - protein, 372 aa, Hordeum vulgare subsp. vulgare
MGNCAGVQGNAEINPTFSAPNTSGNNSKSSSSNATDTSTFGKSSSSSVPPTPRSEKEILQSSNLRKFTFSELKSCTRNFRTDSLLGEGGFGSVFKGWIDERTFTPVKPGTGMIVAVKKLKLDSFQGHKEWLAEVNYLGQLSHPNLVKVIGYCLEDEQRLLVYEFMPRGSLEHHLFRRAPHFQPLSWNLRMKVALEAARGLAFLHSDEAKVIYRDFKTSNVLLDSEYNAKLSDFGLAKDGPSGDKSHVSTRVMGTQGYAAPEYLATGHLTTKSDVYTYGVVLLELLTGQRALDKNRPPGQHNLVEWARPYINSKRRVIHVLDPRLGSQYSLPAAQKAAALAMQCLSMDARCRPDMDQVVTVLQKLPEVKKTSK

SEQ ID NO: 10907 - protein, 367 aa, Coxiella burnetii
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFGTV

SEQ ID NO: 10908 - protein, 466 aa, Novosphingobium aromaticivorans DSM 12444
MNALSPTLTNRSLVDIDRDHLIHSVTSFRGHEQHGAIVLESGDGMWLTDAEGNRILDAFAGLWCVNVGYGQESIVEAAAAQMRKLPYATGYFHFASEPAIRLAGELTAAAPSGLDHVFFTQGGSDAVDSAIRYIVHYWNAAGKPSKKHFIALEWGYHGSSSLGAGLTALGNFHRNFDLPRPWQHHIASPYPYRHPQGDDDAAVIASTVAALEAKVAELGADNVAAFCCEPIQGSGGVIVPPRGWLKALREACTRLGILMLVDEVITGFGRTGPLFACEEEGVSPDFMTTAKGLTAGYIPMGAMFMADHVYQTIADAAPAALPIGHGQTYSGHPVAAAVGLEVLRLYREGGLLENGRKTGERFAWHMERIRAHPLVGDVRYRGLLGAIELTPDKATKAIFDASLDIGGRLSKLTYANGVIVRCFGNAVLGFAPALCCTLEEMDMIFERVERSLDQLLDQPDIRALVV

SEQ ID NO: 10909 - protein, 359 aa, Novosphingobium aromaticivorans DSM 12444
MSSNTRSYSIAVIPGDGIGKEVMPEGMRVLEKAASIFGFEIEQKWHDFACCDYYARHGKMMPDNWKEEIGRPDAIFFGAVGWPDTVPDHVSLWGSLLQFRREYDQYVNLRPVRLMPGVPCPLAGREPGDIDFWVVRENTEGEYSSVGGIMFPNTDREVVIQETVMTRIGVDRVLRYAFDLAQKRERKHLTSATKSNGIAITMPYWDQRVEAIGAEYPDVSHDKYHIDILTAQFVLNPDRFDVVVGSNLFGDILSDLGPACTGTIGVAPSGNINPEGIHPSLFEPVHGSAPDIAGQGIANPVGQIWSAAMMLEHLGEAEAAAAIMRAVEQVLATPSARTRDLKGAASTDACGKAIAEALG

SEQ ID NO: 10910 - protein, 485 aa, Novosphingobium aromaticivorans DSM 12444
MALQLNDPSLLRQAALIDGAWISGDLPKVEVLDPASGEVVGVVPDCGVAETEAAIAAAEASWAGWRRRTANERAALLEAWHALVLANLDDLARIMTAEQGKPLAESQGEIRYAATFIKWFAEEGRRVGGRNIPSPERDRRIIVMTEPVGVSAAITPWNFPAAMITRKCAPALAAGCPVVIKPSEMTPFTALALVELALRAGFPKGTINLVTGMPQAIGAAITASPVVRKLSFTGSTRVGALLMRQSADTIKRLSLELGGNAPLIVFDDADLDLAVKAAMASKFRNAGQTCVCANRILVHAPVYEEFASRLGAAVSALNSAPGMEAASTVGPLINAAAVEKVSAHVEDALAKGGKVLFSGKGREGGNFLRPLVIGNASSDMRLASEETFGPVAPLFRFETEDEAIALANDTPYGLASYFYTSGLDRAFRVAEALEAGMIALNTGSIAMEMAPFGGIKQSGLGREGGLAGIEEYLETKAFHIGGLKI

SEQ ID NO: 10911 - protein, 435 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNT

SEQ ID NO: 10912 - protein, 496 aa, Coprinopsis cinerea okayama7#130
MASFDLCHARNFQAFTMGNGVAPGNSYPLCVPPLEKFWHESEQPPPAKFKKPWLVRERHVPAPKRGEILRQIREALAAKVRSTPGKEMGKIRTEGVGEVQEFIDICDYGVDPILVDSISTHTRSIELVLAVPNPLGVVAVLSAFNFPVAVYGWNLALSLAAGNATIWKPSPTTPLCSIATTKIIARVLEDNGIPGAVASLVTGGKEAGEAVVASPQAELVSFTGSERVGRIVGQNVASRFGKVILELGGNNASIIMPDADLSLAVPAVYFGAVGTAGQRCTSTRRLYLHKDIAESFLDRLKKFYSTVRVGDPLVKETLLGPLHTESACGIYEQAIQKLRSQSAEIITGGKRYQRDDLAGGNFVEPTIALPQSANPKDEIWSTEVFAPILNVAIFDELEQAIEWNNSVPQGLSSSLWTKDIRNVGKWIGPSGSDAGIVNVNVGTSGAEIGAAFGGNKSTGWGRESGGDAWKQYVRWSACTLNFSDAAPLAQGVDFST

SEQ ID NO: 10913 - protein, 102 aa, Fragaria x ananassa
MATLDSDVPMIPVGEGSSSAGPSSTKKPKRFEIKKWNAVALWAWDVVVDNCAICRNHIMDLCIECQANQASATSEECTVAWGVCNHAFHFHCISRWLKTRQV

SEQ ID NO: 10914 - protein, 169 aa, Oryza sativa
VRSESGTTRLLNVTHASKWPTYGRLRARHRHHQAPLPERRRHPMLARVAHDAGAKLVVDNTFTPMVVSPARLGADVVVHSVSKFISGGADIIAGAICGPASLVNAMMDLQEGALMLLGPTMNAKVAFELSERLPHLPLRMQEHSRRAAEYATRRRRWPRRATSSASTAG

SEQ ID NO: 10915 - protein, 510 aa, Corynebacterium glutamicum ATCC 13032
MNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDIALLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEVEQALQELEAVLDAAVIGVPDERWGETGIAFVSIRESYLTNPPTGPELRELLGSVLARYKLPREIHIIEELPRNATGKIQKNILRDFTIPVS

SEQ ID NO: 10916 - protein, 690 aa, Oryza sativa (japonica cultivar-group)
MAPYMWKGLSVEHFLRFTMLNVSDMLQMYIQEWNAPKPMHESLLNEALRRTISNEQKRELWSPLPYQGWKPCLKSSSVHGVPLEPTGYIQVFLDGGLNQQRMGICDAVAVAKILNASLVIPHLEVNPVWKDTSSFEEIFDVDHFINTLKAEVSIVKVLPKKFSWSTREYYGTGIRATRIKTAPVHASASWYLENVSPILQSYGIAAIAPFSHRLAFDDLPVDIQHLRCKVNFQALVFLPHIISLGETLVKRLRSPVQGQSGELIQEVGEDTNQAGKYAVLHLRFDKDMAAHSACDFGGGRAERLALAKYRQVIWQGRVLNSQLTDEELRNLGRCPLTPEEIGLLLAALGFDSRTRIYLASHKDKRSLASEEELTNVEGKASVLAALDYYISMHSDIFISASPGNMHNALMAHRTFENMKTIRPNMALLGRIFVNKSMEWLEFQEAVQAGHKGRYGQIRLRKPKQSIYTYPAPDFRGKNHTSPVYRKLTSKQIVEHHRRFNEFVRDQQQFTRVFYEKTKPKSPMAEAAAKEVAGAAAAAGDMILLISSDGQRFEVAQAVASMSRLVRNMVEDECTDNGVPLPNVPSAVLAKVLEYCSEHAAAAAAAGEEVEELKSFDAAFIEVDNATLFDLILAANYLNVPCLLALACQRAADLIRGKTVEEIRAEFNIANDFTPEEEAEIRKENAWAFQD

SEQ ID NO: 10917 - protein, 414 aa, Arabidopsis thaliana; identical to SEQ ID NO: 1359

SEQ ID NO: 10918 - protein, 334 aa, Synechococcus sp. WH 7805
MAIRIGINGFGRIGRLAFRQAMTCPDVEVVGINDLIEVDYLAYLLRYDSTHRQFQGDIRVEDGALVVNDQPIRITAERDPSQLRWGEIGADYVLESTGFFLTAPLAQAHLDAGARRVVMSAPSKDDTPMFVMGVNHTSYAGQAIVSNASCTTNCLAPLAKVVHDNFGIVSGLMTTVHATTATQKPVDSPSLKDWRGGRGAGQSIIPSSTGAAKAVGRVIPELNGKLTGMAFRVPTPDVSVVDLTVNLDRPTSYENLKQTIKQASQNGLSGILGYTEDPIVSNDLLGESCTSVFDAGAGMALNDRFMKLVAWYDNEWAYSCKCIDLMRHMATHQS

SEQ ID NO: 10919 - protein, 534 aa, Ustilago maydis 521
MAGGAVADVGYTSTGPVARPVNVRQSLPAILVAAASAFGGVLFGYDTGTISGLLVMKNFKETFGQLLPDGKVDLTTNDTSLVVSILSAGTFVGALAGAPLSDILGRRWGMQVALFVFTIGVVMQMATTNLDVFIGGRVVAGLGVGILSTIVPMYQSETAPRWIRGAVVSGYQWAITIGLLCASLATYGTKNHDNSGAWRIPVGIQLAFAIILCIFFTILPESPRWLVKKGNHERASKSLARLNSTDVDDPIVRSELSVIQTNLDIELTHSTGSYLDCFKTNDRKYLLRSLTGIFIQAFQQLTGINFIFYFGTKFFETALPGSDPFIFSVISNVVNVVSTIPGMYMMERLGRRKLLIWGAVWMCLCELIVAVVGTAVPKENTSGGKTAVAFVCIYIAGFASTWGPAAWVVCGEIFPLAIRAKALSLCTASNWLWNFGIGYATPYLVDSGRGKAGLGAKVFFIWTGTCACCAVFAYFLIYETRLLSLEEVDEMYAQTNPIKSTAANAEIRARRSDLEGAVAPVKEDELATHDEKKY

SEQ ID NO: 10920 - protein, 490 aa, Novosphingobium aromaticivorans DSM 12444
MTAFDPDSIRPALAANFIGGEAVVGRGRSFEVLRPSDGQLLGELRAADEQQLCAAVENAAMAQKASGWGAMEPRGRMKLLRRWADLIEADAETLVPLEAVGSSRTLAEVRAWDLPYTAECIRFFAEFADKHGGEIAATTPDKLGFTLTEPYGVIGAIAPWNLPLVMAAWKLGPALAAGNAVVLKPSELTPFSVVRLAELAVAAGIPAGVFNVVQGGGGDIGDALVRHERIAKVSFTGSTRTGQAIMAACAMTGPKPSTLELGGKSPQIVFADADLAKASALVARAITLNSGQVCVAGSRLLVHEKARDEVVERLTTAFEAHRLGTTWDAATTMGPIISEGQLATIDGIVQRARAAGAEAVTGGARAVSPQSGSYYQPTLLAGMSDDNEAVQGEIFGPVLTVQSFADEDEAFALANGTRYGLAAGVHTTDISRALRAVRALEAGTVWVNRYGRSDDFILPTGGFKQSGVGKDLGREAYLGSCKVKTALIQI

SEQ ID NO: 10921 - protein, 378 aa, Novosphingobium aromaticivorans DSM 12444
MTAPEITADVAIIGGGLMGCSAAFFLRQRGLSVVLLETDKVGRQASGTNFGNVRRQGRPIFQLPLANRASRIWRQANELLGSDVEYLQNGHIRVCFRERPENVGKMEEYAAQAREEGLDLELLSGNVLRERFPFLGPDVIAGSHSALDGHANPRLAAPAFARAAMKLGAHVVEDTRIVHAAKIGEDFVLEAADGRRFRAPTLLVTAGAWAGKIVCQFDEPVKLTPRAPTMSVTEPVPYSILPAVGVMTPDEVETVYFRQVARGNVILGGSTRAPSYPDEYRSYVMPQNTMTQFQHLRRLAPALANLQVIRVWSGIEGYTDDGQPVMGPSATVPGLFYAFGFSGSGFQIGPGVGETMAEVIATGHTDIPLDPYSIKRFA

SEQ ID NO: 10922 - protein, 277 aa, Nicotiana tabacum
MAFFNRVGSILKQSVSKHSNLELSASNASLFQAIRSMSSSKLFVGGLSYGTDESSLKEAFSQYGDVIEARVIMDRDTGRSRGFGFISFPSSEEAASALQAMDGQDLHGRRIRVNYATEKRRAGFGGGYGGGGGGFNYGGEGGNSAGAGGYPTNNYGGGFSGGNTSAGGYGSYGGGSNYGNDNSSPAEGGVGYGSANYGNTPNSNYSGPGNSFSGGYDGGNNGNGFGESPGASFNGGQEQVSVDQGTQSINEDIGQETSEGNYRDDDDEPKDFANSRG

SEQ ID NO: 10923 - protein, 339 aa, Solanum tuberosum
MAFLNKIGNILKHGVGKNTNLELSASNGSLFQTIRSMSSSKLFVGGLSYGTDESSLKETFSQYGEVIEARVILDRETGRSRGFGFISFPSSEEATSAMQAMDGQDLHGRRIKVNYATEKRRDGFGGGYGGGNYGGEGGNFAGGGGYAASNYGGGGGGFSGGYNSSGGGGYNSAGGSGYGSSSGYTYGGEGGNVAGSGGYPTNNYGGGGTEFSSGNSSAGGYSSYGGGSSNYGNNSSPVEGGNYGSSTPNINHSGQGSSFSGGYGGGNSGNDFVGAPSNNNSFANTGFGGSSEASYNGSQEQVSADQGTQSINEHLGQETPEGNYRDNDDKPKDYANTRG

SEQ ID NO: 10924 - protein, 393 aa, Daucus carota
MTAPATRNDLMIVNMGPQHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELIYDLFEAATGMRMMHNFFRIGGVAADLPHGWIDKCLDFCDYFLTRVTEYQRLITRNPIFLERVEGVGIIGGEEAINWGLSGPMLRASGIQWDLRKVDHYESYDEFDWGVQWQKEGDSLARYLVRISEMTESVKIIQQALEGITGGPYENLEIRRFDKVWDPEWNDFDYRFISKKPSPTFELSKQELYVRVEAPKGELGIFLIGDKGIFPWRWKIRPPGFINLQILPQLVKRMKLADIMTILGSIDIIMGEVDR

SEQ ID NO: 10925 - protein, 390 aa, Pseudomonas syringae pv. tomato str. DC3000
MTQPYSARSRAIEPFHVMALLARANELQAAGHDVIHLEIGEPDFITAEPIIKAGQAALADGKTRYTAARGLPQLREAIAGFYAQRYQLDIDPQRILVTPGGSGALLLASSLLVDPGKHWLLADPGYPCNRHFLRLIEGEAQLVPVGPQERYQLTPELVASHWNPNSVGALVASPANPTGTLLTRDELAALSSALKARNGHLVVDEIYHGLTYGVDASSVLEVDNEAFVLNSFSKYFGMTGWRLGWLVAPPEAVADLEKLAQNLYISAPSMAQYAALACFEPQTLAILEQRRAEFGRRRDFLLPALRELGFGIAVEPEGAFYLYADISAFGGDAFAFCKHFLETEHVAFTPGLDFGRFQAGHHVRFAYTQSLPRLEQAVERIARGLRSWSA

SEQ ID NO: 10926 - protein, 487 aa, Oryza sativa (japonica cultivar-group)
MVPSFPQPASAAAATRPIPGSYGPPLLGPLRDRLDYFWFQGPDDFFRRRAADHKSTVFRANIPPTFPFFLGVDPRVVAVVDAAAFTALFDPALVDKRDVLIGPYVPSLAFTRGTRVGVYLDTQDPDHARTKAFSIDLLRRAARNWAAELRAAVDDMLAAVEEDLNRAPDPAAASASYLIPLQKCIFRFLCKALVGADPAADGLVDRFGVYILDVWLALQLVPTQKVGVIPQPLEELLLHSFPLPSFVVKPGYDLLYRFVEKHGAAAVSIAEKEHGISKEEAINNILFVLGFNAFGGFSVFLPFLVMEVGKPGRDDLRRRLREEVRRVLGGGDGGEAGFAAVREMALVRSTVYEVLRMQPPVPLQFGRARRDFVLRSHGGAAYEVGKGELLCGYQPLAMRDPAVFDRPEEFVPERFLGDDGEALLQYVYWSNGPETGEPSPGNKQCAAKEVVVATACMLVAELFRRYDDFECDGTSFTKLDKRELTPS

SEQ ID NO: 10927 - protein, 295 aa, Bacillus anthracis str. Ames
MTNVTGTERVKRGMAEMQKGGVIMDVINAEQAKIAEEAGAVAIMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPAKFARAIVEATTHYEDYELIASLSKGLGNAMKGIEISTLLPEQRMQERGW

SEQ ID NO: 10928 - protein, 446 aa, Candida albicans SC5314
MNQPNPNKQPIVQSTSEQTSNEEVDTVLGRFTLFVKDLSNGLNGSQEIPPSQESVSEEAEVISRKIIVLGQTFDNFDNANDYIESKLWLSYRCGFEPIPKSIDGPQPIQFFPSIIFNRSTIYSNFANLKSLFDKENFTSDAGWGCMIRTSQNLLANTLLKLYPKNEPEIVKLFQDDTSSPFSIHNFIRVASLSPLHVKPGEWFGPNAASLSIKRLASELLQDQEIDGIKIPRVFISENSDLFDDEIRDVFAKEKNASVLILFPIRLGIDKVNSYYYNSIFHLLASKYSCGIAGGKPSSSFYFLGYEDTDLIYFDPHLPQVVETPINMDSYHTTNYNRLNISLLDPSMMIGILVTNIDEYIDFKTSCLDINNKIVHFHPHTLPVQQDSIINQSWEEVQDEEEEFINLNVSKIENEQQQEQGQSTDAPDEFIDIGNQSSSVVSVPSNV

SEQ ID NO: 10929 - protein, 591 aa, Ustilago maydis 521
MPLTAEYKAKWPVFALAWSNHPSTSSSSSSFHPRNPSGSARYIPSSPSPLGRQDSLGGPPPSTTPGPPDSARIAVGSFVEQYTNRIQILGFDQRDSTSLTLLADASHPYPPTKLGFQPSTLFDASSSERREASLERERNPGERGYASPTTKLAKRGSWGAKARPSLSGEGVESPDYYPDRELLASTADCLRIWEIYRNEYSDPYQSSYVGGNGGGGVQQGEGSQLPFALREKSVLAHSKNTKSPPAPLTSFSWNTPSPNLIVTSSIDTTCTIWDLPTRTALTQLIAHDREVYDVDWCPGSADVFASVGADGSVRVFDLRSLEHSTIIYETGTAPGATESRPGTSMSMSSRATSTRSVPAAPLLRIAFNPWDANYLATFHLESDSVQILDVRAPGSPILELRGHSAAVNAIAWGPPSVGAGVLGPSKGMVCSAADDAQVLVYDLASTTLRTASAQGRRSRNGHAPSPAPGSLGYSHSTSSFGGTSSPAPTSSIAGSIGIGAEIPFLAYTTPNQDMVNNVSWLRAGGGGLPPGVGGFGGGGGGGSSSHKSVVQEWNEFTAGSTGGGSSSSGFAPHDSDWIALAAGNSVRALKV

SEQ ID NO: 10930 - protein, 71 aa, Triticum aestivum
SSGRPGRWRFEQSGGWIRALLEEAENERMHLMTFMEVANPKWYIFLVMTYSNCYFFSLRWQPKRTSAATTL

SEQ ID NO: 10931 - protein, 434 aa, Brassica napus
MGKENVVSRPLTRAFASALRASTTENQQRANTKRPASEDVNVTAPPNKKKKRAVLGDISNASFSAAKLEARDIKQVKKSQGLASASCVTSEVTDLQSGTEAKAEVVSVTAGNTNDTADNCIEKHKLPPRPLGRSSASIVEKSGVIRSSTALDLPKFTDIDSDDKDPLLCCLYAPEIYYNLRVSELKRRPVPNFMERIQKDVTQSMRGILVDWLVEVSEEYTLVPDTLYQTVYLIDWFLHGNYLERQRLQLLGITCMLIASKYEEINAPRIEEFCFITDNTYTRDQVLEMENQVLAHFSFQIYTPTPKTFLRRFLRAAQASYLIPRRELECLASYLTEVTLIDYHFLKFLPSVIAASAVFLAKWTLDQSNHPWNPTLEHYTTYKASDLKASVHALQDLQLNTKGCPLSAIRMKYKQEKFKSVAVLMSPKLLDTLF

SEQ ID NO: 10932 - protein, 252 aa, Triticum aestivum
MEPNMAPRRLWHVVRAVLFMLRKGMSKRKLSMDLQLLLHRGKIAGKALSRLMSAHGHHDQAASRSAAEAPPPASLSRRTLDPALAVYGPRGAGREVEFSCSNTPSYPPVQLIPAKRRRRNNRRTHRGANGAEPGWYNYDAADIAKVFEVLNDEQLLNEVVGDGGAAPPAVVATPSPALWSSFGRSPAPVRQLRITDSPFPLRDDAADLEGGLVDQEADEFIKKFYDQLRRQQNLAAATPEYGYAGRAAGVAY

SEQ ID NO: 10933 - protein, 368 aa, Oryza sativa (indica cultivar-group)
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENDLPIWVSNDGPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADRTIKTRGHFRTCDCDEACCNIQTSG

SEQ ID NO: 10934 - protein, 217 aa, Glycine max
MASTSSLHLSQALLARAVYLHGSSSDRVSLSFPSFSGLKSHSPCKAAATSSRRRGACASTSVVRAAAVETLDQTTEVSLVEKSVNTIRFLAIDAVEKANSGHPGLPMGCAPMGHILYDEVMRYNPKNPTWFNRDRFILSAGHGCMLQYALLHLAGYDSVLEEDLKEFRQWGSRTPGHPENFETVGIEVTTGPLGQGIANAVGLALAEKHLAARFNKP

SEQ ID NO: 10935 - protein, 951 aa, Vibrio parahaemolyticus RIMD 2210633
MKLVKRSDSVSKETNQLGVSRRAFMKNTSLAAGGAVVGASLFAPGMMKKAQAKSVDPEAKTEVKRTICSHCSVGCGIYAEVQNGVWTGQEPAFDHPFNAGGHCAKGAALREHGHGERRLKYPMKLENGKWKKLSWDQAIEEIGNKVMDIRKESGPDSVYFLGSAKHSNEQAYLFRKMASLWGTNNVDHQARICHSTTVAGVANTWGYGAMTNSFNDMHNCKSMLFIGSNPAEAHPVAMQHILIAKEKNNCKIVVADPRRTRTAAKSDHYVSLRPGSDVAFIWGVLWHIFENQWEDKEFIRQRVFGMDEIRAEVAKWTPAEVERVTGVSEEDVYQTAKLLSENRPGCIVWCMGGTQHTTGNNNTRAYCVLELALGNIGKSGGGANIFRGHDNVQGATDLGVLSDTLPGYYGLSEGAWRHWSKVWEIDYEWIKGRFDDNAYGGQKPMNSAGIPVSRWVDGVLENKDNIRQRENIRAMFYWGHAVNSQTRGVEMKKAMQKLDMMVIVDPYPTVAAVMNDRTDGVYLLPATTQFETYGSVTASNRSLQWRDQVIEPLFESKPDHEIMYLLSKKLGYSDLLFKNIRVENNQPVIEDLTREFNKGMWTIGYTGQSPERLKAHQQNWHTFHKTTLEAEGGPVNGETYGLPWPCWGTPEMKHPGTHILYDTSKTVAEGGGNFRTRFGVEFEGKSLLAEDSYSKGCEIKDGYPEFTDKLLKQLGWWDDLTAEEKAAAEGKNWKTDLSGGIQRVAIKHGCIPFGNAKARAIVWTFPDRVPLHREPLYTPRRDLVTDYPTWDDKDAIFRVPTLYKSIQEQDKSGEYPIVLTSGRLVEYEGGGEETRSNPWLAELQQEMFVEVNPKDANDLGFRDGDDVWVEGAEKGRIKVKAMVTRRVKPGLAFIPFHFGGKFEGEDLRPKYPEGTQPYVVGEAANTATTYGYDPVTLMQETKVTLCNIRKA

SEQ ID NO: 10936 - protein, 180 aa, Erwinia carotovora subsp. atroseptica SCRI1043
MTLKELVVGFGTQIRSICMVGSNAFKKRETRMYPEEPVNPPPRYRGRIVLTRDPDGEERCVACNLCAVACPVGCISLQKAETKDGRWYPEFFRVNFSRCIFCGFCEEACPTTAIQLTPDFEMGEYKRQDLVYEKEDLLISGPGKYPEYNFYRMAGMAIDGKDKGEAENEAKPIDVKGLLP

SEQ ID NO: 10937 - protein, 599 aa, Erwinia carotovora subsp. atroseptica SCRI1043
MTDLTTHDLAQPGWQTRDHLNDPVVGELCNRFGPDAFTVQATRTGIPVVWVKREQLLDVVTFLKKQPKPYVMLFDLHGMDERLRTHREGLPAADYSVFYHLISIERNRDIMLKVALAENDMHLPTVTKLFPNANWYERETWEMFGMAFDGHPNLTRIMMPKTWEGHPLRKDYPARATEFDPFELTKQKEDLEMESLTFKPEEWGMKRGTENEDFMFLNLGPNHPSSHGAFRIILQLDGEEIVDCVPDVGYHHRGAEKMGERQSWHSYIPYTDRIEYLGGCVNEMPYVLAVEKLAGIEVPDRVKTIRVMLSELFRINSHLLYISTYIQDVGAMTPVFFAFTDRQKIYDLVEAITGFRMHPAWFRIGGVAHDLPRGWERLLREFLDWMPARLDTYVKSALQNTILKGRTQGVAAYNAKEALEWGVTGAGLRATGIGFDVRKWRPYSGYENFDFEVPVGDGISDCYSRVMLKVEELRQSLRILDQCLKNMPEGPFKADHPLTTPPPKERTLQHIDTLINHFLQVSWGPVMPANESFQMVEATKGINSYYLTSDGGTMSYRTRIRTPSYAHLQQIPSVIRGCLVSDLIVYLGSIDFVMSDVDR

SEQ ID NO: 10938 - protein, 289 aa, Oceanospirillum sp. MED92
MGVNFMTTNYKETLHKGYGQAFDVEEVLFEQQTDSWHLIIFRNPVYGTVMALDGIIQTTERDEFVYHEMLTHVPILAHGKAKRVLIIGGGDGGILREVCRHKSVEHVTQVEIDQAVIDMCKEYLPNHSAGAFDDPRANIVIADGVEYVNSTDEKFDVIISDCTDPVGPGEVLFSSRFYEGCKSLLNEGGVFVAQNGVPFLQQDEVITTRRRLSPYFKDQSFYAVAVPTYIGGVMTLAWGSDNESLRQLDLSELQKRFADSGITTRYYNPQTHLGCFGLPQYLLDALDKA

SEQ ID NO: 10939 - protein, 253 aa, Brassica napus
MASDGGVSCLRRSEMMSVGIGGIDSPPLDVDEVHVLAVDDSLVDRIVIERLLRITSCKVTAVDSGWRALEFLGIDNEKASAELDRLKVDLIITDYCMPGMTGYELLKKIKESSSFRQVPVVIMSSENVITRIDRCLEEGAEDFLLKPVKLADVKRLRNYLTRDVQVSNGNKRKLPEDSPPLTLSHDSSDSSPPPSTLSPDSSDSSSPPLSPVEIFSSPLLSPLDDEDDDVLTSSPESTPSPVRRQKMRSPGLD

SEQ ID NO: 10940 - protein, 462 aa, Streptococcus thermophilus CNRZ1066
MAFEIIMPKLGVDMQEGEIIEWKKQEGDVVNEGDILLEIMSDKTNMELEAEDSGVLLKITRQAGEIVPVTEVIGYIGAEGEVVADNAAIAPAAEAAPQVEKVADVETPAAKPQPQVAIVHEGGKIRATPKARKVAREMGIDLAQVLGTGAKGRIHADDVENFKGAQPKATPLARKIAADLGIDLATVSGTGFGGKITKEDILAISAPAQVKVAAAAPAVEAKPEKVLPEGVEVIPMSAMRKAISKGMTHSYLTAPTFTLNYDVDMTNLIALRKQVLDPIMNKTGMKVTFTDLIGLAVVRTLMKEEHRYLNASLINDAQNIELHKFVNLGIAVGLDDGLVVPVIHGADKMSLSDFVGASKDVIKKAQAGKLKAAEMSGSTFSITNLGMFGTKSFNPIINQPNSAILGVSATIQTPVVVDGEVVVRPIMGLCLTIDHRIVDGMNGAKFMVDLKHLLENPMELLI

SEQ ID NO: 10941 - protein, 499 aa, Hordeum vulgare
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 10942 - protein, 344 aa, Streptococcus mutans UA159
MKKIVTLAGDGIGPEIMAAGLEVFDAVAQKINFDYEIEAKAFGGAGIDASGHPLPDDTLAAAKTADAILLAAIGSPQYDKAPVRPEQGLLAIRKELNLFANIRPVRIFDALRHLSPLKAERIAGVDFVVVRELTGGIYFGQHTLTENSACDINEYSASEIRRIMRKAFAIARGRSKKVTSIDKQNVLATSKLWRQIAEEVAKEYSDVTLEHQLVDSAAMVMITNPACFDVVVTENLFGDILSDESSVLPGTLGVMPSASHSESGPSLYEPIHGSAPDIAGKGIANPISMILSVAMMLRDSFGETAGAEMIEHAVNKTLTQGILTRDLGGLANTKQMTAAIIANL

SEQ ID NO: 10943 - protein, 380 aa, Magnaporthe grisea 70-15
MAQVRRMASTRIFPLVAFSMDRIEVQGVVSSSSRYIFNSSQRPLLSYSVAGRLTGQRRRTLSALAPRGAAKQDGCHPIPCRSFELVLGIGAKEEVTLHQLDVSAQEAPRDLLRVTEDICVKFATSSRRSSWCWTPLAARNPSNQVEDDEDEDDVDVMPVHSQLAKSIGPSLLSCQREPDHLEESLAPPRIVRNTPGSKSKKTFAEGWGQAETVRLLHSVTRDEMESVTALDRPAGPARLGGEPDGVIGSSVQRWSSLGSRLKAELQGCNQSATEIKKQQLTAQHSQLHIKMGHPVEEPPRNTQPEATREEMRDAMLPLAYRDNCANLLIPLNRCRKDTYYLPWKCENERHSYEKCQYDEFKLRVKKMDELREAKGGARSN

SEQ ID NO: 10944 - protein, 416 aa, Pyrococcus horikoshii OT3
MNKMKAVILAGGFGTRLRPISSTRPKPMVPVLGKPNLQYILEALEKVKEIDEIILSVHYMRGEIREFIQEKMRDYPKDIRFVNDPMPLETGGALKNVEEYVSDDFLVIYGDVFTNFDYSELIEAHKKNDGLITVALTKVYDPERFGVVITDEEGKIVEFEEKPRKPKTNLVDAGIYMVNKDVLKEIPKNKEIYFEREILPKFVNQGLVYGYKMPKQYYWVDLGTPEDFFYAHQIALDELSKENGYMILGENVEIPDDVEVQGPVYIDDNAKIGHGVKIKAYTYIGPNTIIEDKAYFKRSILLGNDIIKERAELKDAILGEGVVVGKDVIIKENAVIGDYAKIYDNLVIYGAKVLPWKKVEEYEAYIKIKLDPTKVRPGQYPDHCPLGLPECIYKKFKAIAGEKPPCDECIENQWLF

SEQ ID NO: 10945 - protein, 588 aa, Glycine max
MSSSFSVRFLAPPSSCFPSSRPKTWLCAATTPTVAPATASSEVEASRLEPRVEERDGFWVLKEEYRGGISPQEKVKLEKDPMKLFMEGGIEDLAKMSLEEIESSKHTKDDIDVRLKWLGLFHRRKQHYGRFMMRLKLPNGVTTSAQTRYLASVIRKYGKDGCADVTTRQNWQIRGVVLPDVPEILKGLDEVGLTSLQSGMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELGIEVFRSEVEKRMPGKQLERASEEELVKKKWERRDYLGVHPQKQEGLSYVGIHIPVGRVQADDMDELARLADEYATGELRLTVEQNIIIPHVDNNKIDGLLNEPLLKGRFSPEPSLLMKTLVACTGNQFCGQAIIETKERALKVTEEVERQVAVTRPVRMHWTGCPNTCGQVQVADIGFMGCMARDDNGKATEGVDIFLGGRIGSDSHLAQVYKKGVPCKDLVPVVVDILVKHFGAVLRNREEGED

SEQ ID NO: 10946 - protein, 529 aa, Nocardioides sp. JS614
MSALRTPSPVERPGEHHVEHHVEHLVVGAGFAGLCTAIRLQEDGEADFLVVEKAGDVGGTWRDNTYPGAACDVPSQLYSFSFAPNPDWTMSFSPQPEIWAYLRRVARESGTLDRFAFHTRLEHATWDEVAQRWRSRLVGPDGERTVTSTTLVVGAGGLSEPRLPEIDGIETFEGELFHSARWNHDVDLSGKRVAVVGTGASAIQIVPELQRTLEATGGHLDVYQRTAPWVIPRHDRRYPAWERAALRHVPGLQRLYRTAVYWARETYVPAFTIEPKIATPAKRAALANIERGIADPELRAQVTPHYEIGCKRILISNTYYPALDADNVELVTDPIVKVTGSAVVTADGVERPVDVLVVATGFYTTELPITEHVTGREGRTLADVWRSSGMAAYKGTTVPGFPNFFMLVGPNTGLGHSSMVFVIESQVEYLRGAVRTIRRGGYAAVEPRQEAHDAWNGDLQRRMRRTVWSTGGCSSWYLDEHGRNTTLWPKSTVTLRRQLARFDTDAYHLRAAAPTTIPQPSPQGEEAHA

SEQ ID NO: 10947 - protein, 500 aa, Citrus sinensis
LLLIPLLLILKKLKAQNKQQLPPSPPKLPVIGNFHQLGELPHQSLWQLSKKYGPVMLLKLGRVPLVVISSAEAARDVLKVHDLDCCSRPPLIGSGKFTYNYSDIAFSPYSDYWRELRKISVLEVFSLRRVQSFGFIREEEVALLMNSISESSSSASPVDLSEKMFALTGSIVFRMAFGRRFRGSNFDNHSFQELVHAVESLLGGFAAAECFPYVGWIIDRLNGYHAKLERVFQELDTLFQQIIDDHLKPAETTKQEHVQQDIIDVMLKIERDQAESHESEAWLTKNHIKAVLLNIFLGGVDTSAITVIWAMAELCKNPRLMKKAQAEIRNHIGNKGRVTEADIDQLQYLKMVIKETLRLHPPAPLLIARDTLYRFKVNGYDIYPKTLIQVNAWAIGRDSKYWESPEEFIPERFIDKPVDVKGQDFEYLPFGSGRRICPGINLGLIMSELALANLLYCFDWKLPNGREEDCVNMNMEEATGVSLTLSKKTPLILVPVNYLQ

SEQ ID NO: 10948 - protein, 280 aa, Nocardioides sp. JS614
MRTLDDKVCVVTGAGSGIGRALALNLAGRGARLALSDVDDIGLAATVDQVRAAGGREVRSDHLDVADRDAFASYAADVAGHFGRVNVAINNAGVALAGNFEDLEYPDMDWIIGVNFWGVVHGTKEFLPHLIASGDGHLVNISSLFGLVSMPGQSMYNASKYAVRGMSEAVREEMLIAGHPVGVTVVHPGGIKTAIARNARVSSREDKEKTARLFDEKLAKMTPERAAEIIVRGILHNRARVLVGLDAHAVHHLAKLTGSRYQDILAKAAGRVLPDQTTAV

SEQ ID NO: 10949 - protein, 330 aa, Ustilago maydis 521
MNRGSGPQNIFRTLERLRQQAQQASQQFNNAGKPGGSSGGSGGSGGGGRGGPPNLANILGGSAGIVALVALGFGVNMSLFNVDGGHRAIKYSRLSGIKDTIFNEGTHFMIPWFEKPIDYDVRAKPRSIASLTGTKDLQMVSLTCRVLSRPRIDALPTIFRELGVDYDERVLPSIVNEVLKSVVAQFNASQLITQREMVSRLVRDNLTARAQRFNLVLDDVSITHVSFSPEFTHAVEAKQIAQQAALRAAFLVDQAIQEKASIIVKAQGEAKSAELIGEAVKKNKGFLKLRKLEAARDIATILSQAGSNNKVLLDADTLLLNVANEDPLHS

SEQ ID NO: 10950 - protein, 540 aa, Oryza sativa (japonica cultivar-group)
MGMRGVGLGFLVRWCLWLIGAEWKCYRWRIWGDLEELDLIATLMAVGETGGWSAISPGSGSGAGLGDPRISGSTYDLFWDGHCFKSKHTLFYIPATLVAFNQVPHFKKSICYYDRTDGGSLSADKWNGYVNKDDRALLKVINTLVNLRFFIMKVVFPKMLGETLAYMSMTRPRKEIYYEPAEVKAAIVTCGGLCPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 10951 - protein, 458 aa, Oryza sativa (japonica cultivar-group)
MDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILEPRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 10952 - protein, 1230 aa, Cryptococcus neoformans var. neoformans
MSSFTPAFRLHHTHSSSVSPTASNDVAPSSPTPNQPHQLAARSPLYANSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIGGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 10953 - protein, 193 aa, Podophyllum peltatum
MGGEKAFSFIFLLFLCFFLANLSASSAHPPRQKLKQRIPCKQLVLYFHDVVYNGHNKANATASIVGAPQGADLVKLAGENHFGNVVVFDDPITLDNNFHSPPVGRAQGLYVYDKKDTFHSWLSFSFTLNTTMHQGTLIFMGADPILIKNRDITVVGGTGDFFMARGIATIATDSYEGEVYFRLKVDIKLYECW

SEQ ID NO: 10954 - protein, 379 aa, Glycine max
MGEGENTEIETETESEATSTWSLGKHTQIIELSETLTNGNLSAKIEAAREIRKMVRKSSSSSSKTRAKLAAAGVIEPLVLMLSSSNVDARQSSLLALLNLAVRNERNKVKIVTDGAMPPLVELLKMQNSSIRELATAAILTLSAAASNKPIIAASGAAPLLVQILKSGSVQGKVDAVTALHNLSTSIANSIELLDASAVFPLLNLLKECKKYSKFAEKATALLEILSNSEEGRTAISIADGGILTLVETVEDGSLVSTEHAVGTLLSLCRSCRDKYRELILKEGAIPGLLRLTVEGTAEAQDRARVLLDLLRDSPPEKRLTSSVLEKIVYDIAERVDGADKAAETAKRLLQDMVQRSMEHSMKCIQHRAASCTPSIPST

SEQ ID NO: 10955 - protein, 180 aa, Triticum aestivum
WLRRRWDPGSRAGLESMQGLALDIIIAQAGARPAAVFDCASTHLRADVIEDASCCIFCRRDLGLYARREPEDSQFPSSKIEKNLGAECFCTISFNPWNKRERHSLDPSPPKGPPEAFSLTTKIFSPKEISENSKKILRRWSSVLSLFKSPSTSGSGSLEPHLPPILGNPINPPPHVALSF

SEQ ID NO: 10956 - protein, 238 aa, Triticum aestivum
  misc_feature (32)..(32): Xaa can be any naturally occurring amino acid
  misc_feature (77)..(77): Xaa can be any naturally occurring amino acid
  misc_feature (99)..(99): Xaa can be any naturally occurring amino acid
  misc_feature (126)..(126): Xaa can be any naturally occurring amino acid
MAELLRAAGFFDLRAAAPFVVAAAVALYFLVXEQLSYLRKKGPLPGPSLVVPFLGSAVRMIRHPTGGGDAQAARAKXSGAGLAADFLFGRFIVFVRDSXELSHRVFPNVRPDPFHLIGHPFGKRLXFGDHNLIYMFGRGPPRTWRPPDPPPNFTPPRALHLRPPSSRRVIPWAHPGGPRPATPPQAEGHGPIPGPPRPRTLEPWREANNGGLVAASLPLSQKGPQQTRLPPTAHTLHL

SEQ ID NO: 10957 - protein, 359 aa, Oceanospirillum sp. MED92
MSKNVLILPGDGIGPEIVTEARRVLELVNEQDNLGLELTEALLGGAAIDAEGVPLPDATLEAAKASDAILLGAVGGPKWDTNPDFQIRPEKGLLGIRSQLELFGNLRPAILYPQLAHASTLKPEVVSGLDILIVRELTGGIYFGQPRGVREKEGGIREGYNTYVYDENEIRRIGRVAFEAAMARDKRLCSVDKANVLEVTVLWREIMEDLAKEYPEVELSHMYVDNAAMQLVRAPKQFDVMVTGNMFGDILSDAAAMLTGSIGMLPSASLDESGKGMYEPCHGSAPDIAGQGLANPLATILSAAMMLRYSLGAGETADRIEAAVSKVLDQNLRTADIMSEGMQQVSTSEMGDAVVAALQ

SEQ ID NO: 10958 - protein, 1060 aa, Streptococcus agalactiae NEM316
MPKRTDIRKIMVIGSGPIVIGQAAEFDYSGTQACLSLKEEGYQVVLVNSNPATIMTDKDIADKVYIEPITLEFVTRILRKERPDALLPTLGGQTGLNMAMALSKNGILEELNVELLGTKLSAIDKAEDRDLFKQLMEELNQPIPESEIVNSVEEAIQFAEQIGYPLIVRPAFTLGGTGGGMCDNQEQLVDITTKGLKLSPVTQCLIERSIAGFKEIEYEVMRDAADNALVVCNMENFDPVGIHTGDSIVFAPAQTLSDVENQLLRDASLDIIRALKIEGGCNVQLALDPNSFKYYVIEVNPRVSRSSALASKATGYPIAKLAAKIAVGLTLDEVINPITKTTYAMFEPALDYVVAKMPRFPFDKFESGDRKLGTQMKATGEVMAIGRNIEESLLKACRSLEIGVDHIKIADLDNVSDDVLLEKIRKAEDDRLFYLAEALRRHYSIEKLASLTSIDSFFLDKLRVIVELEDLLSKNRLDINILKKVKNKGFSDKAIASLWQINEDQVRNMRKEAGILPVYKMVDTCASEFDSATPYFYSTYAVENESLISDKASILVLGSGPIRIGQGVEFDYATVHSVKAIRESGFEAIIMNSNPETVSTDFSISDKLYFEPLTFEDVMNVIDLEKPEGVILQFGGQTAINLAKDLNKAGVKILGTQLEDLDRAENRKQFEATLQALNIPQPPGFTATTEEEAVNAAQKIGYPVLVRPSYVLGGRAMKIVENEEDLRHYMTTAVKASPDHPVLIDAYLIGKECEVDAISDGQNILIPGIMEHIERAGVHSGDSMAVYPPQTLSETIIETIVDYTKRLAIGLNCIGMMNIQFVIKDQKVYVIEVNPRASRTLPFLSKVTHIPMAQVATKVILGDKLCNFTYGYDLYPASDMVHIKAPAFSFTKLAKVDSLLGPEMKSTGEVMGSDINLQKALYKAFEAAYLHMPDYGNIVFTVDDTDKEEALELAKVYQSIGYRIYATQGTAIYFDANGLETVLVGKLGENDRNHIPDLIKNGKIQAVINTVGQNNIDNHDALIIRRSAIEQGVPLFTSLDTAHAMFKVLESRAFTLKVLD

SEQ ID NO: 10959 - protein, 861 aa, Novosphingobium aromaticivorans DSM 12444
MTMKDIRTTCAYCGVGCGIRATVTGDRAVSIKGDPEHPANFGRLCSKGTHLGETVGLEGRLLHPMVDAERATWNEALDLAAARMRECIERHGPDSVAFYVSGQLLTEDYYVANKLMKGFIGSGNIDTNSRLCMASAVAAHNRAFGEDLVPCTYDDLEAADLVLLVGSNTAWCHPVIWQRIEAARSARGTRLVVIDPRRTETAEQADLHVALAPDGDIALFNALLAEMRDRDLLDEAFMAERCAVPEGYVAGLDPRGHGIDPATFRALADLVAASPRMVTLFSQGANQSRCGTDKGNAIINLHLALGRISQTGAGPFSITGQPNAMGGREVGGLANMLACHLGFSSEERADAAIFWNAPNICAGPGLKAVDLFRAVHDGRVKFVWVMATNPAVSMPDAGFVREALARCETLVVSDVIADTDTARLAHIRLPALAWGEKDGTVTNSERRISRQRALFEAPGQARADWAILCDFAERMGWGRAFAFPTAAAIFREYAAMTALAGARGKALDLSHLAGLGDAAYEALEPTLWGGVHPTARTFSHPDGKARLVAVEAPVAAPADPEFPFRLNTGRYRDQWHTMTRTGLSPTLSQHRREPLLEIHPEDAALAGIEDGGLARLATRVGATVFRVLHSTAQRRGDLFVPMHWTDAMAGEGRANRLPLQETDPLSGQPGFKDTPARVEPVVPEWRAFLATRDEAALPSLLWWSRAKVANGWLCELAGNGAPDLEVILPKGTWLEAADMVRGMRRIIVLDKAGGLLAALYLTRNGELPPRDWVAAQIGNAEASALELLAGRPAVALPDRGPIVCVCHGVGVNEIAAAACAGAMTLEAIAGCTRAGSNCGSCRPAIARMLDEMNLDTQEAAE

SEQ ID NO: 10960 - protein, 303 aa, Ipomoea batatas
RMDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 10961 - protein, 660 aa, Bacillus anthracis str. Ames
MTEENKSFYITTPIYYPSGKLHIGHAYTTVAGDAMARYKCMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVILIDRYGLDALRYYLLREVPFGSDGVFTPEGFVERINFDLANDLGNLLNRTVAMIDKYFNGEIPAFKANVTEFDETLVTFAKDTLKKVEEAMENMEFSVALSSIWQLVSRTNKYIDETQPWVLAKDEDDREKLASVMAHLAEVLRQTGIMLMPFLTVAPSKMFAQLGLTDEAHTSWGSLSTIGCIPAGTKVEKGQPIFPRLEMDVEVAYIKEQMKASAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNIPNGTKIK

SEQ ID NO: 10962 - protein, 362 aa, Bacillus thuringiensis serovar konkukian str. 97-27
METTVRKQKKNLETKKTSIYSLQLHEMQDWLKEQGEPKFRAGQIFDWLYKKRVKNYEDMSNLSKGLREKLSNSFDITTLNTLVKQTSSDGTIKFLFQLYDGYSIETVLMRHEYGNSICVTTQVGCRIGCTFCASTLGGLKRNLEAGEIVAQVVEVQRALDESEERVSSLVVMGIGEPFDNYDNLMGFLRIINHEKGLHIGARHMTVSTSGIIPKIYKFAEEDLQINFAISLHAPNSELRSKLMPINRAYKLPDLMEAIKYYVNRTGRRITFEYGLFGGENDQVEHAEELAALLKGVKCHVNLIPVNYVPERDYVRTPREQIFLFEKTLKDRGVNVTIRREQGHDIDAACGQLRAKERKEETR

SEQ ID NO: 10963 - protein, 144 aa, Arabidopsis thaliana
  misc_feature (57)..(57): Xaa can be any naturally occurring amino acid
  misc_feature (94)..(94): Xaa can be any naturally occurring amino acid
  misc_feature (116)..(116): Xaa can be any naturally occurring amino acid
MVFCTAHATVRDPFIGLKYSSAFPATRKALKDITSITSNGSRVNCMQVWPPIGKKKXETLCYLSDLTDSKLAKEVDYLIRARWIRCDELELKHXVVFREHGHSPGYYDGRYWTMCXLTLFGCSESPVLLKEVVECRKEYPTAFI

SEQ ID NO: 10964 - protein, 200 aa, Brassica napus
  misc_feature (176)..(176): Xaa can be any naturally occurring amino acid
MVRFIEESTKHVDKETGNKSNTDVTTAKKKVLQDLIINNGGGLINSWVDSMRACSPTHLKSLMKQSSWLKEHPSALEMFEEILHASEGKQIVMFLDYDGTLSPIVDDPDQAFMSKQMRRTVRNLANCFPTAIVSGRCREKVYNFVKLTELYYAGSHGMDIKGPEQGSKYEADKISXFCQPATEFLPMIDEVYQRLMGKTK

SEQ ID NO: 10965 - protein, 367 aa, Torenia hybrid cultivar
MARAGPLTLTSLALEKSLHEKFIRDEDERPNLAYDQFSSQIPLISLSGIDDECNKRKELCKRIAQACEDWGIFQVIDHGIDLKLVNDMTRLAREFFDLPDEEKLRFDMSGGRKGGFIVSSHLQGEVVQDWREIVTYFTYPIKGRDYSLWPDKPEAWRAVTETYSSQLMCLGCKLLGILSEAMGLEREALTKACLNMDQKVVVNFYPKCPQPNLTLGLKRHSDPGLITLLFQDNVGGLQATRDGGKSWITVQPVEGAFVVNLGDFAHYLSNGRFKNADHRAVVNSNTNRMSIATFQNPSPEAIVYPLKIGDDGKPIIEKPITYGEMYKRKMAKDIELAKLKKLAKEQKLQEEVVNNVEDHHLNNGKTK

SEQ ID NO: 10966 - protein, 469 aa, Rhizobium leguminosarum bv. viciae
MATASEILKQIKENDVKFVDLRFTDRRASLQHVTMDVVCVDEDMFADGVMFDGFSIGGWKAINESDMVLMPDTETVHMDPFFAQSTMVIVCDILDPVSGEAYNRDRRGTAKKAEAYLKASGIGDTVFVGREAEFFVFDDVKYKADPYNTGFKLDSTELPSNDDTDYETGNLGHRPRVKGGYFPVPPVDSAQDMRSEMLTVLSEMGVVVEKHHHEVAAAQHDTLVRNADELGIKFKMQIYKYVVHQVANAYGKTATFMPKPIFGDNGSGMHVHQSIWKGGKPTFAGDEYAGLSESCLFYIGGIIKHAKAINAFTNPSTNSYKRFVPGYEAPVLLAYSARNRSASCRIPFGSNPKAKRVEVRFPDPTANPYLAFAAMLMAGLDGIKNKIHPGKAMDKDLYDLPPKELKKIPTVCGSLRQALESLDKDRKFLTAGGVFDDDQIDAFIELKMAEVMRFEMTPHPVEYDMYYSA

SEQ ID NO: 10967 - protein, 486 aa, Hyphomonas neptunium ATCC 15444
MPLKLKDSSLLKSEAFIGGAWRAATSGETFEVTNPATGETLISVPKMGADETREAIDAAAKAFPEWAALLAEKRSAILRQWFDLLMENQADLAALMTAEQGKSLTESKGEIAYAASFIEWFSQEARRTYGDIIPSHTPTARILVTHEPVGVTAAITPWNFPAAMIARKAAAALSVGCTMVVKPASATPLTALAMAVLAERAGIPAGVLSVITGSAGDIGGELTSNPKVRKVSFTGSTETGKKLMQQSASTLKRLSLELGGNAPFLVFDDADLDAAVEGAIASKFRNSGQTCVCANRFLVQDSIYDAFAEKLQKAVSKLKVGNGMDEGVDQGPLINDDAVETVKAHIEDAVTKGARIALGGKPHALGGTFFEPTILLDVPKTARLAREETFGPVAALFRFTDEAEAIAMANDTEFGLAAYAYTKDLARAFRVSAALDYGIVGMNEGLISTAIAPFGGRKESGFGREGSKYGVSDYLDIKYTLMGGLG

SEQ ID NO: 10968 - protein, 415 aa, Nocardioides sp. JS614
MARISRKNVLVICLAGGEGKRLMPLTADRAKPAVPFAGIYRLIDFALSNVVNSGFLKVVVLTQYKSHSLDRHVTQTWRMSTMLGNYVTPVPAQQRVGKHWYLGSADAIYQSLNLMRDERPDYVVVVGADHVYRMDFYQMVKAHAESGAACTVAAIRQPIELADQFGVIDVHPDDPSRIREFLEKPTDPVGLPDSPGEVLASMGNYVFDADALVEAVTRDATEIGSKHDMGGDIVPAFVRRQQAAVYDYKDNDVAGSTDRDRGYWRDVGTLGSYYAAHMDVVSPLPVFNLYNFDWPIYTSYGPQPPAKLVQGASGDLPGVDEAVLSPGVVVTGGQVQRSVLSPSVRVDTGAEVTGAVLMNGVYVGAGAVVRNAILDKNVVVPPGAQIGVDPEADRARGFVVEDGLTILGKDQAFPT

SEQ ID NO: 10969 - protein, 831 aa, Novosphingobium aromaticivorans DSM 12444
MNAPTSFSQKDQPAQARERLVVIGNGMAGCRAVEEILARDPARFDVTIFGAEPRVNYNRIMLSPVLAGEKAFDDIVINDASWYADNGITLVSGDPVVSIDRETQTVVARSGRVEPYDRLLIATGSDPFIIPVPGHDLPGVVTFRDLDDVERMLAASERGGSAVVIGGGLLGLEAAHGLALRGMKVTVVHLMPTLMERQLDEAAGYLLRSELERRGQTIVTGGDTAEILGRDGHVSGVKLKDGREFAADIVVMAVGIRPATGLARAAGLDVERGILVDDHMMTSDPAVMAVGECVQHRGQCYGLVAPLWDMCRALADCVTGNPSGYEGSVTSTKLKVSGIDLFSAGDFSGGEGAEDIVMRDASRGIYKRVIVREDRVVGAVLYGDTGDGSWYFDLLKKGEDISEIREALIFGQAFAAGGALADPNAAVAALSDDAEICGCNGVSKGKVVETIKGGACSLDAVRSQCKASASCGSCTGLVESLLRLTLGGEVEAGPKTMCKCTSFTHSDVRRLIVEKNLRLIPQVMQELGWSTPDGCASCRPALNYYLLCAWPGEYEDDQQSRFVNERMHANIQKDGTYSVVPRMWGGLTNPRELRAIADVVEKYNAPMVKVTGGQRLDIFGIRKEDLPAVWADLNAAGMVSGHAYGKSLRTVKTCVGSEWCRFGTQDSTGLGVKLEQMTWGSWMPHKFKIAVSGCPRNCAEATIKDFGVVCVDSGYELHVGGNGGIKVRATDLLCRVATEAEAMEVCAAFIQLYREQAWYLERTAPWIERVGLEHVKAALFDDPEAVATLAARFRHSQQFMQDDPWAKRARGADAELHQHLAEVRPFQMENA

SEQ ID NO: 10970 - protein, 809 aa, Solibacter usitatus Ellin6076
MAKQNPITPVVAGDARRHLPLLLLLFAGSGCSALIYEIVWYQLLQLVIGSSAVSLGVLLATFMGGLCLGSLLLPRLKAAGQHPLRVYGKIEFGIAVCGILVLFVMPLVDSVYTSAVGHGLPAILLRALVCALCLLPPTFLMGASLPAASRWLKATPEGVSWLGLLYGANTVGAVMGCLLAGFCLLRVFDMATATFIAAAINVTVGLVSFGLAKRSPEYPPASDSRVVIAPGAWPVYVTIALSGATAMAAEVVWTRLLGLMLGATVYTFSIILAVFLVGLAIGSTGGAMAARTAKSPKALLGWSQMLLAAAIAWTAYMLSESLPYWPVNPLLSTSPWYTFQIDLVRCIWAIFPAALLWGASFPLALAAAASEEGDPGRLVGGIYAANTGGAILGALGTSLILVPAIGTASSQSVLIALCAVSGLLMLVPLLKSMRISNALMVGAALVIAIMLAGSVSPVPGMLIAYGRRMMTSMGRSKVLFTGEGINSSIAITEWDDGAVQFHVSGKVEASTESYDMRLQRMLGHLPALMHKEPKSVLIVGFGAGVTAGSFVPYPSIQRIVICEMEPLIPPTATKYFGKQNYFVMNDPRTQVIYDDARHFVLTTREKFDIITSDPIHPWVKGSATLYSKEYFELVKQHLNPGGVITQWVPLYESDPETVKSEIATFFDAFPNGTIWGNDISGGGYDIVLLGQVDPAKIDLDAMQARLDRPEGARVQESLREVGFGNVVQLLATYAGQEPDLRPWLAGAQINRDGNLRLQYMAGLALNVSREGAIYSEMLGYRRWPDSLFTGSEDKRRALRYALDPRSVGQ

SEQ ID NO: 10971 - protein, 483 aa, Oryza sativa (japonica cultivar-group)
MTTPHGLLQYSSGAFSDQVPADDSAEEHGVKDHAMLAPFTAAWQTAISPPLVIERSEGCYVYDVNGTKYLDALAGLLSTALGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGLPTLHQDFDLPGRFVLHTDCPHYWRFHLPGETEEEFATRLADNLENLILKQGPETIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 10972 - protein, 400 aa, uncultured bacterium 582
MALLSDTLARVKPSPTVAMSSKAIEMRAAGRDIISLSAGEPDFDTPENIKSAAIAAILAGKTKYTAPDGIIELKQAICDKFLRDNALRYRPEQVSVGTGGKQVLYNALMATLNPGDEVIIPAPYWVSYPDMVYLAGGEPVILETSVERGFKLSAEALEAAITPRTKWFIFNSPSNPTGAGYHWDELRALTEVLQRHPHVWILSDDIYEHLVYDNFKFCTPAEVAPDLMDRTLTVNGVSKGFAMTGWRIGYAAGPRALIAAMRTIQGQSTSNPCTVSQWAALEALNGPQDYIASNNILFRTRRDLVVAQLNAIDGITCPTPEGAFYVYASIDGLIGKTTAAGVLLANDEAFAMQLLEEANVAIVFGAAFGLSPCFRVSYAASEDTLKAACTRIAEFCAALT

SEQ ID NO: 10973 - protein, 246 aa, Magnaporthe grisea 70-15
MARNSEKAQSMLFRFREAQAADLGIIDAGRTRRPRAITEQDSIPACEKWRGQVLKDISRKVSRIQESSLSDYQIRDLNDEINKLMREKHMWEVQIRNLGGPNYTRAGGAKVYDEAGKEIGGAGRGYRYFGRAKELPGVKELFEAARAKKGDEKPLEARDDLRKQVDAAYYGYSPDEEDDELLAYEAAKEKEAFENLADNRKGEQLPPGWEPLPGDNGDGKGWELPTVEEVQQELINRRKQRLLNQL

SEQ ID NO: 10974 - protein, 556 aa, Rhizobium leguminosarum bv. viciae
MYRYDEFDHAFVTERVEQFRDQVERRLSGELAEDAFKPLRLMNGVYLQLHAYMLRIAIPYGTLSSRQLRMLAHIARTYDRGYGHFTTRQNLQFNWPKLSDIPDALADLASVEMHALQTSGNCIRNVTADHFAGAAADEIADPRPYAEILRQWSSVHPEFSFLPRKFKIAVTGAERDRAAIQVHDIGLHVKKNDKGEIGFAVYVGGGQGRTPMIAKLIRDFLPEEDLLSYTTAIVRVYNLHGRRDNKYKARIKILVHETGTEELTRQVEAEFAALKDTELKLPEKDVQSIAAYFAPPDLPQRAEGWENLARWKKADSGFSRWVQQNVQPHKNPDYGMVTISLKPIGGIPGDASDAQMDAIADLAEEYAFDEIRVSHEQNLILPHVALADLEAVYRGLVAINLAEANAGLITDIIACPGLDYCALANARSIPLAQEISRRFGNAERQAEIGELKIKISGCINACGHHHVGHIGLLGVEKKGAELYQITLGGSGDEHTSIGEIIGRGFEPDRVTDAIETIVDTYLGLRLDHSENFLAAYRRVGPQPFKTALYGSAAEAA

SEQ ID NO: 10975 - protein, 103 aa, Zea mays
MTGRGKGGKGLGKGGAKRHRKILRDNIQGITKPAIRRLARRGGVKRISAVIYEETRGVLKTFLEGVIRDAVTYTEHAKRKTVTSLDVVYALKRQGRTLYGFGG

SEQ ID NO: 10976 - protein, 420 aa, Bordetella parapertussis 12822
MDEIQSIVIVGAGQADAVAAASLRQLGYRGGLTLIGQEAHPPYERPPLSKAVLQGTATHAEAAVHPAGFYAENDIALLTETAVAALDPIARTVRLADGRTLPYDRCLLATGGHARELPALPRGRAGVHYIRTLNDALDLRAALRPGVRAAVIGGGFLGLEVASTARELGAEVTVIENGSRLLERALPAIVSDWLAERVRASGVDLRLGGAIAAIGDGPPYAITLADGTQVNADLIVVSIGLAPEVTLARQAGLPLDDNGGICVDAQARTADPHVYAAGDCASQPRACLGTAARFESWQNANEQARAAATAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAVAVA

SEQ ID NO: 10977 - protein, 124 aa, Bacillus anthracis str. Ames
MKVVQTNNAPQAIGPYSQGIIVNNMFYSSGQIPLTASGELVAGDVTVQTEQVFQNLQAVLEEAGASFDTVVKTTVFLKDMDDFNAVNEVYGSYFSAHKPARSCVQVAKLPKDVSVEIEVIALVK

SEQ ID NO: 10978 - protein, 425 aa, Oryza sativa
MPATDSSSAAAPLTSFGRSFLSHRRDQIPPPPPDHHSHSHTQHPSSSDLEIDAFHRHAADLLHDLLSDSNADPSAPDLLSLAWTRRLLDSFLICLEEFRAILFALADSQPLSRPPLDRLLLDFLDRAVKALDLCNALRDGLDLIRQWRKHLAIAAAALAPAPAAQRGEAQIRRARKALTDLTILMLDDKDAGGVVGQRNRSFGRAGTTRDSLPHGHGHHRRSSSGGSSGSGSGSHLRSLSRSVSRTWSAARQLQAIGGGLTVPRANDIAATGGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAG

SEQ ID NO: 10979 - protein, 552 aa, Oryza sativa
MWAPASSPTILAAFGLVGLVLAWQAGLQLHRLWWRPRRLEKALRARGLRGSRYRFLTGDLAEEGRRRKEAWARPLPLRCHDIAPRVEPFLHGAVGVGAAHGKPRITWFGPTPEVHVADPELARVVLSNKFGHFEKVSFPELSKLIPQGLSAHEGEKWAKHRRILNPVFQLEKLKSILFLYLIIEMSSENVQLMLPVFSACCEELISRWMGSIGSDGSYEVDCWPEFKSLTGDVISRTAFGSSYLEGRRIFELQGELFERVIKSIQKMFIPGYMYLPTENNRKMHQMNKEIESILRGMMGKRMQAMKEGESTKDDLLGILLESNTRHMEVNGQSNQGLTIKDIMEECKLFYFAGADTTSVLLTWTMLLLSMHPEWQDRAREEILGLFGKNKPDYDGLSRLKIVTMILYEVLRLYPPFIELTRKTYKEMEIGGITYPAGVIINLPVMFIHHDPEIWGSDVHEFKPERFSEGISKASKDPGAFLPFGWGPRICIGQNFALLEAKMALCLILQRLEFELATSYTHVPHTIISLHPMHGAQIKVKSYMTISDYSVFY

SEQ ID NO: 10980 - protein, 182 aa, Zea mays
MSPPTQPQLKDKAAHEVPRATAASAVASLTKWMRERAAEAPPNLLADERDDLVVLQLSLRRVPPKPTTKPHLLPLPHPVVAHSAASVCVISDDRAGSCSPAAAAILDAARSLKLPVSEVVPFSALRTDYRPYESRRRFAASYDLFLADRALLPMLPRLLGKSFYSTKKAPIAVDFTRAGWGA

SEQ ID NO: 10981 - protein, 346 aa, Cytophaga hutchinsonii ATCC 33406
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 10982 - protein, 160 aa, Nocardioides sp. JS614
MHPLVVIGVSGSGKSTVGAALAQRLRVPYEDADDLHPPENVAKMSAGHALDDDDRYPWLEAVGGWLAEHPDGGVMACSALRRKYRDQLRRHAPVVEFVLLEGTPEVIGRRQASRPGHFMPASLLASQFATLEPLEPDERGVVIDVDQSVEAIVDAIVGRP

SEQ ID NO: 10983 - protein, 480 aa, Hyphomonas neptunium ATCC 15444
MGRPILTPQEMLAAEQAVFNTGTDRFTLMQRAGEAVAEFVHAHWPDGQIQVLCGPGGNGGDGFIAAAALAKLWRKVEVYSVLPVSELTGDTAKAASAWEGPVHKLEDALKSQPELIVDALYGAGLTRPLEGAAAELAQRGGRVISVDVPSGIDGYTGKPLGPAFQAEATLTFAALRPAHVLLPGSAFSGVVMVADIGVPVKTALAENSPALWHSQMPQPGFGVHKYQRGHLKVVSGGPWNTGAARLTAKAGLRAGAGLVTMLSPPDAAGVHAAHLTAIMLAPFVTPDDLAAYAARSTAMVIGPAAGVTDATRANVEAILKGPARVVLDADALTAFGEDPEVLFKQLRPTDILTPHEGEFSRLFGDLLATSDNKVQATRAAAAKAGCVILLKGADTVIAQPDGNALVNTHATRWLATAGSGDVLAGIIAGFMAQGVDTFVAAAIGCWLHGEAGRRVGAGLIAEDIEMQLPVILSALHGELG

SEQ ID NO: 10984 - protein, 480 aa, Zea mays
MAVSHNVGSKHGVAPLEVSVEAGNGGAAEWLDDDGRPRRTGTFWTASAHIVTAVIGSGVLSLAWAIAQLGWVAGPAAMLLFAFVTYYTATLLAECYRTGDPETGKRNYTYMDAVRSNLGGAKVAFCGVIQYANLVGVAIGYTIAASISMKAVRRAGCFHAHGHADPCNSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVSVAAAAGSIADVIDALKVYRPFSG

SEQ ID NO: 10985 - protein, 556 aa, Streptococcus agalactiae NEM316
MKTDIEIAQSVALKPIAEIVEQVGIGFDDIELYGKYKAKLSFDKIEAVRSQKVGKLILVTAINPTPAGEGKSTMSIGLADALNKIGKKTMIALREPSLGPVMGIKGGAAGGGYAQVLPMEDINLHFTGDMHAITTANNALSALLDNHIHQGNELDIDQRRVIWKRVVDLNDRALRQVIVGLGSSVNGIPREDGFDITVASEIMAILCLATDLSDLKKRLSNIVVAYSRDRKPIYVKDLKIEGALTLILKDAIKPNLVQTIYGTPALVHGGPFANIAHGCNSVLATSTALRLADYVVTEAGFGADLGAEKFLDIKTPNLPTSPDAIVIVATLRALKMHGGVSKEDLSQENVKAVKRGFTNLERHVNNMRQYGVPVVVAINQFTADTESEIATLKTLCSNIDVAVELASVWEDGADGGLELAQTVANVIETQSSNYKRLYNDEDTIEEKIKKIVTKIYGGNKVHFGPKAQIQLKEFSDNGWDKMPICMAKTQYSFSDNPNLLGAPTDFDITVREFVPKTGAGFIVALTGDVLTMPGLPKKPAALNMDVLEDGTAIGLF

SEQ ID NO: 10986 - protein, 284 aa, Oryza sativa (japonica cultivar-group)
MLPYATAAEAEAAVGRGLTWAEAAWFRYSAAIPDYCLYCHNVPILLLVYTLAPLPLALLELRRHLPLPHKLQPGVRHPPAAFLRCYAATARVLLLAVGPVQLASFPAVRAVGIRTGLPLPSAGETAAQVAVYLLVEDYLGYWIHRLLHTPWAYHHIHRVHHEFTAPMGYAAPYAHWAEILILGFPAFAGPAIVPCHMTTFWLWFVLRHLEAIHIHSGFKLPFDPTKYIPLYGGVEYHDYHHFVGGHSQSNFSSVFTFCDYIYGTDRGYRYHKASLSKMRIFVRA

SEQ ID NO: 10987 - protein, 293 aa, Oryza sativa (japonica cultivar-group)
MEQYEEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMER

SEQ ID NO: 10988 - protein, 336 aa, Pseudomonas aeruginosa
MGRRYLSGAAGAIRRRGSTCHCRQRRMRAFLRGAGKSRCQIAALPGRSRPMSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTHEGLRRLPLETLRQRFRDSGIATRYYNADIHLGAFALPQYVLQAIGKQDND

SEQ ID NO: 10989 - protein, 526 aa, Chlamydophila pneumoniae TW-183
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 10990 - protein, 429 aa, Zea mays
  misc_feature (39)..(39): Xaa can be any naturally occurring amino acid
MSSSAPAPAAMAVDDAEDDQLASMSTEEITRASRLLDNXEIRVHKDELQRSNLELESIKEKTKENQEKIKLNKQLPYLVGNIVEILEMNPEDEAEEDGANIDLDSQRKGKCVVLKTSTRQTIFLPVIGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 10991 - protein, 295 aa, Oryza sativa (japonica cultivar-group)
MPMSDPTAAVIPKPGGIGVGGGGGDDEEPVEIREVWADNLEEEFALIRDVVDEFPFVAMDTEFPGIVCRPVGAFRSPADYNYATLKANVDMLHLIQLGLTFSSPRGELPALGPGRRRCVWQFNFREFDDARDIFASDSIELLRRSGIDFRRNSERGVDARRFAELLMSSGVVLNDSVYWVTFHAGYDFGYLLKILTCSSLPDTQAGFFKLMKIYFPTVYDIKHLMKFCNSLHGGLNKLAELLDVERVGESHQAGSDSLVTSCAFWKLKDSFFAGSTEKYAGVLYGLNAENVVSAH

SEQ ID NO: 10992 - protein, 500 aa, Thermus aquaticus
MEKVFYVTTPIYYVNAEPHLGHAYTTVVADFLARWHRLDGYRTFFLTGTDEHGETVYRAAQAAGEDPKAFVDRVSGRFKRAWDLLGIAYDDFIRTTEERHKKVVQLVLKKVYEAGDIYYGEYEGLYCVSCERFYTEKELVEGLCPIHGRPVERRKEGNYFFRMEKYRPWLQEYIQENPDLIRPEGYRNEVLAMLAEPIGDLSISRPKSRVPWGIPLPWDENHVTYVWFDALLNYVSALDYPEGEAYRTFWPHAWHLIGKDILKPHAVFWPTMLKAAGIPMYRHLNVGGFLLGPDGRKMSKTLGNVVDPFALLEKYGRDALRYYLLREIPYGQDTPVSEEALRTRYEADLADDLGNLVQRTRAMLFRFAEGRIPEPVAGEELAEGTGLAGRLRPLVRELKFHVALEEAMAYVKALNRYINEKKPWELFKKEPEEARAVLYRVVEGLRIASILLTPAMPDKMAELRRALGLKEEVRLEEAERWGLAEPRPIPEEAPVLFPKK

SEQ ID NO: 10993 - protein, 351 aa, Bdellovibrio bacteriovorus HD100
MASIAQAIRMALHYGEANMGVKDIFGQDVGAPLGGVFTATQGLETAWNSTLDERGIISMAMGIAMGGDRCVAEIQFADYIFNTIDLLKIAGNTLWCTNGQIQLPMVVMTPVGAGIFGSVYHSHSFDAWASRLQGWKIVMPSNPLDAYGLMLSAIEDPNPVLYLKSKALMRHKGDELIPGEPADEKELKAMIDKPVQNSEGWKPRWPELEKYMVPIGKGKITHAGEHITVVTYSRMVHLCDEVAVKLAEEGISVEVIDLRSIYPYDWPMIKASIEKTGRVLFVNEDTEVTNFGEHLAYRATQECFYQLMARPRVLAGKNLPGIGLHPNLEKNSVPQIHDIELAIREVVAEVP

SEQ ID NO: 10994 - protein, 202 aa, Oryza sativa (japonica cultivar-group)
MDLSPNPDSPPSGGGNGGGGGSSSSNSSPSMGAGAPQSPSRYEAQKRRDWNTFGQYLRNHRPPLSLAQCSGAHVLEFLRYLDQFGKTKVHTAACPFFGHPSPPAPCPCPLRQAWGSLDALVGRLRAAFEENGGRPESNPFAARAVRLYLREVREHQARARGVSYEKKKRKKPQQQQLQGGDSSGLHGHQHHPPPPPPAGAAC

SEQ ID NO: 10995 - protein, 515 aa, Clostridium thermocellum ATCC 27405
MKVVTPVQMREIDSYTINKVGIPGIVLMENAAVRVTDEILKDYGSLVNKNIVLLAGKGNNGGDAFAIARHLCNKGANTVVFILAAKKDISGDARINLDILENMGVETVEVLEGNDLTDMEKRLERADLVVDGIFGTGLKGGVKGFRGNVIKLVNQKNKPVIAVDIPSGVDGETGEIEGECIKAYKTVTFGYPKFGHFLHPGCEFVGELVVADISIPDSVAQNFDIKSYVTDKETVSRLIPGRKADSNKGDYGRVLVITGSTGMTGAGCLAGTASLRSGTGLLYLGVPKTLSFIYECNLTEAVTLPLEDENKGFLTKECIPMLLEYMEKMDAVAIGPGLSTKEDVEDVVFSVVENCKVPMVIDADGLNLISRNLPVLKKARAPVVLTPHPGEMARLTGLSIGEIQKRRVGTAREFSEKWGVTTVLKGAKTVVASPDGRVFINPTGNSGMSTGGTGDVLTGIIASFIGQGLDPVDAAVAGVYLHGLCGDRVANVKGEHGLVAGDLAEEIPYAIKSLI

SEQ ID NO: 10996 - protein, 468 aa, Azospirillum brasilense
MSDISKVFDLIKEHDVKYVDLRFTDPRGKLHHTAQHVSTIDEDVFEDGIMFDGSSIAGWKAINESDMILQLDPTTAVMDPFSAQPTLNILCDVYEPSTGQPYARCPRGIAKAAEKYMASAGIADTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGLDGIQNKIHPGEAMDKNLYDLPAEELAKVPTVCGSREALDSLKADSAFLQKGDVFTKDMIESYIDLRTEELLAFETMPHPIEYKMYYSV

SEQ ID NO: 10997 - protein, 334 aa, Arabidopsis thaliana
MPTMGNKNSMCGLKRFPNYKKSPIGSFAKNSSSHDGIKTIEAVNSCSFSRKADLCIRIITWNMNGNVSYEDLVELVGKERKFDLLVVGLQEAPKANVDQLLQTASSPTHELLGKAKLQSVQLYLFGPKNSHTLVKELKAERYSVGGCGGLIGRKKGAVAIRINYDDIKMVFISCHLSAHAKKVDQRNTELRHIANSLLPRDKRKRDLTVWLGDLNYRIQDVSNHPVRSLIQNHLQSVLVSKDQLLQEAERGEIFKGYSEGTLGFKPTYKYNVGSSDYDTSHKIRVPAWTDRILFKIQDTDNIQATLHSYDSIDQVYGSDHKPVKADLCLKWVNS

SEQ ID NO: 10998 - protein, 444 aa, Bacillus cereus
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEFEWDIFRTQVHQWERDQYMSLY

SEQ ID NO: 10999 - protein, 195 aa, Geobacter metallireducens GS-15
MSRKATIERVTKETQIKLSLEIDGAGEAKICTSVPFLDHMLDLFARHGLFNLQVDARGDIDIDFHHTVEDIGIVLGQALKEALGDKKGIRRYGQASVPMDETLASVAVDISGRPYLVYHVALPKVKIGEFDVELVREFFQAVVNNLGANIHVNVMYGDNVHHMVEACFKAFARAMDQATQVDPRIEGVMSTKGKL

SEQ ID NO: 11000 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKVESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 11001 - protein, 474 aa, Glycine max
MTRGIKHRQKAKSKKKGSKKEGGSSSSLAPEIPAKVWQPGVDKLEEGEELQCDPSAYNSLHAFHIGWPCLSFDILRDSLGLVRTEFPHTVYFMAGTQAEKPSWNSIGIFKVSNITGKRREPVPKLGTDDTEMDGEDSDSDDDSEEEDEGGAQGPSLQLRKVAHQGCVNRIRSMPQNPHICAAWADTGHVQVWDLNSHLNVLAETETEGVQGVAAVFNQDPLYKFKHKDEGYAIDWSPLVPGKLASGDCNNCIYLWEPTSAGTWNVDNAPFIGHTASVEDLQWSPTESHVFASCSVDGNIAIWDTRLGKSPAASFKAHNADVNVMSWNRLASCMLASGSDDGTISIRDLRLLKEGDSVVAHFEYHKHPITSIEWSPHEASSLAVSSSDNQLTIWDLSLEKDEEEEAEFKAKTKEQVNAPEDLPPQLLFIHQGQKDLKELHWHTQIPGMIVSTAEDGFNVLMPSNIQSTLPSNGAL

SEQ ID NO: 11002 - protein, 308 aa, Oryza sativa (japonica cultivar-group)
MYAAMYPETFGFSAYPQQQQPPPDAASCIYTTALPLIADPPDILGNMAQPSFLSEYDLGGEGDLFKAPEPIIEEPVLSLDPVAAAISMMSGSENVMDETIEVADISDIQNDSLLSEVLYECEKELMEKSAIEETISELLDVKIPMLQVEEFPRETQVQLPAMEKEKPSVPECCSLQKSVSSGCLNSADWINGPARPNFLDFQGLDFETAFGLRRAYSEGDIQNLGASTPRPGNSGNAQLASCERLVTISDLKSEERKQKLSRYRKKKVKRNFGRKIKYACRKALADSQPRVRGRFAKIEEGDLLKPRK

SEQ ID NO: 11003 - protein, 66 aa, Zea mays
YFSFAFSWTSSILLSSKSGLFCRLLLVTKYRRLPVVDSSGKLVGIITRGNVVQAALEIKKKVEGTL

SEQ ID NO: 11004 - protein, 171 aa, Nocardia farcinica IFM 10152
MTQNESAPRVVVMGVTGSGKTTVGTRLAAALGVPFAEGDDFHPAANIERMRAGIPLTDAERRPWLDRIAAWLAGATGGGVVSCSALARAYRDTLRAAAPDVLFVHLDVPRPVLDRRVRERRGHFMAPQLLDSQLALLEPLGPDEPGVVLDGTRPPEELVARARELMRTTPR

SEQ ID NO: 11005 - protein, 157 aa, Oryza sativa
WDDGTMMGASPPEEQHSTVEEVVVVRRNQKRTKNFSGKEDEGLVSAWLNVSKDVVQGIEQSRCAYWKRIYDYFHANKDFTSDRSQNSLMHRWSTIQENVTKFEGCLSRIGDRKQSWVSSQDKIMHACALYKAEDENHRPFHMMHCWNLLRNQQKWID

SEQ ID NO: 11006 - protein, 482 aa, Rhodococcus sp. RHA1
MLEEAAIASVQTGLFIGGKWRDSARTMPVHDPSNGQILCTVADADAAEAREALDAAVAAQPSWAATTPRERSTILMNAHRLLLENVDRLALVMTLEMGKPLTEARGEIAYAAEFFRWFAEEAVRIDGGYMTAPGGGSRFLVTRQPVGPSLLITPWNFPMAMGTRKIGPAIAAGCTSVIKPAAQTPLSILALADILTEAGLPDGVVNVVTTSSPDEVITPLILDGRARKLSFTGSTKVGKHLLELCARTVMRTSMELGGNAPFLVFDDANLDDAVDGAMAAKMRNIGQACTAANRILVHSSVAEEFTRKLTQRMEALPVGRGTEDGVVVGPLIDEAAVAKVSSLVADAVERGASVLTGGEALDRPGNFYPATVLTGVPDDAEMCHNEIFGPVAAISTFETEAEAVERANDTPYGLVAYVYTDSLKRGIRVCEALESGMVGLNQGVVSNPAAPFGGVKESGLGREGGTTGIDEFLETKYIGVAV

SEQ ID NO: 11007 - protein, 344 aa, Ostreococcus tauri
MSYKDMGRAGPLEIRTRGPPFGGLPQAQAGMKRSDSIGTIEKYWDDDAEWYEFHPNALAREGDGKFKELAVGKLLTVFLDYDGTLTPIVDEPDKAFMDDEVREAVRQCARRFPTAIISGRSRHKVSQFVQLEELYYAGSHGLDIAGPTRTSDGTPITATALAHQPAQWARDVMDRVTNDLIEKTRDIPGANIEHNMFCVSAHYRGVSDADRPRFQKIVDEIVASDECLIKHDGKMVWEVRPRVAWDKGKALSYLRDALIPDLAKKGFGSEEVFTVYVGDDVTDEDAFMEINEKLGDHLGVGVLVSHAPKVSAAKFSLRNTPEVLQFLTTLSKLADAGEVKTLPR

SEQ ID NO: 11008 - protein, 413 aa, Rhodococcus sp. RHA1
MTRLSPLLAQATPVTVDHGEGCYLYGTDGRRYLDFTAGIGVTSTGHCHPHVVEAARRQIGSLIHGQYTTVMHQPMLELVDRLGSVLPAGLDSLFFANSGSEAVEASLRLSRQATGRPNVIVFHGGFHGRTVATATMTTSGTRFSAGFSPLMGGVHVAPFPNAYRYGWSEEEATAFALKELDYIFATLTAPNETAAFVVEPVLGEGGYVPGNTAFFQGLRERADRYGILLVIDEIQTGFGRTGKFFGHQHFDVRPDIITIAKGLASGFPLSGIAASEALMAKGWPGSQGGTYGGNAVSCAAAVATLEVIEKEDLVANAAARGVQLLDGARTRAIDGIGDVRGLGLLVGSEFTAADGSADRTKASAAQQLAAKKGLLLLTCGAHMNVVRMIPPLIVTAEQIEDALKIWSEVLDEV

SEQ ID NO: 11009 - protein, 109 aa, Geobacter metallireducens GS-15
MNERDDILQAVYRVIKERKGASADSSYTASLLQKGIDKILKKLGEEATEVVIAGKGGKREEIVYETADLFFHTLVLLGYYDIDPEEIYAELRRRFGTSGIAEKASRPKE

SEQ ID NO: 11010 - protein, 226 aa, Streptococcus thermophilus CNRZ1066
MDELKKLAGVYAAGFVEDGMVVGLGTGSTAYFFVEEIGRRIKEEGLSVVGVTTSSQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 11011 - protein, 443 aa, Clostridium saccharobutylicum
MAKYTKEDIINLVKENGVKFIRLQFTDIFGTLKNVAITDKQLEKALDNECMFDGSSIDGFVRIEESDMNLRPNLDSFVIFPWRPQQGKVARLICDVYKPDGTPFEGDPRHVLKRANADAKELGYTMNVGPECEFFLFETDENGRATTNTQDKAGYFDLAPTDLGENARRDMTLALEEMGFEIEASHHEVAEGQNEIDFKYGDALTTADNIMTFKLVVKSIAQRHGLHASFMPKPIFGINGSGMHVNMSLFKDGKNAFVDENDKNGLSKVAYQFIAGLLKNIKGMAAVTNPLVNSYKRLVPGYEAPVYLAWSCKNRTALIRVPAARGAGTRVELRCPDPSSNPYLVLACLLQAGLDGIKNNLQPPAEVEANIFAMTEQERKENGIDNLPNNLYEAVNYMKENELAKKALGDHVYGNYVAGKAAEWDDYRTKVHDWELENYLNKY

SEQ ID NO: 11012 - protein, 114 aa, Xylella fastidiosa 9a5c
MSEETIFAKIIRREVPATFVYEDEEVLGFKDIMPRAPVHVLFIPKREMIPTLDDLRPEQGPLIGKLVLAAAEYARREGFAQDGYRIVMNCREHGGQTVFHLHLHLLAGAPLGTW

SEQ ID NO: 11013 - protein, 281 aa, Clostridium thermocellum ATCC 27405
MDEKRLNELRKYSTIIRRHIIEAVYNAKSGHPGGSLSSADIITVLYFNEMRVDPKNPAWEDRDRFVLSKGHCSPALYGALAERGFFPVEELLKFRHIDSFLEGHPSMRYVPGVDMSTGSLGQGISAAVGMAIAGKLDKKDYYVYVILGDGEMQEGQVWEALMSASHYKLNNLIAFLDHNHLQIDGNITEVMSPEPIVDKVRAFGWNVITIDGHDHRQISEAVREAKKSGDKPTMIIAETVKGKGVSFMENVAEWHGSPPNKEERDRAIAELDKILAGLEGR

SEQ ID NO: 11014 - protein, 308 aa, Shewanella violacea
GTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 11015 - protein, 448 aa, Bacillus licheniformis ATCC 14580
MNQSFVEKSKQYLWLPFTQMKDYDENPLIIESGQGIKLKDIDGRVYYDGFSSVWLNVHGHRKKELDEAIKKQLGKIAHSTLLGMTNVPATELAEVLIKITPENLTRVFYSDSGATAMEIALKMAFQYWKNIGKPEKQKFISMKNGYHGDTIGAVSVGAIELFHHVYGPLMFESFKVNVPYVYRSKSGNPDECRDECLAELERLLSERHDEIAALSVESMVQGASGMIVMPEGYLAGVRELCTKYDVLMIVDEVATGFGRTGKMFACEHERVQPDLMAAGKAITGGYLPIAVTFATEEIYEAFYDDYNKLKTFFHGHSYTGNQLGCAVALENLRLFESEKIVAQVAEKSKILESLFHDLAALPHVGDIRQLGFMSGIELVQSKETRQPYPPEERIGYRVSLKMRELGMLTRPLGDVVAFLPPLASTADDLRAMVSIMKEAIQEVTGRAY

SEQ ID NO: 11016 - protein, 542 aa, Arabidopsis thaliana
MERLVVLPFSIGCISVSSVAVLSPLSKPHHHHSRQVIREQEEEDNMKNVFKFLAVSKPEISIGINRIFKSFKTISQLFADKDEEKEEVETSGMEIGVPTNVKHVSHIGWESGLTAATGPGDLGPRVSGLPRNASVADALRDGVWWINGSRSRNPIIQLLKNCLPLSSVVNLQVDAEDDLFMWKVGGSEASVGFSSAATWIHLNPVGEKVDWHKAIWFKGRIPKHAFISWVNIRHRLPTRDKLLSWGLHEKSEITSLLGPMFLLLHCLRMGIAHQATVYTLWRERNTRLHTSSSRPAAGLIMEIKNLIRTHLDPLSRAQRIGPNAFCLPIERRREIETSMGLIVDDDNDGEVLIPPPNFSMVEDGIYRSGFPELENFGFLSTLNLRSIIYLCPEPYPEDNLKSLASNNIKLFQFGIEGKTDPPTPMPKDTVLSALRVLVDVRNHPILIHCKRGKHRTGCLVGCLRKVQNWCLSSVLEEYQKCAGLKWRQRDLRFIEDFDVLRLKQCLYSIIYQYNGYGLKRRKLLYQEENVVQEQQKPQATKG

SEQ ID NO: 11017 - protein, 576 aa, Oryza sativa (japonica cultivar-group)
MAAATPASGGGGGGYSCETAEQTREWMEAISAFLHLHRPLLEAHVVNFFKDRLWEMVDAEWMECLRREPVESLLMLPSGCVQEHWPSSLRDFVLTAKSLVLPREQKSPRSLLPDLHVASINTVLAQGMNSKKKHEIETLAGLVHAITKSCGAKTVIDVGSGQGYLAQALSFEYQLPVVAIDASSHHASVTNTRAERIKKYYTAKCVGKQQLRVPRTVTCHVLSSDTLAAVTLEACQDDHAEHVPESKNFNESSPQIEKPNDSIPPLVLAGLHACGDLSVNMLRLFVSCEQVKALISIGCCYNLLSEECHEDTNTCPGFPMSKAAKLSNLVLRKSTRDLGCQSAERWRSLTKDIALQNFDIHAFRAAFQMFLEKHFPEVSRSSPSIGRQGKALRRQRLRKVMESPMAMAETDALSYSTQKEQIMTKDDPLPTGPNNFKEVHVDFLPELSTGFVDSAVSGAAVVPDDIYLDKSQKFTLFKDFTVSGLGRLGCDFVENVSLLEIWKDVQPFTEFIGPFWCLRVALGPLVETYILLDRLLFLQEQGSVIEASLFPLFNPTMSPRNMAIIAWKLSANPSKV

SEQ ID NO: 11018 - protein, 424 aa, Streptococcus agalactiae NEM316
MKFNEQSNSQAALLGLQHLLAMYAGSILVPIMIASALGYNAEQLTYLIATDIFMCGIATLLQLQLSKHFGVGLPVVLGCAFQSVAPLSIIGAQQGSGYMFGALIASGIYVVLVAGIFSKVANFFPPIVTGSVITTIGLTLIPVAMGNMGDNAKEPSLQSLTLSLVTIGVVLLINIFAKGFLKSISILIGLISGTILAAFMGLVDASVVAEAPLVHIPKPFYFGAPRFEFTSILMMCIIATVSMVESTGVYLALSDITNDKLDSKRLRNGYRSEGLAVLLGGLFNTFPYTGFSQNVGLVQISGIRTRKPIYFTALFLVILGLLPKFGAMAQMIPSPVLGGAMLVLFGMVALQGMKMLNQVDFEHNEHNFIIAAVSIAAGVGFNGTNLFISLPNTLQMFLTNGIVISTLTAVVLNIILNGLPKKLI

SEQ ID NO: 11019 - protein, 539 aa, Oryza sativa (japonica cultivar-group)
MGSLPEQFVFRSRLPDIAIPDHLPLHDYVFERLADRRDRACLIDGATGETLSFGDVDALSRRVAAGLSSIGVCHGSTVMLLLPNSVEFAVAFLASSRLGAVTTTANPLHTPPEIAKQVAASGATVVVTEPAFVAKVSGLAGVTVVATGGGAERCASFAGLAAADGSALPEVAIDVANDAVALPYSSGTTGLPKGVMLSHRGLVTSVAQLVDGENPNLHLREDDVVLCVLPMFHVYSLHSILLCGMRAGAAIVVMKRFDTVKMLQLVERHGVTIAPLVPPIVVEMAKSDALDRHDLSSIRMVISGAAPMGKELQDIVHAKLPNAVLGQGYGMTEAGPVLSMCMAFAKEPTPVKSGACGTVVRNAELKIVDPDTGLSLPRNQPGEICIRGKQIMKGYLNNPEATEKTIDKDGWLHTGDIGFVDDDDEIFIVDRLKELIKYKGFQVAPAELEAMLIAHAAVADAAVVPMKDDSCGEIPVAFVVARDGSGITDDEIKQYVAKQVVFYKRLHKIFFVDAIPKAPSGKILRKDLRAKLAAGIPAC

SEQ ID NO: 11020 - protein, 436 aa, Saccharomyces cerevisiae [sequence omitted]

SEQ ID NO: 11021 - protein, 175 aa, Rhodococcus sp. RHA1
MNTPARTEARHRVVIIGSGFGGLFAAKALRRADVDVLVVDRTSHHLFQPLLYQVATGILSEGEIAPSTRMVLKKQSNASVMLGDVTDIDLTARRITSTHQGRTTTTTEYDSLIVSAGARQSYFGNDHFAEHAPGMKTIDDALELRGRILGAFERAELSTDPEERARLLTFVVVGA

SEQ ID NO: 11022 - protein, 191 aa, Ostreococcus tauri
MGLTASSLNLTQYDIEDVQQHCDGKFTSREIQALYARFRSLDKRHKGFLTEDELMAIPELAISPLAPRIVQMFQNQNFKDFVKMLSALSPRASRDDRLRFMFQCHDVDRDGEIARSDLETMTRHLVGSSVSEEDFNALIHRAFEDLRAMRAERADAREGSARGVAFDEFRRALSAVDRTLPTVRVPVDDDA

SEQ ID NO: 11023 - protein, 446 aa, Methanococcus voltae
MTSLEMALEYIKINNVKFLRFQFVDIHGEPKNIAYPVKLGTADGEEELMGVLENGLFFDGSSIEGFVEIEDSDMVLKPDLSTLSVLPWRPSEKSVARIICDVYRKNGKPFEGDPRGCLKRVLAEFKEEFKGEYFVGPEPEFFILKNENGKWVPGDDAGYFELEPLDEGNDLRRNIVFALENLGFHVEASHHEVAPGQHEVDFKYDNAVKTADSVITFKTTIKTLAKQSGVLATFMPKPFFGMNGSGMHCNQSIWLDGKPSFYDENNAHQLSDICLSYIGGILEHTKALVSVTNPTVNSYKRLVPGYEAPVNIAWANSNRTSIIRVPAARGKGTRVEFRAPDPACNPYLAFTVMLAAGLDGVRRKLIAPEPVEKNIFAMSEAEKREANIDSVPSNLYDAIEELRQDKVLKKALGDHIFNKFIEIKTKEYDAYRTAVTDWEFNKYVRI

SEQ ID NO: 11024 - protein, 472 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 11025 - protein, 61 aa, Zea mays
  misc_feature (25)..(25): Xaa can be any naturally occurring amino acid
  misc_feature (34)..(34): Xaa can be any naturally occurring amino acid
MTTRGNCIDSTLSARDHYLEHPNRXKAHQFKPTXQVTLDPYKHDHACLVGGYRMPKKQKAI

SEQ ID NO: 11026 - protein, 469 aa, Proteus vulgaris
MSLEHVLSMIEEHKVRYIDLRFTDTRGKEQHLTIPAHQVNDDFFEEGKMFDGSSIGGWKGINESDMVLMPDASTAMLDPFFQDPTLIIRCDVLEPGTMQGYDRDPRSISKRAEDYLKSSGIADTVLFGPEPEFFLFDDIRFKNDISGASYAINDIEAAWNTNTKYEDGNKGHRPMVKGGYFPLPPVDSSQDIRSTMCNIMEEMGLVVEAHHHEVATAGQNEVATRFNTMTKKADETQIYKYVVQNVAHVFGKTATFMPKPLVGDNGSGMHCHMSLSKNGTNLFAGDKYGGLSEMALYYIGGIIKHARALNAFTNPTTNSYKRLVPGFEAPVMLAYSARNRSASIRIPVVASMKARRIEVRFPDPLANPYLAFAAQLMAGLDGITNKIHPGDAMDKNLYDLPPEEAKEIPTVAGSLEEALNALDADREFLTHGGVFTNDSIDAYLALLRTDVQRVRMAPHPLEFEMYYSA

SEQ ID NO: 11027 - protein, 340 aa, Bacillus licheniformis ATCC 14580
MPQKQIELARRPQGIPVMDDFRIKETEIPEAKNGEALVKTLYVSVDPYMRGRMQDTKSYVEPFPLDEVITGGVIGEVISAKGDKLKKGDIVLGRLGWQEYSAVREDNLQKIDPSLAPVTAFLGILGMTGLTAYFGLLDIGQPKAGETVVVSGAAGAVGSAVGQIAKIKGARVVGIAGSDEKTAYLKEKLGFDEAINYKTTENMASALEQACPDGVDVYFDNVGGAISDAVFTLINKFARIPVCGAISSYNVKSAEEDMGPRVQTALIKSSALMKGFVVNDYRDRFPEGIKQLAEWVKSGQLQYEETITEGFERIPEAFLGLFEGKNLGKQLIKVADSDNA

SEQ ID NO: 11028 - protein, 547 aa, Magnaporthe grisea 70-15
MDIQTCAVLSALETVAWVGFHEYRSLALTTRKELVAVFSVFFLVQYLCAKIYRIFIYPVHVSPLRHLPTPKGNHFMLGQLVNQFRASCPNELYLKWTSQWPDSPFVRFFTIGNKESLLINGIEANREVFATHCYAFTKPSLFLRFVGDIAGTGLLFTEGDEHKRHRKMILNVFSVPNLKKMFPIFQEKAEELSQHLDATIAASTGGSIDVQCIYSKATIDIIGITALGLDLRNLKSTKLRMDFLQCYRRMHEQPFSAALISFINVHVPIRRLLWFVRANRDFVEASQEVRAMLRTCIRERIRDVDSRKGAEVKFQSRDLLTYMVEERLLAQCKDPLTTEDILGHLLNFLSAGHETTTGVMTWASYVLATNPRIQDRLRAEVEALLKESPCPSYSDIERMKYMHNFVREVLRLYSPAVATYREAAKDVTICGTLIPKGTHLVLCPSVCNKSKRIWGADAEEFVPERWEKLDGEAASPYSIMTFLAGPRQCIGKQYALQEVKVLLIEVISKFRLLPTEELVSNDFKVNISNPGVVLRPKGGMVLRVERL

SEQ ID NO: 11029 - protein, 533 aa, Yarrowia lipolytica CLIB122
MSTSAMTDDYPMAEVSITEETKMPEPAKKSQLLVILLCLFAAMGGFVFGYDTGTISGFINMDPFLESFGEADESGVFFLSRIRAGLIVGLFSIGAFLGTLLGGFLADKVGRKKGIVYVAMVYIVGMLIQITAFTAWYQIAIGRVIGGVGIGALSVLVPMFQSETAPQNLRGALVSSFQLFITLGIFIGFSVCYATKSRLDTGAYRIPMGLCFAWAFILLIGMCFMPESPRFLVSIGRIEEARKAMAMTNQVPLHDAVIDEELKAIENSVIREKSAGKATWKELFTGEPRMGYRLTLGILVQVLQQLCGANYFFYYGTSIFKAIGMSDSFATSMIFGGINLLSTFGGLYIVDRFGRRKCLLGGAMVMFVCFLVYSTVGFAALYPNGDTTLPARKAVGDVMILFTCIFIAAFASTWAPIAFVVVSETFPLRMRSKGMAVATGGNWMINFLVSFLTPFITSSIGFKYGYVFTACIGFAIIFVFFFIPETKGLSLEDVDELYASGVSARNSPNWVPSSKKQEVNEPKNSMTDFSESS

SEQ ID NO: 11030 - protein, 464 aa, Enterococcus faecalis V583
MKYQFPENFWWGSAASGPQTEGVFEGDGKGQNIWDFWYQEAPEKFFQQVGPDKTSQFYKKYQEDIQLMKETGHNSFRTSIQWSRLIPDPTTGKVNQTAVDFYNQVIDDLLEHGIEPFMNLYHFDMPMVLQEKGGWESREVVDLYVDFAKTCFELFGDRVKKWFTHNEPIVPVEGGYLYGWHYPDKVNLKEGIQVLYHEALASAKAIAVYHSMNLSGEIGIILNLTPTYPRDEHNEADVNAAKFVDGFFNRSFLDPAVKGHFPEDMVAWAKANDLLPETTPEDLAIIAENTVDLLGVNYYQPRRAKAKETPVETRPEGLLPEDFYDVYDMPGKKMNPYRGWEIYEKGIYDTLMNLKENYGNIRCYISENGMGVEGEERFVNEQGVIEDDYRIEFVQDHLKWVHQAIQEGSNVQGYHMWTCMDNWSWLNAYKNRYGFIAVDLDDDAKRTIKKSGRWFKEMTANNGF

SEQ ID NO: 11031 - protein, 411 aa, Rickettsia sp. A-167
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNPLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKALGQLDNNPLLQIAIELEAIALKDEYFIERKLYPNVDFYSGIIYKAMGIPSQMFTVLFAIARTVGWMAQWKEMHEDPEQKISRPR

SEQ ID NO: 11032 - protein, 881 aa, Enterococcus faecalis V583
MKKFIYSFNETHNEGKETLGGKGANLAEMTRLGLPIPQGFTITTRCCMDYLADATFFEEHLQSEILKAVKNLETETGKSFTADNEILLVSVRSGAAFSMPGMMDTILNLGLNDQRVKKFATLTSPGFAFDCYRRLIQMFGDVVYHIPKELFDQQKERLEQELNKKITAFQEEDHFALIVRYQEVFEQHQVVFPQDPVAQLFEAIKAVFDSWNNQRAVVYRNLHHIAHDLGTAVNIQEMVFGNRGLDSGTGVVFTRNPVTGENQLFGEFLLNAQGEDVVAGIRTPEPIRRLRLTMPKVYQDFRHYAELLEYHYRDMQDIEFTIENEKLYILQTRNGKRTAAATVKIALDLAKENRITKQEALLRVTPDTIDQLIHPVFDQEKRQHMERLAMGLPASPGAASGQIVFTAEKAKELTNLGKKVILVRQETSPEDIEGMVVSEAIVTSRGGMTSHAAVVARGMGTCCVTGCESLTVNEETKQLHCGPQVILEGTIISVDGSTGEIYLGEIPTISADNNDDLQELLSWADAYADLTVRANAETTQDLETAIRFGAAGIGLARTEHMFFGEERVLEMRRLILAESEKEATYALEQLLHFQQEDFYQMLKVVQDKPMVVRLLDPPMHEFLPHEKNDIQLLAKQLQRFPVTIAKQIERLQETNPMLGHRGCRLGVTQPQIYKMQVTALFTSAIRLVKEGITVYPEVMIPLIAEKEELLYLKRILKETIDGLFEEHKMTPFPYEIGTMIELPRACLIADQLAEEADFFSFGTNDLTQMTYGFSRDDIGKFINTYREKKIITQDPFQSLDQTGVGQLIQLAVEKARRTKPNMSIGVCGEVGGDPQSITFFQTLGLNYISCSPYRVPIAKLAAAQAKILTEPAVTEEQMVLL

SEQ ID NO: 11033 - protein, 320 aa, Bartonella doshiae
TYIDGDKGILLYRGYPIEQLAEKGDFLESCYLLLYGELPTQQEKNDFDRRIMQHTMVHEQFSRFFQGFRRDSHPMAVMVACLGAMSAFYHDSIDITDPQQRMIASIRLISKVPTLAAMAYKYSIGQAFVYPHNSLSYAANFLRMCFAVPCEEYQVNPVLTRAMDRIFILHADHEQNASTSTVRLAGSSGANPFACIAAGVACLWGPAHGGANEACLKMLKEIGSVKKIPEFIARAKDKNDPFRLMGFGHRVYKNYDPRAKIMQKTCHEVLKELNRQDDPLLDIAIELEHIALNDEYFIEKKLYPNVDFYSGITLKALGFP

SEQ ID NO: 11034 - protein, 322 aa, Bartonella taylorii
TYIDGNKGILLYRGYPIDQLAERGDFLESCYLLLYGELPTKQEKHDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEGYNINSVLTRAMDRIFTLHADHEQNASTSTVRLAGSSGANPFACIAAGVACLWGPAHGGANEACLKMLQEIGSVERIPEFIARAKDKNDPFHLMGFGHRVYKNYDPRAKIMQKTCHEVLKELNIQDDPLLDIAMELEKIALNDEYFVEKKLYPNVDFYSGITLKALGFPTE

SEQ ID NO: 11035 - protein, 130 aa, Triticum aestivum
MVRFSSLNDALRTISNAERRGFRQVLIRTSFKVIIRVLVLLQQHGYIGEFEVVDDHRANKIVENLLGRINKTGVISPRFDVKVLDIEKRINNLLPSRQFVFILLTTGEGIMDHVEARKRGVGGKILGYVY

SEQ ID NO: 11036 - protein, 628 aa, Legionella pneumophila str. Paris
MKQFPGFYFDKNRAIDLICMGRVAVDLYAEQIGLDLKDVASFKKYLGGCAGNIAVGAARLGLKSQMFSCVGSDELGKFLKEELEREGVNIELLSETDNHLTGLVLLGIKPPSNFPLLFYRNDCADMQIKSDQISFTDLKNAKALLITGTGLSTESVKNTTLEVVHLARKAETTIVFDLDYRPVLWRLTVIGNGESRYCQNEYVTQVYQQVLPLCDLIVGTEEEICIAGGSNDIEVSLINIRQRTDAPIVVKLGEKGARVHFGTDKGLLQAKSFPVEVLNVLGAGDGFMSGLLSGLLQGKSWEQAVTYANACGALVVTRHGCAPAIPYKEELDYFIQEYEHDPEIWSSSQLTQLHEKLSKNQKTQLLIKNPCGFADGLNSIVTMQDSPTAMSFSSLKLNKGQSHQFNSSYEFAALLMTGKVVFQYGSYSQEVERTDYFSQSPYVLHCSKNEVSSVIALTDCEILLMETENENLFSPILFDASNMLELDNRGEGVLENTSYRLVRTVFDKRNRPESNLVVGEIITFQGRWSSYPSHYHQQPEIYHYRFSEPQGYAFGENGKEVMRIEHYDTYQIANNQEHAHCAAPGYALYTLWFIRHLNNNAYTLPTFIKDHEWTRTSRANLRAWQQKQ

SEQ ID NO: 11037 - protein, 471 aa, Legionella pneumophila str. Paris
MNKGMNAFVFLIAVIAGFGGFLFGFDSSVIADVKDQVISQLALTDWQWAQVVSSSLLGCILGIPISGLVADKLSRRSLLKVVALGFILGSSLCALAPGFVSILLGRFIIGICIGIASYIAPLFIAEIAPPHQRGTLVLINGLTITFGQAIAYLIGYFLHDYSLMSWRYLFWIGSLPALVLFSGMYFVPHSPRWIMMKYGADATLKTLKQIRPVGYNIQQELTEISNNLVNPAPAYIQMFKKPIVFVLLLGVGLGIFQQFSGINALMYYGPVVFESFGFSPVKNAILATFFLGLVNFIFTVVTLFYVDKLGRRFLLISGTLIASISLYLVSLLSSNSLLVNKFWILGGLSFYVMGYCISLGSLFWVLISEIYPLSVRGLAMSIATVFQWGANFVVSLLFLPIYQFSGQTVTFAMFATFCLLACWFIYYFVPETTSVSLEKLEDNLSSGKKIRDIGQPVSKNIKIAKFNLIMD

SEQ ID NO: 11038 - protein, 473 aa, Synechococcus sp. PCC 7002
MTQTATDVLRLIQEENIQIIDLKFVDLPGIWQHCSFYQDQLDEASFVDGVPFDGSSIRGWKAINESDMAMVPDPTTAWIDPFCKEKTLSLICSIKEPRTGEWYSRDPRSIAQKAVDYLAPSGIGDTAYFGPEAEFFVFDDVRFDQTENKGFYYVDSVEGRWNSGRKEPGGNLAHKPGYKQGYFPVPPTDTLQDMRTEMLLTMAKCGVPIEKHHHEVATGGQNELGFRFATLLKAADYLMTYKYVIKNVARKYGRTVTFMPKPLFNDNGSGMHTHQSLWKEGQPLFWGDRYANLSQLALHYIGGILKHAPALLAFSNPSTNSYKRLVPGFEAPVNLAYSQGNRSASVRIPLSGPNPKAKRLEFRCPDATANPYLAFAAMLCAGIDGIKNAIDPGDPLDVDIYDLTPEELSKIPSTPASLEAALEALQQDHDFLTAGGVFTTDFIENWIEYKLDAEVNPLRLRPHPYEFALYYDC

SEQ ID NO: 11039 - protein, 468 aa, Acidithiobacillus ferrooxidans
MGYSPSDVVKLIQEKDIKFIDFRFTDTKGKEQHVSVPGHVIEEDTFTEGKAFDGSSIAGWKGINESDMILLPDPDSAVLDPFMDETTLLLRCDVIEPATGQGYERDPRSVAKRAEIYLKSTGIADTSFFGPEFFVFDSVTWNIDMSGCAYKVDAEEAAWNSGKEYESGNMGHRLGVKGGYFPVPPVDSAQDLRSAMCLAMEEMGLKVEVHHHEVATAGQHEIGVGFNTLTPRRMRCKILKYVVHNVAAVRQTATFMPKPVVGDNGSGMHVHQSLGKDGKNIFAGDLYGGLSEIALYYIGGIIKHAKAVNALTNPSTNSYKRLVPHFEAPVLLAYSAKNRSASIRIPYVNSPKARRIEVRFPDSTANPYLAFSAMLMAGLDGIQNKIHPATAMDKNLYDLPAEEQANIPGVAASLEEALRALEADHDFLMKGGVFSESWLEGYLDVKWAEVQTLRVTTHPVEFQMYYSL

SEQ ID NO: 11040 - protein, 468 aa, Vibrio alginolyticus
MSVEKVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEESAEIPTVAYSLKDALAELDADREFLTAGGVFSDDFIDSYIELKSQDVERVNMTTHPVEFELYYSV

SEQ ID NO: 11041 - protein, 155 aa, Oryza sativa
MVRKAKVEFDESPPDDFDPKNPYGDPVAMLEYREHLVREKWIQIETAKIIRDRLRWCYRIEGVNHHQKCRHLVDQYLEATRGVGWGKDARPPELHDPKIKCCKVNTDDSPNIATNYGIRSIPTVLMFKNGEKKESVIGAVPKTTLATIIDKYVSS

SEQ ID NO: 11042 - protein, 622 aa, Erythrobacter sp. NAP1
MSAIGGIFSDEDVQDDQLAVLKRSLSRIPHDASGAWRSGRIALAAASRHTTDESTIQVQPFVCDSGKLAAVFDGYLLNPDELAADLEAGGAKLVGCSEVELALRAYEAWGNECANRMQGEFAMIVADLATGQLFAARDHMGTVPLYYRREGGRIIVASDFPTLAALGETLGLGAMTPDRLYLAQIMANRWYLREATPWQEIKRIVRAHTLRFDGKRVIGQKYWTPPTEVTIRYKRDEDYAEHYREMLFDCVRRSLRSHRKVGVAVSGGLDSSAIFAIAHRLEGSGQSPAPSIAAYSLAAEEGGNAFELPYARAVAAHVGRDLAEVPLFDPDIDWYTEDGARHMDLPTPSNGAMMWGLEERVVADGARVLINGGGGDEWLQGNELYYSEYAARGEWGKYWQALRRDADAFGWQRAFKRSMRFTSAELAPRWLRERIRTRLRAARRKSDAAMNWLSQDLREALSEAEERYEAELPDNAVGWTKRNTATSPFSDLSHQLMRRQRSLIGVESRHPMLSRAFMEFSLRTPIDIKMRGAMTKVIHRKAMAGILPDEVVSRTNKANFTNTGIDQQFADYVRANASTQLAEICNLHGLQAILDVDFSAPEGDYWAWEIWGLYASAAFLYQ

SEQ ID NO: 11043 - protein, 665 aa, Nicotiana tabacum
MSSPTPGASPAPTSPPAPPTNSTSPPPTAVASPPALPAQAPPPTSPTPPATTPPPTASASPPPPSTSAPSSSTPPPPTTQSTPEPSGSPPSPPSPPSGSSPSPPAPSGSGRSPAGPRGGGGSSTSSPASDEGSSGVSTGLVVGIAIGGVLILAVLSLLFICCSRRKKRRNHGPVEYYPPAQPPPMGYKADPYGDPVHHWQHNAPSPADHVVSIPPKPSPPPAGASRPPHSPVTASSLQPPPPPPYMSSSGASSNYSGFDPLPPPSPGMVLGFSKSTFTYEELVRATDGFSNANLLGQGGFGYVHRGVLPNGKEVAVKQLKAGSGQGEREFQAEVEIISRVHHKHLVSLVGYCITGSQRLLVYEFVPNNTLEFHLHGKGRPPLDWPIRLKIALGSAKGLAYLHEDCQPKIIHRDIKAANILVDFNFEAKVADFGLAKLTSDVNTHVSTRVMGTFGYLAPEYASSGKLTEKSDVFSYGIMLLELITGRRPVDSSQTYMDDSLVDWARPQLTRALEDEKFDSLIDPRLGNDYNHNEVARMVACAAACVRHSARRRPRMSQVVRALEGDVSLSDLNEGIRPGHSTVYSSHGSSDYDASQYNEDMKKFRKMALGSQEYGSTGQYSNPTSEYGLYPSGSSSEGQPTREMEMGRTKKDSRGFSGSKGFIGSS

SEQ ID NO: 11044 - protein, 411 aa, Rickettsia africae
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNPLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFVIARTVGWMAQWKEMHEDPEQKISRPR

SEQ ID NO: 11045 - protein, 411 aa, Rickettsia akari
DSEFAELKIRGKIFQLPILKASIGEDVIDISRVSAEVNCFTYDPGFMSTASCKSTITYIDGDKGILRHRGYNIKDLAEKSDFLEVAYLLIYGELPSIEQYNNFTKQVAHHSLVNERLHYLFQTFCSSSHPMAIMLAAIGSLSAFYPDLLNFKEADYELTAIRMIAKIPTIAAMSYKYSIGQPFVYPDNSLDFTENFLHMMFATPCTKYKVNPIIKNALNKIFILHADHEQNASTSTVRIAGSSGANAFACISTGIASLWGPAHGGANEAVINMLKEIGSSENIPKYIAKAKDKSDPFRLMGFGHRVYKNYDPRASVLKETCKEVLKELGQLENNPLLQIAIELEAIALKDEYFIERKLYPNVDFYSGIIYKAMGIPSQMFTVLFAIARTVGWMAQWKEMHEDPGQKISRPR

SEQ ID NO: 11046 - protein, 923 aa, Lotus japonicus
MMELPATRILSQAVTCFLCLYIFIGSASATEGFESIACCADLNYTDPLTTLNYTTDYTWFSDKRSCRKIPETELRNRSNENVRLFDIDEGKRCYNLPTIKNGVYLIRGTFPFDSLNSSFNASIGVTQLGAVRSSRLQDLEIEGVFRATKDYIDFCLLKGEVYPFISQLELRPSPEEYLQDFPTSVLKLISRNNLGDTKDDIRFPVDQSDRIWKASSISSSAVPLSSNVSNVDLNANVTPPLTVLQTALTDPERLEFIHTDLETEDYGYRVFLYFLELDRTLQAGQRVFDIYVNSEIKKESFDVLAGGSNYRYDVLDISASGSLNVTLVKASKSEFGPLLNAYEILQVRPWIEETNQTDVGVIQKMREELLLQNSGNRALESWSGDPCILLPWKGIACDGSNGSSVITKLDLSSSNLKGLIPSSIAEMTNLETLNISHNSFDGSVPSFPLSSLLISVDLSYNDLMGKLPESIVKLPHLKSLYFGCNEHMSPEDPANMNSSLINTDYGRCKGKESRFGQVIVIGAITCGSLLITLAFGVLFVCRYRQKLIPWEGFAGKKYPMETNIIFSLPSKDDFFIKSVSIQAFTLEYIEVATERYKTLIGEGGFGSVYRGTLNDGQEVAVKVRSATSTQGTREFDNELNLLSAIQHENLVPLLGYCNESDQQILVYPFMSNGSLQDRLYGEPAKRKILDWPTRLSIALGAARGLAYLHTFPGRSVIHRDIKSSNILLDHSMCAKVADFGFSKYAPQEGDSYVSLEVRGTAGYLDPEYYKTQQLSEKSDVFSFGVVLLEIVSGREPLNIKRPRTEWSLVEWATPYIRGSKVDEIVDPGIKGGYHAEAMWRVVEVALQCLEPFSTYRPSMVAIVRELEDALIIENNASEYMKSIDSLGGSNRYSIVIEKRVLPSTTSTAESTITTQSLSHPQPR

SEQ ID NO: 11047 - protein, 412 aa, Rickettsia bellii
NTEFAELKIRDKIFKLPILKASIGQDVIDISKVYSEADCFTYDPGFMSTASCRSTITYIDGDQGILRHRGYDIKDLAEKSDFLEVAYLLIYGELPNNKQYNDFTKKVAHHALVNERLHYLFQTFCSSSHPMAIMLAAVGSLSAFYPDLLNFFKEADYELTAIRMIAKIPTIAAMSYKYSIGQPFVYPDNSLDFTENFLHMMFATPCEKYKVNPVIKNALNKIFILHADHEQNASTSTVRIAGSSGANPFACVSTGIASLWGPAHGGANEAVINMLKEIGSVENIPKYIAKAKDKNDNFRLMGFGHRVYKNYDPRAAVLKETCKEVLKELGQLDNNPLLQIAIELEAIALKDEYFIERKLYPNVDFYSGIIYKAMGIPPQMFTVLFATARTVGWMAQWKEMHEDPEQKISRPR

SEQ ID NO: 11048 - protein, 375 aa, Desulfovibrio desulfuricans G20
MSQRDYYEVLGVSRDAADDEIKRAYRKKAMEFHPDRNPDNPEAEAKFKEAAEAYDVLRDAEKRARYDRFGHAGVNGNGYGGGGGFSSTEDIFAHFGDIFGDLFGFAGMGGARGPRPQAGSDLRYNLNISFRQAARGDEVTLRIPKNVTCPDCSGSGAAPGTQPETCPQCGGSGQVVRQQGFFQMAMPCSACRGEGRIVRNPCPRCRGAGQVQDIRELSVRIPAGVDTGNRLRLRGEGEPGVHGGPPGDLYVVIRVDDDKTFRRQGQDLVVRKEISFVQAILGDKVEVPTLDDPVTVDIPRGTQSGEVFRIAGKGLPHLGSSQTGALLVEVTVRIPSSVNDEQEKLLREFERLEENRPLRKVKNMFKKAGKAMGMD

SEQ ID NO: 11049 - protein, 411 aa, Rickettsia helvetica
DSEFAELKIRGKIFKLPILKASIGEDVINISRVSAEADCFTYDPGFMSTASCQSTITYIDGDKGILRHRGYDIKDLAEKSDFLEVAYLLIYGELPSSEQYNNFTKQVAHHSLVNERLHYLFQTFCSSSHPMAIMLAAVGSLSAFYPDLLNCKEADYKLTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYIAKAKDKNDPFRLIGFGHRVYKNYDPRAAVLKETCKEVLKELGQLENNPLLQIAIELEAIALKDEYFIERKLYPNVDFYSGIIYKAMGIPSQMFTVLFAIARTIGWMAQWKEMHGDPEQKISRPR

SEQ ID NO: 11050 - protein, 716 aa, Marinobacter sp. ELB17
MTRSKLLLILVIAVIVGFFLGFDGHKLLTLENLQANQGALAQWIDQNLLIAVVGYAAIYVVVTALSLPGATIMTLAGGAFFGNLYGLAAVSIASTLGASLAFLVARFLMRDTLRERYRETIAKMDRGIKKDGAFYLATLRLVPVFPFFLINLAMGLTGMKLRTYALVSWIAMLPGTFVFVNAGTQLGQIQSTGDIVSADLLLSFALLGLFPLVAKIVVGFLRRRKVYAGWKKPERFDYNLLVIGAGSAGLVSAYIAAAVKAKVALIEKHKMGGDCLNTGCVPSKALIRSAKAADTLRHANRYGLESVAVKGSFRNIMNRVKDVIAKVEPHDSPERYRDLGVDCIAGEASFVSPWELEVRHNDGHNERLTARSIIVATGGKPAMPPIPGLEDMEPLSSDNLWELQEQPERLLVLGGGPIGSELAHAFARLGSQVIQVEMGDRLLAKEDSDVSELVRVQFENDGVDLRLEHAAKEFAIEEGEKVVYCEHKGERVRIAFDQVLVAVGRAANTKGLGLDKIGVETLPNGTVPVEEDMSLRYPNVFACGDVAGPYQFTHAAAHQAWYAAVNALFGQFKRFKVDYRVMPWVTFTSPEVARVGLSEAEAREKGVAFEVTKYGLDDLDRAITESEDSGFIKVLTPPGKDKILGVVVVGSHAGEILAEFTLAMKHGLGLNKILGTIHPYPTWNEAAKAAAGQWKRANAPQRLLAIVEKIHSWRRG

SEQ ID NO: 11051 - protein, 411 aa, Rickettsia japonica
DSEFAELKIRGKIFKLPILKASIGEDVIDISRVSAEADCFTYDPGFMSTASCQSTVTYIDGDKGILRHRGYDIKDLAEKSDFLEVAYLLIYGELPSGEQYNNFTKQVAHHSLVNDRLHYLFQTFCSSSHPMAIMLAAVGSLSAFYPDLLNFKEADYELTAIRMIAKIPTIAAMSYKYSIGQPFIYPDNSLDFTENFLHMMFATPYTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 11052 - protein, 178 aa, Triticum aestivum
  misc_feature (65)..(65): Xaa can be any naturally occurring amino acid
  misc_feature (88)..(88): Xaa can be any naturally occurring amino acid
  misc_feature (114)..(114): Xaa can be any naturally occurring amino acid
MAPTVMASSATSVAPFQGLKSTAGLPVSRRSNGASLGSVSNGGRIRCMQVWPIEGIKNSETLSYXLPTAQATGGPSLKARSNYLIRSXKWVPCLQVNKVGSTFPLTTTHPLGYXYGRYWDMLELPKFPGAPTPPGDRRWRRSKKGYLTLFPHIDTNGQNQLPLTTGSRSGRLKIPHSI

SEQ ID NO: 11053 - protein, 411 aa, Rickettsia massiliae
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEVVINMLKEIGSSEYIPKYIAKAKDKNDPFRLMGFGHRIYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 11054 - protein, 411 aa, Rickettsia parkeri
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 11055 - protein, 133 aa, Enterococcus faecalis V583
MKETSLVIIKPDGVERKLVGKIIQRFEDKGIDLLHLKFERLTVETVKEHYEHLKDELFFPELLAYMTSGPVVVMVVVGDNVVKKVRKLVGATNPLDAESGTLRADYGLSVTKNLIHASDSVQSAKIEMQRFFG

SEQ ID NO: 11056 - protein, 451 aa, Shewanella sp. MR-7
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLHLENGESVTVDCLIWAIGRSPATGNIGLENTDVQLDSKGYVITDAQQNTTHKGIYCVGDIMAGGVELTPVAVKAGRLLSERLFNGMSDAKMDYSQIPTVVFSHPPIGTMGLTEPEARAQYGDDNVKVYTSTFTSMYTAVTSHRQACKMKLVCAGKEEKVVGIHGIGFGMDEILQGFGVAMKMGATKADFDAVVAIHPTGAEEFVTMR

SEQ ID NO: 11057 - protein, 792 aa, Escherichia coli
EAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 11058 - protein, 431 aa, Vibrio vulnificus YJ016
MTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDLERFKRFFHLMIDHGVYLAPSAFEASFTSLAHGSKEIEATLEAADRCFAILAAESK

SEQ ID NO: 11059 - protein, 131 aa, Brassica napus
MLPVRQTKRVFYSASVFTLARKRRRCVSSSISPAPETNTGPNLLDSIPDDLVVSILCKLASTSRCPADFISVSMICKRLNTLATCPYVLSRLSRKAIAIKAQNWSESAHRFLKRSADAGSLEACYTLGMIR

SEQ ID NO: 11060 - protein, 349 aa, Burkholderia vietnamiensis G4
MRWSRSSSPRSTAAACTSARPTARRSPSTRCRTRGRPTRSAPPTRSHAGSPFAAGARAFLREIRPMCLIAFDWQPDAAAGPVFTLAANRDEFFRRTSAPLSWWEDVPGVLAGRDLEAGGTWLGVSRDGRFAALTNYRAPFDIRAGAPTRGKLVSDFLGGPGVAPLDYLGALAEHAAVYNGFNLLVGDWKRRELAWFCNRAAEGESRVAAPMAVGAGVHALSNARLDTPWPKVVRKRAELGTLLTDNATPSLDELIDLLRDPRVADDDALPHTGIPLERERALSAAFIETPEYGTRGTTALRVTMKEGVRLTVDIKERCDDDGSHRTVRPGTFERAFTFDIDATPPRAVR

SEQ ID NO: 11061 - protein, 338 aa, Burkholderia vietnamiensis G4
MASCDACPFTAPRAPSSPMPLNPKIAQVLDMIERAKRPSYHHQTPQQARAAYEKSAPILDVAPAPMHSVDACVVPTRDGRTIGARLYLPVAPSLAEPLPALVYYHGGGFTVGSVDTHDALCRMFARDAQCAVLSVDYRLAPEHKFPTAVHDAEDALRWLHREAAAFGIDAARLAVGGDSAGGTLATVCAVLARDAGIHLALQLLIYPGVTGHQATESHARLANGYLLTQDTIQWFFSQYVREPADRDDWRFAPLDGTRGAPSSFAGVAPAWIATAEYDPLSDEGAAYAQKLRAAGNTVALVCYPGMIHEFFKMGGYIPEVRAAHADATAALRAAFDGV

SEQ ID NO: 11062 - protein, 442 aa, Solibacter usitatus Ellin6076
MPSSDPIRHVILLIMENRSFDHMMGGLSTVLPGLDGVDPQHPHVNYDAAGTPFFQAPSTIRQTTSDPKHEHADVVIQLANNNGGFVQDFIKAYPNSTTQERQQIMDYFPADFLPGLHSLAHDFTVCDRWYSSVPGPTWPNRFFALSGTSLGRILMPASVTTDPGAYFQQTQITLFDRLTQAGKSWKNYFCDFPAAWLLLRNLLPQNVVHSRPIDEFFTAVRDEKSFPEFAFIEPKYFGADENDDHPPHNIMKGEKFIADVYNAIRSNPDLWNSSLLVIFFDEHGGFYDHVTPPGAVAPDDHQHEYTFDQLGVRVPSLLISPWVSRAVDHTQYDHTSVLKYLIDKWKLGSLGRRAAAATSIAGALRESKPRTDTVPFIRVPYTVLMPEHPEWETAAVSGHQDGLELFAQHLQSQINGVPQTITQLADTVRTGILGIPAALGIK

SEQ ID NO: 11063 - protein, 174 aa, Glycine max
ITAIENGLRGKHNGSSTTISPLAGKLFVVIGAGGAGKALAYCCQAKGARVVIANRTYDHARKLAYAIGGDALALADLDNYHPEDGMILANTTSIGMQPKVDETPVSKHALKYYSLVFDAVYTPKITRLLKEAEESGATIVTGLEMFMGQAYGQYENFTGLPAPKELFRKIMENY

SEQ ID NO: 11064 - protein, 552 aa, Xylella fastidiosa 9a5c
MKALFRACRIGKVMLRYRLDTLLDGTAAERWLRLAKPFVPRISAEIVEQSRGRRLRLALQELGPIFVKFGQILSTRRDLVPQDIGDELVMLQDRVEPFEGQTARIIIETALGKSVESAFAHFDTVPLASASISQVHAATLHDGREVVVKVLRPDIEHQISDDIALLKSLATLVEHTHPNADKIRPCEIVAEIETTLAAELDLQREGANASVLRRFWEASDDIYVPEVIWSHTAEQVLTLERMYGIPSDDIALLDASGIDRKALSSKGIRVFYTQVFRDNFFHADAHSGNIWVDSDPARKSNPRFIALDFGIMGQLSQKDQYYLAENFMAIFHKDYRRIAELHVEAGWIPPHVRIEELEAAARSVCEPYFTRPLSQISLAEVLMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYGLHPDGLYLGAIPVWSLISGCVGALALFSAWWRS

SEQ ID NO: 11065 - protein, 664 aa, Shewanella oneidensis MR-1
MSSRKVLANAIRALSMDAVQKANSGHPGAPMGMADIAEVLWNDFLKHNPNNPKWVDRDRFILSNGHGSMLIYSLLHLTGYDLPMDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWPHAPFEIPADVYAGWDAKDAGAAREAAWNDKFAAYAAAYPELAAEYERRVLKGELPADFEAKAQAFIQECQAKGEGIASRKASQNAIAAFGAILPELLGGSADLAGSNLTLWAGSKGIQDDPAGNYVYYGVREFGMSGIMNGVSLHGGFINYGATFMMFMEYARNAVRMSALMGIQNIFVYTHDSIGQGEDGQLTNPFEQLANLRMTPNMAVWRPCDAAETAVAWKAAIERRHAPTSLIFSRQNLKAQARTAEQLANVAKGAYVLQDCAATPEYILIATGSEVQLAMEAAATLTEQGKQVRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 11066 - protein, 455 aa, Arabidopsis thaliana
MDRVSNLPDGVRGHILSFLPAKHIALTSVLSKSWLNLWKLIPILDIDDSEFLHPEEGKAERLEIRQSFVDFVDRVLALQDDSPIDRFSLKCITGIHPDHVNRWICNVLQRGVSDLDLFIDFSYEDTQEDEDMLPQEMFVSKTLVKLKIRNDRCVDWWCGKGGTSLPMLKSLYIDSDLILWGKMKRFLSSFPVLEELRMASMEWKESHETVSSASLRKLSILGTGCEDYVNPKSISFDTPSLLYLNYSDLVAEDYPLVNMGKLLEARINLIVKDDQIKRVREPNNDLLQDDAGNVVLQFGNVVKLMNGIQNIQILYLTADTLEVLSLCCESMPVFNNLKTLGIKSEEGRGWQAVPALLRNCPHLEYLIIEGLLHNVTDKCGDACDCISREDKGRSLASCPVKKEMGIFPEEEGPTNFENPGAFEYVEKILKLYNEISNCDVYFLVWGYMRRKWTTQ

SEQ ID NO: 11067 - protein, 391 aa, Shewanella oneidensis MR-1
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLYAPIACAGPLLAQELDALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVSDVGDSDMIFDIGPDSAEALAKIIESAGTIVWNGPVGVFEFDQFGEGTKRIAHAIADSKAFSIAGGGDTLAAVDKYGIADKVSYISTGGGAFLEFLEGKELPAVAMLKKRGA

SEQ ID NO: 11068 - protein, 296 aa, Bdellovibrio bacteriovorus HD100
MNTDHPFYRHFEKVYGSRWPGLFAALQTREQQVARVNAWSPSDKSTKSWSQFPEKSELPGCHWLTPAHGCQPERNSDELLDIYIMDPASVMVARALDVQPGDRLLDMCAAPGGKSLVMIESFGGEGEIFCNDLSPERRERLKKVIQQYVPREVRNRVWVTGKDGVQFGLKEPGSFDRVLLDAPCSGERHILENQAAQDEWSPRRTEHLAARQYSLLAAAFLAVKVGGRIVYSTCSISPAENDDVVRKLLKKKKSAVKLLEAPVGVGGERTELGVAYMPDQCGFGPLYFAVIEKVEE

SEQ ID NO: 11069 - protein, 344 aa, Nocardioides sp. JS614
MTTQAAAQPATPQQAGGGTGLDPAVRLDLYETMVLSRTYEEAILREYHADKGPGFDIGKGLIPGEMHLSAGQEPVAAGVCAHLTTDDAVTATHRPHHFAVAHGVDLRRMTAEIFGREDGLGRGRGGHMHLFDPDTHFSCSGIIAEGYPPALGQAFAFHRQGTDRIAVAVTGEGAANQGAFHESLNLAARWSLPVVFVVEDNDWGISVPRTASTSVASNADRAAAYGIPGERIEGNDVEGVYDAARRAVARARAGEGPSLIEVHTLRLWGHFEGDAQGYRLDLEDAPSHDPIPRYETRLREAGVLDDETVTRIRSAASERTEDAIAFAKNSPVPDPASATSYVFA

SEQ ID NO: 11070 - protein, 347 aa, Nocardioides sp. JS614
MTITETPTTPTPHSRRLTTSKAIVEAIAFEMERDPSVFYLGEDVGSYGGIFGSTGGLLDRFGKDRVIDTPISETAFIGLGIGAAVEGMRPIVELMFADFMGVCLDQIYNHMAKIHFESGGNVKVPMVLTMAAGGGYSDGAQHSQCLWGTFAHLPGMKVVVPSSPADAKGLMTAAIRDDNPVVYLFHKGVMGLPWMAKNPRSNDAVPDGDYETPIGKANVVRSGSDVTVVTISLSVHHALDVAERLADDGIDVEVLDLRSLVPLDREAILASVAKTGRLVVVDEDYLSFGMSGEVVATIAEHDPTLLKRPAERVAVPDVPIPYAHALEYAVLPRQDRIEAAVRRVVAG

SEQ ID NO: 11071 - protein, 500 aa, Arabidopsis thaliana
MTNIWLLSLIFVICILVAVFNHKNRRNYQRTPPSPPGCPIIGNLHQLGELPHQSLWKLSKKYGPVMLLKLGRVPTVIVSSSETAKQALKIHDLHCCSRPGFAGARELSYNYLDIAFSPYDDYWKEVRKLAVQELFSSKQVHSIQPIKDEEVKKLIDSISESAAQKTPINLNKTLLALTVSVVCRTAFSVNFEGTVLNSERFNNIVREALEMLGSFSASDFIPYVGRIIDLLTGLQGRRERSMRDLDAFYEQMFDLHKQKKEEGSEDFVDLLLRLEKEEAVLGNDKLTRNHIKAILMDVLLAGMDTSAITMTWAMAELAKNPRVMKKVQSEIRSQIKNKERISFDDTDKLEYLKMVIKETWRLHPTTPLLIPREAMSEFEINGYTIPVKTRLHVNVWAIGRDPDTWKDPEVFLPERFTDNNIDAKGQHFELLPFGGGRRMCPAVYMGTTMVEFGLANLLYHFDWKLPEGMKVDDIDMEEAPGLTVNKKNELILVPTKFLDP

SEQ ID NO: 11072 - protein, 392 aa, Synechococcus sp. WH 8102
MPRPPELSARAVGLKPSLTLAIGAQAKALQQAGRDICSLSAGEPDFDTPDFIVEATRQALRDGITRYGPAAGDPELRAAVAEKLSSGNGIAITPEQVLITNGGKQAIYNLFQVLLNPDDEVLLPAPYWLSYPEMAALAGAKVKLIPTQAEEGFRLDLAAVEAAISPRSRLLLLNSPGNPTGRVMKRQELEDVAELVRRHPQLLVMSDEIYEFLLAEGEQHHSFAAIAPDLADRCFTVNGFAKGWAMTGWRLGYLAGHQDVIKAAAALQSQSTSNVCSFAQRGALAAIQGPRACVSAMAESYNRRRQLLTEGLQAIEGITLVEPRGAFYAFPQLPESAGGSMDFCSRALEQAGLAVVPGLAFGNDRCIRLSCAVSRETIRDGLSRLTQLLDET

SEQ ID NO: 11073 - protein, 414 aa, Campylobacter coli RM2228
MLVIEDVRAYEVLDSRGNPTVKAEVVLSDGSMGAAIVPSGASTGSKEALELRDNDERFGGKGVLKAVSNVNETIADEILGLDALNQAQLDDTLRELDGTNNYSKLGANATLGVSMATARAAANALGVPLYRYLGGANASILPVPMCNIINGGAHASNNIDFQEFMIMPFGFTSFKEALRSVCEIYAILKKELANLGHSTALGDEGGFAPNLANNTEPIDLLMTCIKKAGYENRVKIALDVASTEFFKEGKYHMEGKAFSSEDLIERYVELCAKYPICSIEDGLAENDFEGWIKLTEKLGNKIQLVGDDLFVTNEDILREGIIKKMANAVLIKPNQIGTITQTMRTVRLAQRNNYKCVMSHRSGESEDVFIADFAVALNTGQIKTGALARGERTAKYNRLLEIELESDEYLGEKL

SEQ ID NO: 11074 - protein, 248 aa, Saccharomyces cerevisiae
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 11075 - protein, 467 aa, Candida tropicalis
MSALRSFQRSSNVAKSTLKNSVRTYATAEPTLKQRLEEILPAKAEEVKQLKKDYGKTVIGEVLLEQAYGGMRGIKGLVWEGSVLDPIEGIRFRGRTIPDIQKELPKAPGGEEPLPEALFWLLLTGEVPTEAQTRALSEEFAARSALPKHVEELIDRSPSHLHPMAQFSIAVTALESESQFAKAYAKGVHKSEYWKYTYEDSIELLAKLPTIAAKIYRNVFHDGKLPAQIDSKLDYGANLASLLGFGENKEFLELMRLYLTIHSDHEGGNVSAHTTHLVGSALSSPFLSLAAGLNGLAGPLHGRANQEVLEWLFKLREELNGDYSKEAIEKYLWDTLNAGRVGPGYGHAVLRKTDPRYTAQREFALKHMPDYELFKLVSNIYEVAPGVFDQHGMTKNPWPNVGSHSGVLLQYYGLTEESFYTVLFGVSRAFGVLPQLILDRGLGMPIERPKSFSTEKYIELVKSIGKN

SEQ ID NO: 11076 - protein, 1119 aa, Aspergillus nidulans FGSC A4
MYKTGNHSSDPARKNHRSAPPIPERLNTGNSRLMRQTRTAAKDSSFVLISRSGHFLANQCLASSCCSSVNLLEPDAAGSEDYMAGSHRSPVLKDQWRGSSGEVGDQRGREKHSRPRGSHRDRGRERFRDQDRHHHHPPNDDRLHRSSRSPPPRSFPGPDNKPQHRDFSTNIASTRASPAPSRSEIRPSQNINRPDSPERIGYRVTNSHMRSAERNHRREDSPSAPPFKRQRTHSPPPDGFQGRPPTHSRGAPPRHGRDFDREPSHSKGRGGRPPGRGRPSRRPSPRRERERRKHDSGLRDPSRNRQPWSHDWEDKPPIHPSRRYRSPPLDGIERDSYLRSPSRVSAGTLDSRTSALSRRGSKGDIAMHPPPSPSRLSLDRVPDTGYGAGLPERSRASRSPVNSYHESTRPSSPYSTARSGRSGQHSSHPSQHSFRASNFSEHDSPSRLSHGQPTSSHHVAPSHSYRDGQQRYQETHQDRRISGIVPTAPLSHARNRFSSPQRDASASRSRAGPPSPPQGPAADDPPPPPPPPTEPRSHREGYQNLTNHRPASRETRAPDEGSGHDSGSGFRAGQTGQPDTRPPEPPSGPSKGGKISFAFKAKTGPPSAPKPVPDLAQRMLAREPPQRVAEPPRSKMSSGPPPRFKPEPRFDRRDRDRDRHRDRDRNRGRNDRRDYREPRGSREARDYRDSRRDDRRVDPRDKRRNDKASGVRPERRHDPSPEPVKRSKIMLRLKPRPTISEEFANSDSVYFRKPGNESVIGAGTYGKVFKAIHVYTQRKVALKKIRMEGEKDGFPVTAVREIKLLQHLRNHNVVSLLEVMVEKNECFMVFEYLSHDLTGLINHPTFTLTAAHKKDLAKQMFEGLSYLHHRGVLHRDIKAANILISNQGRLKYADFGLARFFSKSRQLDYTNRVITIWYRPPELLLGETQYGPAVDVWSAACVYVEMFTKKAVFPGEGGEISQLDKLYNTLGTPTRAEWPNIVEMPWFELMRPTERRKRIFEDIYRDILSPAALDMVSQVFRYDPAKRPSAEDVLAHPYFHSEEPSPQQPIELENIQGDWHEFESKALRKERDREARRAEYQRDKEKRKILAAQDERETKRIKPDTSDGLTSSVPQPGQQ

SEQ ID NO: 11077 - protein, 320 aa, Enterococcus faecalis V583
MKRIGILTSGGDAPGMNAAIRAVVRKSIFDGIEVYGINYGFAGLVAGDIRRLDVADVGDKIQRGGTFLYSARYPEFATEEGQLKGIEQLKKFGIEGLVVIGGDGSYHGAMALTKRGFPAVGIPGTIDNDIPGTDFTIGFDTAINTVLESIDRIRDTATSHVRTFVIEVMGRNAGDIALWSGVAGGADEIIIPEHDFDMKNVAKRIQEGRDRGKKHCLIILAEGVMGGNEFADKLSEYGDFHTRVSILGHVVRGGSPSARDRVLASKFGSYAVELLKEGKGGLCIGMLDNQVVAADIIDTLENNKHKPDLSLYELNHEISF

SEQ ID NO: 11078 - protein, 286 aa, Medicago truncatula
MFRESCDIVIIITSSLFLSRLQPSSTHEPTPPDSPQSANHRTSSFSNKMVKLKIPEHQVAGHQAKNGILGPLIDDSGKFYKPLQDDERGSNELAFYTSLYSDPRIPTNILKFFPSFHGTQTVDASDGSGLHPHLVLEDIVSNYTNPAVVDIKIGSRTWHPQSSEDYIRKCLQKDRESSSIKLGFRISGLRSVGPTNQLWQPHKKFLMDLSVDDVMLVLRKFVSSDGNVDEPDCVFGSRVFVPILEELLELKKWFEVQTIFHFYSCSVLVVYEKDEKEDEKKSASAV

SEQ ID NO: 11079 - protein, 235 aa, Triticum aestivum
  misc_feature (116)..(116): Xaa can be any naturally occurring amino acid
MGKLLCDSSPGGGAVAVAEALPPSPAPASPPQLLAWAAPEPPAGWSAVWALDDQQRRRLLRIWERGVAWKPPRQGGDGPEAPAPAPAVVFRLDHGGEVESDGNCLFTAARRAAGRXAEAREFRHRAVRRFADVSPAAEGSQQGAPLTPPLAQPPGRRNLKARLEGAYSIQGGSSWPPAQKPTANIPLRRPFRKLRPVSGVPKGLLGTPKYMFTERGLFPAAPPREIFVGAHSSYC

SEQ ID NO: 11080 - protein, 222 aa, Aquifex aeolicus
  misc_feature (1)..(1): Xaa can be any naturally occurring amino acid
  misc_feature (208)..(208): Xaa can be any naturally occurring amino acid
XSLRVILFDLDGTLIDSAKDIALALEKTLKELGLEEYYPDNVTKYIGGGVRALLEKVLKDKFREEYVEVFRKHYLENPVVYTKPYPEIPYTLEALKSKGFKLAVVSNKLEELSKKILDILNLSGYFDLIVGGDTFGEKKPSPTPVLKTLEILGEEPEKALIVGDTDADIEAGKRAGTKTALALWGYVKLNSQIPDFTLSRPSDLVKLXDNHIVEFEGHHHHH

SEQ ID NO: 11081 - protein, 344 aa, Scopolia parviflora
MATLVSNWSSNNVSESFIAPLEKRAEKDVPLGNDVPMIDLQQEHHLVVQQITKACQDFGLFQVINHGFPEKLMAETMKVCKEFFALPAEEKEKLQPKGEPAKFELPLEQKAKLYIEGEQLSNEEFFYWKDTLAHGCHPLDEKLVNSWPEKPATYREVVAKYSVEVRKLTMRMLDYICEGLELKLGYFDNELSQIQMMLTNYYPPCPDPSSTLGSGGHYDGNLITLLQQDLPGLQQLIVKDGNWIAVEPNPTAFVINLGLTLKVITNEKFEGSIHRVVADPTRDRVSIATLIGPDYSCTIEPGKELLSQDNPPLYKPYPYTEFAEIYLSDKSGYMLVLSHIKSNA

SEQ ID NO: 11082 - protein, 134 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEVQQRVGFVFPVSTKSSPGYRWVDTGTMESLCSGNRPTQGGSNEG

SEQ ID NO: 11083 - protein, 359 aa, Scopolia parviflora
MAFRNGSTNTTINHLNGASTIPKNGSTTTTINHLNGASTIPKNGNNITTTLLKNGSPHEFGCIKPGWFSEFSELWPGEAFSLKIEKLLFQGKSDYQDVMLFESATYGKVLTLDGAIQHTENGGFLHIEMIVHLPLGSIPSPKKVLIIGGGIGFTLFEVLRYPTIEKIDIVEIDDVVVDVSRKFFPYLAAGFDDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPQVDFRNPVNPIDKKPSHIKSKGPLKFYNADIHKAAFILPSFARNLMEKEIFSIV

SEQ ID NO: 11084 - protein, 504 aa, Xylella fastidiosa 9a5c
MLTRKKSMDCKVGRLGMPIALAVSDCYPNPKRFPLMSLENVEKLVKDKKIEFVDLRFVDMRGVQQHVTFPVNILEPSLFKDGKMFDGSSIAGWKGINESDMVLLPDANTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNGGYRPAVKGGYFPVPPTDSLHDLRAEMVKTLEQVGIETEVHHHEVATAGQCEIGTKFNSLVKKADQLMTMKYILKNVAYRNGKTVTFMPKPMVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFIDGYIALKMQEVTQFRAATHPLEYQMYYAN

SEQ ID NO: 11085 - protein, 656 aa, Glycine max
  misc_feature (50)..(50): Xaa can be any naturally occurring amino acid
  misc_feature (338)..(338): Xaa can be any naturally occurring amino acid
IFTPTITCPPQPSPTSETPASYHPSVDAPQEPESDVRRRRRFAAPPIASXGSSPSTSRPEDLNLFLELLPLKMRRELYRHREIGGLIEIVMDLGRKPLARFPSGDWVISEQPIAQEDLRHAISKVGEFSDDNRSGIDRSLHRISAIRNRKMQIIGLTCRVGRAVGGSAEIIRDLVEDGGSILVIGPPGVGKTTLIREIARMLADEFRKRVVIVDTSNEIGGDGDVPHAGIGRARRMQVPNVNMQHNVMIEAVENHMPETIIIDEIGTELEALAASTIAQRGVQLVGTAHGMTIENIIKNPYLQILVGGIESVTLGDEEARKRKVQKTILERKGPPTFXCAVEMISKTECRVHHRLDATVDAILAGKPPLFEIRQWDDSDNELPKYAPLPEENLGETSDLTNNNITSSDNEPSEDDKDHPRTWSTKWSTSGPVMTRSSPMQVYTYKILEADLLQVAKVMGLEDVIDVTDDIGTAEAILASSSEIRQNPWIRGVAKFHHVPVFVIKSNTMAQMVKAVRMILGLESFGPTPKKPLNECLDIEIEDDEPKRKPSLEEIDALEEVRLAIEYIVIPGGEAVELLPRRSEIIARQLELVQSYQLAAEKSGTDQNPRLQILPLRLNTKKASKSTVARKKTSPTSMSTGDSGNGTSVTRLPILPE

SEQ ID NO: 11086 - protein, 332 aa, Bacillus cereus E33L
MNPLIFKENRPFDLIAVGRLCVDLNANETQRPMEETRTFTKYVGGSPANIAIGAARLGLQTGFIGKVSDDQMGRFITGYLKDNKINTDQIRIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEQSNDQVTAERWFSHYAKIVVIKHGGDGSIAYTRDGQSHRGGIFKTKVLKTFGAGDSYASAFIYGLIQGLEIPQAMRLGGASASIVISKHSCSDAMPTRAEISAFMETAEELV

SEQ ID NO: 11087 - protein, 235 aa, Burkholderia thailandensis E264
MTLLMTQDELKRLVGEAAARYVTDNVPQGAVIGVGTGSTANCFIDALAAVKDRYRGAVSSSVATTERLKSHGIRVFDLNEIESLQVYVDGADEIDESGAMIKGGGGALTREKIVASVAETFVCIADASKRVAMLGQFPLPVEVVPMARTAIGRRLAALGGVPVLRVKQDGTPYVTDNGNEILDVKGLRIDDPRALEAAINGWPGVVTVGLFAQRGADLCLLGTEHGVETLRYAAR

SEQ ID NO: 11088 - protein, 300 aa, Burkholderia thailandensis E264
MANGTQDGIQIRGSVPAIVTPMLEDGSLELAAFRKLIDWHIEEGTDALVVVGTSGESATLSVDEHVLMIETAVKHAAKRIPIVAGAGGNSTAEAIELSKHAKAVGADATLQVVPYYNKPTQEGMYRHFKAIAEAVDLPVILYNVPGRTVADMSNETILRLAQVPGIVGVKDATGNIDRAAQLIKAAPAHFSIYSGDDPTAIALMLLGGHGNISVTANVAPRAMSELCRAALAADVKTAREIHMKLLSLHKHLFIEANPIPVKWALQQMGKIAGGIRLPLTPLDERCHEAVRGALREAGLL

SEQ ID NO: 11089 - protein, 217 aa, Oryza sativa
SSTLVVSSAPCLLAPPPRRVAAEQGRAGRRSPSQRRGGDPDAMSTGDSTESLDIDCLDDGDSEVVSSLQHLADDKLHISDNRDVAGVASKWTKHGCNSVEIDYIVDIDNNHEDPQLCATLAFDIYKHLRVAETKKRPSTDFVETIQKNIDTSMRAVLIDWLVEVTEEYRVVPETLYLTVNYIDRYLSSKVINRRKMHYLVSFAWLLVLSMKRYGHPS

SEQ ID NO: 11090 - protein, 422 aa, Campylobacter coli RM2228
MSNSVTVTDNRNGKSYEFPIYDGTTGPSVVDMGSFYKQTGMFAYDEGLTSTATCKSKITYIDGEEGVLMHRGYPIEWLAENKLFLDVVHLLLYKELPSNERLEAFRYELKKRSYIHEGMHRLFDSFPDNAHPMAVLQGAVSSLSAFYPDHLNMNVREEYMEMAARVVAKIPTIVAAAYRYKNGFPMAYPNLDRGFTENFLYMLRTYPYDHVELKPIEVKALDTVFMLHADHEQNASTSTVRAVGSTHAHPYACISAGIGALWGHAHGGANEGVIRMLEEIATVDRVDEFIKRAKDKNDPFRLMGFGHRVYKNFDPRAKVLKKLRDQLIDELGIDTNLIKVATRIEEIALQDDYFVQRNLYPNVDFHSGLILKALGIPNEMFATLFVIGRTPGWIAQWIEQKEQETLKIVRPRQLYLGETSKI

SEQ ID NO: 11091 - protein, 460 aa, Lupinus albus
MGYSSFVAIALLMSVVVVCNGGKTSTYVRNLIEKPVDMPLDSDAFAIPPGYNAPQQVHITQGDLVGQAMIISWVTVDEPGSNQVIYWSDSSLQNFTAEGEVFTYTYYNYTSGFIHHTTITNLEFDTTYYYEVGIGNTTRQFWFITPPEVGLDVPYTFGIIGDLGQTFDSNTTLTHYQNSNGTALLYVGDLSYADDYPYHDNVRWDTWGRFTERSAAYQPWIWTAGNHEIDFDLQIGETQPFKPFSTRYHTPYEASQSTEPFYYSIKRGPAHVIVLATYSAFGYSTLQYKWLTAELPKVNRSETSWLIVLMHAPWYNSSNNHYMEGEPMRVIYESLFLKYKVDVVFAGHVHAYERSERVSNNKYNITNGICTPVEDITAPIYITNGDGGNLEGLATMKQPQPSYSAYRKASFGHGIFAIKNRTHAHYSWNRNQDGYAVEADKLWLFNRYWNPLNDSTIHIP

SEQ ID NO: 11092 - protein, 103 aa, Capsicum annuum
  misc_feature (68)..(68): Xaa can be any naturally occurring amino acid
INWDLRTASAYCATWDADKPLEWRQRYGWTAFCGPAGPTGQAACGICLRVTNTGTGTQATVRIVDQCXNGGLDLDVNVFNQLDTDRRGYQQGHLIVNYEFVNC

SEQ ID NO: 11093 - protein, 532 aa, Enterococcus faecalis V583
MKNSEEHEPKQRHHLIEYANGPSLEEINGTIDVPKNMSFWKTLFAYSGPGALVAVGYMDPGNWSTSITGGQNFQYLLMSIILISSLIAMLLQYMAAKLGIVSQMDLAQAIRARTSKTLGIVLWILTELAIMATDIAEVIGGAIALYLLFHIPLGLAVFITVFDVLLLLLLTKIGFRKIEAIVVALIVVIFVIFAYQVALSNPVWGDVIKGLVPSAEAFSTSHAVNGQTPLTGALGIIGATVMPHNLYLHSSVVQSRKIDRKDKTDIQRALRFSTWDSNIQLTMAFFVNSLLLIMGVAVFKSGSVKDPSFFGLFDALSNPAVMSNSILAHIAGSGILSILFAVALLASGQNSTITGTLTGQIIMEGFIHMRVPIWLRRMVTRLLSVIPVLICVLMTSGKSTVEEHIAINNLMNNSQVFLAFALPFSMLPLLMFTDSRVEMGEHFKNSWLIKLLGWVSVIGLIYLNMKGLPDQIEGFFGDNPTASQITLADNIAYVIIALVILLLVWTVVELYKGDKRYAQQLAAMEQQVEEVK

SEQ ID NO: 11094 - protein, 692 aa, Pseudomonas aeruginosa
MISKSRRSFIRLAAGTVAATVATSMLPSSIQAALAIPAHRRHGNLKDVEHVVILMQENRSFDHYFGTLKGVRGFGDRMAIPLPDGQRVWHQKGSKGEILPYHFDTSTTSAQRVDGTPHTWPDAQQAWNEGRMDKWLPAKTERSLGYYKEQDIAFQFAMANAFTICDAYHCSFQGGTNPNRLFLWTGTNDPLGQHGGPVTTNDHDSNGPVEQGYTWTTYPERLQAAGITWRVYQDMADNFSDNPLIGFRQYRAAAPDSPLIVNGLSTWKLDALKRDVLANSLPQVSWIVAPAKYSEHPGPSSPIWGAEYTSWVLDALTANPEVWSKTALLVMFDENDGFFDHVAPPAAPSLNKDGTLRGKTTADATLEWHTKGDIRYRNQPYGLGARVPMYVISPWSKGGWVNSQVFDHTSVIRFLEQRFGVMEPNISPWRRAVCGDLTSAFNFANPNNEPFPELPDTSQADAIVASQIKLPKPKPPAVAAMPKQEMGIRPARALPYELGVHARYRSGGDALSLTFANTGKAGAVFQVFDLLDSENPPKRYTVGARKRLHDSFQGDASGDYHLEVHGPNGFLRVFRGNLRRDLADGKAPLPEVRIDYEPLFGNLRVQLINRGRHPVKLTVKDNVYRQGERRTVNVPPGQRREVRYSLRSSGNWYDFSVSAQGADSFLRRFSGRMEDGRSGFSDPGMGLGTLTF

SEQ ID NO: 11095 - protein, 554 aa, Burkholderia vietnamiensis G4
MTDTPDRPDDLPVDAERRRVLGGLATLGAGVALGGCEITSGRAPRTAADLQLDETLRRHVRHIVVIFAENRSFANLYGDFPGVQYPLSAVKPEQAQQLDRDGKTPLPVLPKIWGGLVPQAQEVDGKRYVIAERDIDKLPNAPFRLADAQGKPLPNGVITRDLWHRFYQNQMQIAGGRNNQFAAWADSGGLVMGHYRNSADTLRLWNLARQYTLCDNFFMAAFGGSWLNHMFLISAQPPVYPDAHKHPQATKLLSKVDGDDPAGTRLALAANSPASALDGPPKFAADGALTPDGYGVNTMAPPYQPSYVPPADPGNAAYADPADHRVMPPQAHATIGDRLSEKNVDWAWYSGAWQYALEHRDTGSVPDFQYHHQPFNYFANYAPGTDARRKHLRDAGVGDDPSTNHFLAAVDAGKLPAVTFYKPQGNLNMHAGYADVESGDRHIANVIEHIRRSPQWANTVIVMTHDENGGWWDHVAPPVGDRWGPGSRIPALVISPFAKKGHVDHTMYDTNSILRFISRVHGLAPLDGVAARDRAFASRGAPPPGDLTNALDFG

SEQ ID NO: 11096 - protein, 564 aa, Zea mays
MAAAAVTSNGGAVAANGPAPGRLASVYSEVQTSRLLHTLPLPSVLRSNFSVVDGPASSAAGNPDEIAKLFPNLFGQPSASLVPSAEPAATRPLKVGVVLSGGQAPGGHNVICGIFDYLQERAKGSTLLGFKGGPAGIMKCKYVELTSDFVYPYRNQGGFDMICSGRDKIETPEQFKQAEDTANKLDLDGLVVIGGDDSNTNACLLGEYFRSRNLKTRVIGCPKTIDGDLKCKEVPTSFGFDTACKIYSEMIGNVMTDARSTGKYYHFVRLMGRAASHITLECALQTHPNAALIGEEVAAKKETLKNVTNYITDIICKRADLGYNYGVILIPEGLIDFIPEVQKLIAELNEILAHDVVDEAGAWKSKLQAESRELFEFLPKTIQEQLMLERDPHGNVQVAKIETEKMLISMVETELEKRKAEGRYSAHFRGQAHFFGYEGRCGLPTNFDSNYCYALGYGAGALLQSGKTGLISSVGNLAAPVEEWTVGGTALTSLMDVERRHGKFKPVIKKAMVELDAAPFKKYASLRDEWAIKNRYISPGPIQFSGPGSDDSNHTLMLELGAEL

SEQ ID NO: 11097 - protein, 591 aa, Oryza sativa
MGATLLLLCADFSAVAGGRRRPSLPSEPRLAAPAAGSRAPPSRASVRPSAAAAPLAARGLPHHASVAGDNPMESTSKCDGAEAAQPLDTKDDVEPFLQAPAVATCIGATGTRPEFGAQQGPGPGINFAPIVTPRLGPGEPVSERGQGRSCPTRPVATPSDEVVSLDDDRQLHRAAGANARESEEEHLYRLGIFRGKDGGVVVNGLDLENPLCSTLVTGFKLLRIVEAEALGAPFIHLLWREALEARLGIGYRRKGQQLLVRGGRRPGLDRGWCSCRRDQVWGKAGLVLRFGRHERNALVLVLLPLLIQCYSLTGLFNVALMSALMPPGKICNMFTLDLVLSDSPGSTWPGTSLWVMISRCVGNGHWLCRLQWGDGRERTDDEEELILRFTFKFHFKGGRCTMILSVLSSPALVSGLMVVRAKNPQNSGIYTVGDFMTKREELHVVKSTTSVDEALEMLVEHRITGFPVIDDEWNLVGVVSDYDLLALDSISGNGLAEVDIFPEVDSTWKTFIEIHDFWFTSNGKVIGDVMTSAPLVVRETTNLEDAARLLLETKYRRLPVVDSSGKLVGIITRGNVVRAALKIKKKFEGEL

SEQ ID NO: 11098 - protein, 555 aa, Arabidopsis thaliana
MNITATSLDSEDELSIKYMDAVDNINILKRYGCDIQHEVDVHTMSFDNSLSLQRYDRIVFNFPHAGSRFFGRELSSRAIESHKELVRGFLENAKEMLEEDGEIHITHKTTYPFSDWGIKKLGKGEGLKLLKKSKFELSHYPGYITKRGSGGRRSDDYFPVDVDPCDLKGFEVLEIYHPSMSDGFVNSVMVARKLTDRLIKYEWCTGTRSLNSLKKTRQTEPDQFNKREINRSGPGQVAEEEEEVVAVMMMMTSLGGGAGGGGGGGGSGGGRFVTYPPPLSVPPSAPQSPNFSGGLRSQPSFLVEQEKYLSELLAERHKLTPFLPVLPHVCRLMNQEILRVTTLLENALSQSRFDHPSPLASGGIFQNSRADMNGWASQFPSERSVSSSPAPNWLNSPGSSSGLIVKRTIRVDIPVDKYPNYNFVGRLLGPRGNSLKRVEASTDCRVLIRGRGSIKDPIKEDMMRGKPGYEHLNEPLHILVEAELPIEIVDARLMQAREILDDLLTPVEETHDFYKKQQLRELALLNGSLREEGSPMSGSISPYNSLGMKRAKTRG

SEQ ID NO: 11099 - protein, 276 aa, Ostreococcus tauri
MAAMLDQSLDAMIKETRKATPKARKANAKKTGNKTPIGGKKKIGGLKNRSTGATPMAMDIGGGVKKGGKNRKPMRSNAATAMAIDSARRGVNGNARIAVGGKTKLMVGNLDFKVNDRDIKVSLGIAELFSQVGRVLSAGVNYGPNGKSKGTAEVTLATLDSAMKAVSTYNGVKLDGRPLQIVIVDAPQNKQSAKPITHRLSGLKQQPTKNGKQQQKPGNRGAATAKVVAATKKTAPKKKAPKKKAPKKEDAPKPTAADLDASLDAYKASADVQMAA

SEQ ID NO: 11100 - protein, 346 aa, Nostoc sp. PCC 7120
MTTVLAIETSCDETAVAIVNNRQVLSSIIASQISVHQQYGGVVPEVASRAHLETINGAIAQAMDQAQLGWDKIDAIAATCAPGLVGALLVGLTAAKTLAILHNKPFLGVHHLEGHIYATYLSEPTLDPPFLSLLVSGGHTSLIYVKECGRYESLGETRDDAAGEAFDKVARLLKLGYPGGPVIDKLAQTGNPQAFALPEGKVSLPGGGYHPYDGSFSGLKTAVLRLVQQLEKDGDSLPLEDIAASFQATVAKALTKRAIACALDYGLDTIAVGGGVAANSGLRQHLQAATAANNLRVLFPPLKFCTDNAAMIACAAVDHLSRGHTSPITLGVESRLSLSQVMKLYQ

SEQ ID NO: 11101 - protein, 306 aa, Ostreococcus tauri
MQSAKNAAPVVSAALQALVYGGTGAYGLYHRCAHRAFERVGARKRRISRVTRVHSLFNVEGGHRAIVYNRFVGVKDKVYSEGTHFIVPWVERPYIYDVRARAHQVNSQSGSRDLQMVNISIRVLTRPDTSRLPEVYKTLGMDFNERVLPSVIHETVKSVVAQHNASELITKRQEVSLAIRRLLQERASQFNMVLDDVSLTALTFGREYTAAIESKQVAQQEAERAKFVVERAKQEKLSAVIQAEGEAKSAKLIGEAIANNPAFLTLRKIEAARAIAQTMANSSNRVMLSADSLLLNLQDNDKDGKK

SEQ ID NO: 11102 - protein, 358 aa, Oryza sativa (japonica cultivar-group)
MPAFADIAIDPPLADSYRALALLRRDRDGGIAPPAVQMVGSGGAVLERDLPMVDLERLTRGGAGERKACAGAMARAASEWGFFQLTNHGVGRELMEEMRREQARLFRLPFETKEKAGLLNGSYRWGNPTATSLRHLSWSEAFHVPLASISGADCDFGDLTSLRGVMQEVAEAMSRVANTVAAALAEELTGRGGGGASAAPWFPAGCDETTCFLRLNRYPACPFAADTFGLVPHTDSDFLTVLCQDQVGGLHLMKDSRWVAVRPRPDALVVNIGDLFQAWSNNRYKSVEHKVVANAKTDRLSVAYFLCPSYDSLVGTCGEPSPYRAFTFGEYRKKVQEDVRTTGKKIGLPNFFKHSSVQ

SEQ ID NO: 11103 - protein, 293 aa, Oryza sativa (japonica cultivar-group)
MADDPSLDFGEFPQPFCSQQVVSFQPSVTTSGSGGMPVYLDCSSGMDSNTVMLSTTPSVVVSTTSSNTVADPGQNLKYGGPLAADWSRLELDVLKDGLQKYGNEQGIMKYIKIAASLPSKTVRDVAMKCQWLGKRENSRRRKSEDHHTGRKMKERKAKMAEPSLWGTNHPVQTDTRVPSFVSHNAIQNNQILTGATGIDRAMQHLLVPNDRLLDQIEANMLACQPQNNIELFHRTRRNINGLLQTMNQMPGIMSKMPPLPVSVNENLASFVLPGLTVPQFLGGSQLKEEPRGW

SEQ ID NO: 11104 - protein, 153 aa, Glycine max
MKLSCLLLVSFFAAAYASSERAIAVAGAGGLLSDPEQQCVYTVYVRTGSIWKGGTDSAIGVTLLGSDGTGVRIADLEQWGGMMGAGHDYYERGNLDIFSGRGPCMERAPCWANVTSDGAGAHHGWYCNYVEVTATGPHMGCAQQLFTVEQWLA

SEQ ID NO: 11105 - protein, 334 aa, Solibacter usitatus Ellin6076
MAHQITLIPGDGIGPEVADATVRAVDATGAKIEWERVDAGARALAEQGQLIPDDVFASLECTRVGLKGPTATPIGGGHQSINVALRKKLGLYTNFRPVRMLPGLKTRYHDLALDLAIFRENTEDLYSGLEHEVVPGVVESLKIITQNASMRIARAAFEWSRRESRKKVVAIHKANIMKLSDGLFLKCCREVASHFPDVAYSEMIVDNACMQLVMRPETFDVLVLPNLYGDIISDLTAGLVGGLGIVPGANIGDNHAIFEAVHGTAPDIAGKCMANPTALMQSAVLMLAHLGERDASARLHAAIYQTYAERDHLTGDVGGKSSTTEFTEAVIRRL

SEQ ID NO: 11106 - protein, 456 aa, Nocardia farcinica IFM 10152
MAGGEPKRRRWSIVPQTQAASRRRVVIVGSGFAGFTCAKHLCRTLAWTGEDEVEIVLVTPNDYMLYTPLLPDVAGGLIDPRFVVISLADSLPRVRLVVATAESVDLANKTITVTSPHHAPRELSWDRLVLTPGSVTRLFDVPGLAEHARGLKTVAEALYLREQLLRQLELADHEDDPEVRRARRTFVVVGASYAGTELVAQLRALADTYADRRGFAREEIRFLLLDTAERVMPEVGERLGDKVLEVLRGRGIDIRLQTTLAELDDDRVVLTDGTVVPTHTVAWVTGVTGAPILATLGLPMERGRLVVDEYLRVPGHPDVFAGGDAAAVPDLTAPGTITPPTAQHASRQGKALARNVAASLGMGNEAPYRHKDMGLVVDLGPGFAVANPLGVRLSGLPAKVVARAYHTYAVPRGVNRWAITLTYLTNAVTPRPLSLLGLVSPEEASFGMSEGIPAHR

SEQ ID NO: 11107 - protein, 1174 aa, Streptococcus pyogenes MGAS10394
MNVILNGGLMKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPRMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADTVKVVVYDKQDQTKVLGQANLTKSDKGVWRAHLTSDSIKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTYPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAKYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLPGAQVLADAEQAGVTAIAKPKGVQFTKEGLTIDGLTALVLKVSSKTANPSQQKSQTGNHQTKTPDGSKDLDKSLMTRPKRAKTNQKLPKTGEASSKGLLAAGVALLLLAISLLMKRQKD

SEQ ID NO: 11108 - protein, 507 aa, Solibacter usitatus Ellin6076
MIAPLTPLDFLARSASTWRDRIAVVDGDRRFTYSGFAARVQGQAAALLALGVQPGDRVAVLAPNGAMALESHFAPMSIGAVLVMLNTRLAAGELAWILNHCGAKVLLVDPQLAPLVADAAVPHIIQDYEAFLSAAPPHYTPVPVTDENACIAINYTSGTTGFPKGVMYTHRGAWVNALGEITEHGLTQRSVYLWTLPMFHCNGWCFPWAVTAAGGRHICIRQPDPCEMVALIQAQGVTHLCGAPVVVSSLAQYCAANQVKFERPLRIVTAGAPPPPAVIRAAEETGAEICHAYGLTETYGPHTICSWNPEWDERPAPERALLKARQGVAYTVAGTDLRVVDFQMHDVPPDGETMGEVLMRGNNVMLGYYANPKATEDAFQGGWFHSGDLAVVHPDGYIELRDRMKDIVISGGENISSIEVEKTLADHPAVAEVAIVAVPDEKWGEVPKAYVGLKPGCSATAEELIAWCRDRMAHFKAPKLVEFGPLPRTATGKIRKNQLRAQAKANS

SEQ ID NO: 11109 - protein, 218 aa, Solanum lycopersicum
MAGYRGDDEYDYLFKLVLIGDSGVGKSNLLSRFTKNEFNLESKSTIGVEFATKSLNIDGKVIKAQIWDTAGQERYRAITIAYYRGAVGALLVYDVTRHVTFENVNRWLKELRDHTDPNIVVMLLGNKSDLRHLVAVSTEEAKSLAEREALYFMETSALEATNVENAFTEALTQIYRIVSKKAVEAGDEGATSTAPPKGQTINIKDEGSAWKKFGCCSS

SEQ ID NO: 11110 - protein, 327 aa, Nostoc sp. PCC 7120
MAETLFFNALREAIDEEMARDSSVFVLGEDVGHYGGSYKVTKDLYKKYGELRILDTPIAENSFTGMAVGAAMTGLRPIIEGMNMGFLLLAFNQISNNAGMLRYTSGGNFKIPLVIRGPGGVGRQLGAEHSQRLETYFQAVPGLKIVTCSTPYNAKGLLKSAIRDDNPVLFFEHVLLYNLKEDLPEKEYYLPLDKAEIVRSGKDVTILTYSRMRHHVTQAVKTLEKQGYDPEVIDLISLKPLDLETIGASIRKTHKVIIVEEAMRTGGIAAELIASINDRFFDELDAPVLRLSSQDIPTPYNGTLERLTIVQPEQIVEAVQKMIALRV

SEQ ID NO: 11111 - protein, 376 aa, Karenia brevis
ITTVGGIFARAAVPSGASTGIYEACEMRDGDKSRYVGKGCMKAVASVNNVLAKELKGMSVKDQKALDKKMCDLDGSPNKSVLGANAILGVSLAAAKAAAQGKGIPLYEHIAELAGNTGPMVLPIPCFNVINGGSHAGNKLAFQEYFIIPVGAETFAEAMRIGCECYHTLKGILKKKFGGDATLIGDEGGFAPPCDAKSGVEFCWEAIKKAGYEGKCKIGMDVAASEFKVEGQDCYDLGTWYPEAEKTPDLKKTAAEFQALYAELCKDFPIITIEDPFDQDDWDGWVGMTGAIGEGTQVVGDDLIVTNVKRVATAIEKKACNALLLKVNQIGSLTEAIDAVKMCKREGWGIMCSHRSGETEDTTIADIAVGLCCGQI

SEQ ID NO: 11112 - protein, 133 aa, Glycine max
  misc_feature (68)..(68): Xaa can be any naturally occurring amino acid
  misc_feature (76)..(76): Xaa can be any naturally occurring amino acid
MAEHTFIMIKPDGAQRGLIGEIISRVEKKGSYLKGSKLVTVDRPFAEKHYARCAARPFFSGSVDYIIXGRVVAMIXDGRNVVTTGRKIIGTTNPAQSEPETIRGDFAIDTGRNVIHGSDAYDSAIKEIALWFP

SEQ ID NO: 11113 - protein, 181 aa, Triticum aestivum
  misc_feature (113)..(113): Xaa can be any naturally occurring amino acid
AYLGDIIEQVCTKKQAGTGPEFPGYRRPTRPKASFAYLGKPEDSIGVDIIFYRSHTEGMPHAHADVVDEIEQMALHKYGGIPHWGKSRDFAFDGAIAKYPKVHEFLRVKDRHXRPEGLFSNEWTDKSLGINGSPNIIKKRCAIEGLCICSTNSHCAPEQGYFCRPGKVYKEARVCSFFKNY

SEQ ID NO: 11114 - protein, 378 aa, Karenia brevis
LTTKAGISVRAAVPSGASTGIHEACELRDGVKTRYLGKGVTKAVESVNTTLNEALKGMSVAEQKALDEKMIELDGTPNKSKLGANAILGVSLAAAKAAAAARGVPLFKHFADLAGNTGPMVLPVPCFNVVNGGSHAGNKLAFQEYFIVPVGAATFKEAMQIGAECYHTLKGIIKKKFGGDATLIGDEGGFAPPCDARGGCELVMEAIEKAGYKDKCQVGMDVAASEFKTEGKDEYDLGTWYPEAEREADPGLKMTGAQLADFYAGLCKDFPLITIEDPFDQDDWEGWKVFTEKVGEPTQVVGDDLTVTNVSRVKKAIDEKACNALLLKVNQIGSVTESIDAVRMCKQSGWGVMCSHRSGETEDTTIADLAVGLCTGQI

SEQ ID NO: 11115 - protein, 1084 aa, Burkholderia thailandensis E264
MPKRTDINSILIIGAGPIIIGQACEFDYSGAQACKALREEGYKVILVNSNPATIMTDPSTADVTYIEPITWEVVERIIAKERPDAILPTMGGQTALNCALDLFHHGVLEKYGVELIGASPEAIDKAEDRQKFKDAMTKIGLGSAKSGIAHSLEEAHKVHGEIMAATGGSGYPVVIRPSFTLGGSGGGIAYNREEFEEICKRGLDLSPTRELLIEESLLGWKEYEMEVVRDRADNCIIVCSIENLDPMGVHTGDSITVAPAQTLTDKEYQILRNASLAVLREIGVDTGGSNVQFSINPKDGRMVVIEMNPRVSRSSALASKATGFPIAKVAAKLAVGYTLDELKNEITGGATPASFEPTIDYVVTKIPRFAFEKFREADSRLTTQMKSVGEVMAIGRTFQESFQKALRGLEVGVDGLDEKTTSRDEIVREIGEPGPDRIWYVGDAFRIGMSREQIFEETAIDPWFLAQIEQIVLKEKALAGRTLASLTKDELHYLKQSGFSDRRLAKLLGATPADVRARRLALNVRPVYKRVDTCAAEFATKTAYMYSTYEDECEAQPTTNKKIMVLGGGPNRIGQGIEFDYCCVHAALAMREDGYETIMVNCNPETVSTDYDTSDRLYFEPLTLEDVLEIVDKEKPVGVIVQYGGQTPLKLALDLEAHGVPIIGTSPDMIDAAEDRERFQKLLQDLGLRQPPNRTARAEDEALALADEIGYPLVVRPSYVLGGRAMEIVHEPRDLERYMREAVKVSNDSPVLLDRFLNDAIECDVDCICDGDAVFIGGVMEHIEQAGVHSGDSACSLPPYSLSKETVAELKRQTGAMAKALNVVGLMNVQFAIQQVPQQDGSKEDVIYVLEVNPRASRTVPYVSKATSLPLAKIAARAMVGQTLAQQGVTKEVEPPYFSVKEAVFPFIKFPTVDPVLGPEMRSTGEVMGVGRTFGEALFKSQLAAGSRLPESGTVLLTVMDADKPKAVEVAKMLHDLGYPLVATRGTAAAIEAAGVPVKVVNKVKDGRPHIVDMIKNGEIALVFTTVDETRAAIADSRSIRMSAQAHKVTYYTTMSGARAAVEGLRYLKDLEVYDLQGLHARLN

SEQ ID NO: 11116 - protein, 472 aa, Candidatus Kuenenia stuttgartiensis
MSNSAFDLAIIGGGPAGYVAAIKAAQSGLKTALIEKEKVGGTCLHKGCIPTKTLLYSAELYRKFANAGEYGITTGSLNVDYPLIHRRKEYVVKRLFQGVQSLLKKNGVDVFSAEGRIISNQEVSIVSDGIETNRIKVKNIILATGSAPFIPKNIPYDKKYVLTSDDILLREEIPKSIIIVGGGAVGIEFACLFNAFGTEVTVLELLEDILPSEDKEINGTVKNLLIRRGVNVLTQTSLEKVEIENGVKLEIKGVNDISGNREFLHADLLLLAAGRVPLLDNIGIEEMSLNFDGQYLRTNEGMETSQRGVYAIGDITGAPLLAHKAINEGILSVTHLTGKDMHIINRKNIPRVVYSFPQVASIGLTQKEAEEMGYKVKIGKFPFAANSMAIIEGESLDGFVKIVSEEKYGEILGVHAIGHHVGEWMWGLSLNSILEGTVQEVSNAIFPHPTLSEALFEAAHSIVDKPICNAVE

SEQ ID NO: 11117 - protein, 442 aa, Solanum tuberosum
MSTSGQQQFRYTQTPSKVLHLRNLPWDCSDEELVELCKPFGKIVNTKCNVGANRNQAFVEFADLNQAINMVSYYASSSEPAQVRGKTVYIQYSNRNEIVNNKSPGDVPGNVLLVTIEGVEAGDVSIDVIHLVFSAFGFVQKIATFEKAAGFQALIQFSDVGTASAAREALDGRSIPKYLLPEHVNHCHLRISYSAHTDLNIKFQSHRSRDYTNPYLPVNPTAMEGVLQPVVGPDGKKKEPESNVLFASLENMQYAVTVDVLNTVFSAFGTVQKIAIFEKNGQTQALIQYPDVTIAAAAKDALEGHCIYDGGYCKLHLSYSRHTDLNVQAYSDKSRDYTVPESSLLAMQQASAVHATPPVWHNPQSGPVQSSAGYATTGTVPGQAPPAWNPNLQGGGSTFPSAPTGYPGHSYAPPAPAYATAVHPPGSSQQTNHISTGSRLLV

SEQ ID NO: 11118 - protein, 480 aa, Chara vulgaris
MATATMAASGAATATATSKLNVRAPRGSSSSSSSGRKSSAIAAQALPCARSSQKGAGLCEYKGLKASTAHVFGGVTGRDAADASDLFVDSVTRDVSSKVIGSGHRGETEAKLRVAINGFGRIGRNFLRCWHGRPDSPLEVIAINDSGGVKQATHLLKYDSMLGTFNADVKTVDETHISVDGKVIQIVSNRDPLKLPWAELGIDIVIEGTGVFVDGPGAGKHIQAGAKKVIITAPAKGSEIPTYAVGVNEGDYHHDVSNIISNASCTTNCLAPFVKVLDEEFGIVKGTMTTTHSYTGDQRLLDASHRDLRRARAAALNIVPTTTGAAKAVALVLPKLKGKLNGIALRVPTPNVSVVDLVVNVENKGCTAEDVNDAFRKAANGPLKGVLAVCDEPLVSVDFRCTDVSSTVDSSLTMVMGDDMVKVVAWYDNEWGYSQRVVDLAHLVAAKWPGAKPAPDGKDADPLGTYCESNPDDAECRVFE

SEQ ID NO: 11119 - protein, 678 aa, Aspergillus nidulans FGSC A4
MGRLITLATCSLNQWALDWEGNCERIIESIRQAKAAGATLRVGPELEITGYGVLDGFLEGDTFLHSWEMLARIIDHPDCQDIVVDVDGNYREMRHFTPWQRPREVEDYYLEQIVGKITGQYKVPFGDAVISTRDTCLGLETCEELFTPNGPHIPYSLAGVEIISNSSGSHHELKKLDTRVNLITQATKLSGGIYLYANQQGCDGDRLYYDGCAMIVINGNIVAQGSQFSLNDVEVVTATVDIEEVRTYRASTSRNMQASRQPPFVRLDLDTRLSRSDEDADPGIAPSETLIPRYHAPEEEIALGPACWLWDYLRRSGAAGFFLPLSGGIDSCATAVIVHSMCREVIKAVQQGNEQVIKDVRRLCAEPAGSTWLPTTSQEVCNFMGTQNSSKETRDRAKELAAEIGSYHIDFNFDTVVTALMNLFTVVTNFQPRFKVHGGSRAENQALQNIQARLRMVLSYLFASLLPTVRQRPGGGGLLVLASSNVDECLRGYLTKYDASSADLNPIGSISKVDLKKFIGHCATSFDMPILTSFLNATPTAELEPITATYVQSDEADMGVTYAELGTFGYLRKVSKLGPWSMYERLLHMWGNEYSPREIYEKTRHFFYNYAINRHKMTVITPSYHAEQYSPDDNRHDLRQFLYPPFTWAYKKMEESVKYWEERGWTTGKAQKKSVKAD

SEQ ID NO: 11120 - protein, 318 aa, Arabidopsis thaliana
MQASETENIKYEESFIKNTRGMKLFTCKWVPAKQEPKALVFICHGYAMECSITMNSTARRLVKAGFAVYGIDYEGHGKSDGLSAYVPNFDHLVDDVSTHYTSICEKEENKGKMRFLLGESMGGAVLLLLHRKKPQFWDGAVLVAPMCKIAEEMKPSPLVISILAKLSGVIPSWKIIPGQDIIETAFKQPEIRKQVRENPYCYKGRPRLKTAYELLRVSTDLEKRLNEVSLPFIVLHGEDDKVTDKAVSRQLYEVASSSDKTFKLYPGMWHGLLYGETPENIETVFADIIGWLDKKVADESGGFESELKRKNDGIPLKG

SEQ ID NO: 11121 - protein, 288 aa, Campylobacter upsaliensis RM3195
METKLAQIYTQNELEILKESFKSAKNVCVFLNFLKTNEAMINELFKDLEFQRLNSFCYLFKAQDKSILSKMKAFNEGHFYIQNYSSYLCARNLGVKPNESILDMCAAPGGKSINLANFMQNKAYLACVEANKERFFTLQKNLKNYGVNAKIFLKDAKSIGRLCPLKFDKILLDAPCSTLAKTGFENVKSPKEIKALALLQKKLLHSALKALKHGGELVYSTCTFLREENEEVLENALKSEFELEFLELDLEGVIAKEAKSEFGELKKARRIMPCENYDGFFIAKMRKI

SEQ ID NO: 11122 - protein, 266 aa, Arabidopsis thaliana
MENPAKRVLMTSNGDEVSRNIAFHLAKHGCKLVMMGNEGSLRSIVDKIRDSIEGAFPADVIALDMESDSEVAFHAAVQKAWELSGHFDAFLNSYTYQGKVQDILQVSQDEFHRITKINLTAPWFLLKAVATRMKDHGSGGSIVFMATIASGERALYPGADAYASTSAAIHQLVRASAMSLGKHKIRVNMISRGLHLDDEYTASVGRDRAQKLVKDAAPLGQWLNPETDLYSTVIYLISDGSRFMTGTTVLVDGAQSLTRPRLKSYM

SEQ ID NO: 11123 - protein, 131 aa, Glycine max
MAMNRARYIRHILTTKEVVGVACQRTFATGKAKKGSKGGAAADAPKASTLSKEVKSSTVVGANILKEGTDPKIQPDSEYPDWLWHLLDKRPALSELRRRNIDTLSYEDLKRFVKLDTRARIKENNSVKAKN

SEQ ID NO: 11124 - protein, 484 aa, Prochlorococcus marinus str. MIT 9301
MTADKLDKIKFGTDGWRGIIGFDFNLSNLSRVVVAACQELHYQYYKEVNSKKIIIGYDRRFMAFEFAKQIVPFIRGCGFEPILSDSFVTTPSCSFYAKEVGCLGALVITASHNPYNWLGLKIKSFNGCSVDEFFTSEVEKRLMLGNSIETIDGVNQLVDIKKFHLDRIKSLFDIDYISKRLKKMKLRIFVDAMHGSAANCMAEIFASNDLEVISEIRKDADPFFGGKPPEPLLNYADDLKQILMKNSTNAVKTLGIIFDGDGDRIAAIDEKGRYSSTQDLLPYFISYLGEIKNNSYPVLKTVSGSDIIKNISESQNRDVIELPVGFKYIAEKMIKEKIFIGGEESGGVGFGEFMPERDALYAAMVLLNGIAEKSQYLYETLDEIQEDFGPSFYKRIDIKFPNQSDKNNVKEFIIDNIPENINNHKLKSISKIDGIKLRIDKNFWLLFRFSGTEPLLRLYCEAPKESYLIEVLEWGQEFINMAIK

SEQ ID NO: 11125 - protein, 1119 aa, Nostoc sp. PCC 7120
MTQDELLVLIEQAATEGWRELDLSGQELTELPGEIGKLQQLESLILGKQVGGYEKVGYRIFQKALGNNLKTLPIELLSLPNLRKLDISGNPLEGIPDVVMQILHLEELILIRVQLTEIPEALAKLTNLTQLILSDNQITEIPEALAKLTNLTQLNLSYNQITEIPEALAKLTNLTQLNLSYNQITEIPEALAKLTNLTQLNLRGNQRTEIPEALAKLTNLTRLNLSYNQRTEIPEALAKLTNLTQLILSDNQIKEIPETIAKLTNLTHLILSGNQIKEIPETIAKLTNLTQLGLDGNQIKEIPEAIAKLTNLTQLGLDGNQIKEIPEAITKLTNLTHLILSGNQIKEIPETIAKLTNLTQLALSSNQITEIPEVLAQLTNLTQLFLSSNQITQIPEALAPLTNLTTLHLRVNQITQIPEAIESLPKLELLDLRGNPLPISPEILGSVYQVGSVEEIFNYLRLLRSGEVRPLNEAKLLLVGQGSVGKTSLIERLIHNKYDRNQPQTDGLKVETWNVQVNSKDIRLNVWDFGGQEIYHATHQFFLTKRSLYLLVCNCRTSEEENRIEYWLKLIESFGGQSPVIIVGNKKDEQPLDINRKALREKYPNIQAIIETSCQDNIGIDELRTAILQQVGNLKEVYDLLPLSWFEVKQQLESMSQDFITYSSYIGICYENKIPEEHNQEQLIDLLHRLGLVLNFREHPILRDTNVLKPNWVTEGIYALLSDENLKTKSKGIFTPADLTRVLNPERYPTKRHGYLIELMKEFELGFELACYPPQFLIAGLLPKDQPDATELEGETLEFQYHYKVLPESIISRFIVNTHERIHNQIYWRSGVMLQYQQHNEIYNIARIKADPEDKKIFIAISGRKETRRSFLAILRDVFQKIHKSLANLEITEWVPVPGYPNHPPLDYQELLGLETMGILEYPIGKLKININIRQLLDGYESLESRRKLQKGDHDLDDRTAYEDILDIAKLAVSRPIITKAEAKAVSENPQFTNNLQGANIANFANEVKDNASQQASNFNQTSGANIAEIMQLINNLRQTVAQFPPEIRDDIIIDIDDVEVEIQKPEKERNTPKLKKRLAALLTAASVAAAPIASVVDFTNNVMELGSKLGIELIQPSP

SEQ ID NO: 11126 - protein, 221 aa, Capsicum annuum
MGVCYGMMGNNLPSHSEVIQLYKSRNIGRLRLYDPNHGALNALRGSNIEVILGLPNVDVKHISSGMEHARWWVQKNVKDFWPDVKIKYIAVGNEISPVTGTSSLTSFQVPALVNIYKAIGEAGLGNDIKVSTSVDMTLIGNSYPPSQGSFRNDVRWFTDPIVGFLRDTRAPLLVNIYPYFSYSGNPGQISLPYALFTAPNVVVQDGSRQYRNLFDAMLDSV

SEQ ID NO: 11127 - protein, 201 aa, Prochlorococcus marinus str. MIT 9301
MSSLRQSEIKRKTNETDISVFINLDGNGISEIDTGIPFLDHMLHQISSHGLFDLKIRAIGDTHIDDHHTNEDVGIALGKAFSKALGERKGICRFGHFFAPLDEALVQVTLDCSGRPHLSYDLQLKAPRIGNYDTELVKEFFIAFVNNSGITLHINQIRGSNSHHIVEACFKAFSRAMRMATEIDLRRSGSIPSSKGMLENQ

SEQ ID NO: 11128 - protein, 470 aa, Sulfolobus solfataricus P2
MMSLEVIEVRSPSNLKVIGTVKRMSKDEVRGEIEEAYKGFEIISRMPLYKRTAILRKISEILEREQERLARLLAMEAGKPISDSRVEVLRASRLFRQAAEEVGIVLEGKNYRVDAYEYPPGNENRIVLSTREPIGVVTAILPFNFPINSFAHKVAPALAVGNSVVVKPSINTPLAAVEMKKILVEAGLPDSAVRVVTGYSSEIGDEIITHPLVGLITLTGSTQTGLKIASKAISLGKRIIMELGGSDPIIILEDANIERASSIAVRARFEYAGQNCNAGKRIIVRQEVYDKFVKAFNEKAKALKVGEPLDETTDVGPVINKESVENLNSVLEDAKVKGGRVEILNRGPESGSFFPLTMVTNPSLDMLVLKSEVFGPIVPIVSVKSDEEAIRIANSTEYGLQSAIFTNDVNRALKLSRELKFGAVIINDSTRLRWDSLPFGGFKKTGIGREGVRETMLEMTENKLIAITLL

SEQ ID NO: 11129 - protein, 481 aa, Burkholderia vietnamiensis G4
MANVTYTDTQLLIDGEWVDAASGKTIDVVNPATGKAIGKVAHAGIADLDRALAAAQRGFEAWRKVPAHERAATMRKAAALVRERADAIAQLMTQEQGKPLTEARIEVLSAADIIEWFADEGRRVYGRIVPPRNLGAQQMVVKEPVGPVAAFTPWNFPVNQVVRKLCAALATGCSFLVKAPEETPASPAALLRAFVDAGVPAGVVGLVYGDPAEISSYLIPHPVIRKVTFTGSTPVGKQLAALAGQHMKRATMELGGHAPVIVAEDADVALAVKAAGGAKFRNAGQVCISPTRFLVHNSIRDEFTRALVAHAQGLKIGNGLDEGTTLGALANPRRLTAMASVVENARKVGASIETGGERIGSEGNFFAPTVIANVPLEADVFNNEPFGPVAAIRGFDKLEDAISEANRLPFGLAGYAFTRSFANVHLLTQRLEVGMLWINQPATPWPEMPFGGVKDSGYGSEGGPEALEPYLVTKSVTVMAV

SEQ ID NO: 11130 - protein, 344 aa, Haloarcula marismortui ATCC 43049
MRASTLTDVGEITVEDRDRPDPADDEVLVQVGACSVCMTDYHMYHGTFAAETPLVLGHEGAGTVAEVGADVDRFAVGDRVAINPTVPCNACSYCKKGETHLCENNTSIGGAGDTILDGAFAEYVRVPAINVEDIGEMSFERAALAEPLACCVHGVEQADIKPGDSVGIIGAGPIGLLLLQAFRNAGAAPIVVSELDDERRELAADLGADAVIDPNEEDPEEAIPAAAGGPVNVGAEAIGLVPTIKQANAVTAPGGSTLIFGVPDQEATMEVSPFDVFFDEVDYRGSFSLTTEDFERAITLLRHERIDAETLITERIGLDDLPAAFERMGNAEGLKKVVVPGDSE

SEQ ID NO: 11131 - protein, 463 aa, Debaryomyces hansenii CBS767
MSVDKYKIHQCIGKGNFGDVYKATDISNNTLVAVKVINLDESDEDIAVLIQEIQFLSKLRSPYITKYFETFINDMSMWIVMEYCGGGSCADLLKCYRKLNEETTAFIIRDVLRGLTYLHEENKVHRDIKLANILLTSYGEIKLADFGVSGEITMTQLKRNTFVGTPFWMAPEVITRLKTGYNEKADIWSTGITTIELVTGSPPLSQYDPMKILFEIPKKRPPLLTGVDFSENIKDFVRYCLIKDPKKRPSSSTLLHHKFLKNIKRNVNLFKLLEEKNKWSEKHHRNGKKPKYPLRVDYGDLPEYDPLIKWDFNTKKSYHTKSSPMEQTLLINNESPLLNMISLPPHSQCYELAMPTKLSSPLSPLQITYSSQVSPGSPQKPQESPDRKLENTSHPVPIKFLDDVVLYSLQRLHVRAKAPSTKVTIDKLMQNFIDYESLRPGLSEAFVEEILMLHIANSNSHPY

SEQ ID NO: 11132 - protein, 302 aa, Synechococcus sp. WH 8102
MAWEQQCRSSGLFETTLDLWPASASPDWLWCLGLPLLTEAARDQTQRHLIGLSALPGCGKTTLGHWLERAAQQLGLPLQVVSIDDFYFDAERLDQAMRGNPWGVPRALPGSHDLPLLCQTLSRWKRGEHVDLPQFDKSLRQGRGDRCGWRSCSAQILVLEGWFVGCQPLLPGESIEHGCEHLSPPIRPDELASREAVQEVLGTYRPIWALLDRLWQIKAQDIRSPQIWKQQQEDQMLREQGVALDNKSLLGFIRMILTAIPPQSFDRIDADVRVDVDPERRLRQLRIRRQSQDSSSSASRTG

SEQ ID NO: 11133 - protein, 268 aa, Haloarcula marismortui ATCC 43049
MLEATRAPSVRMSVLDSFSLDGETAIVTGAAQGLGKQMATGLTDMGADVAIADVNVEKAERTASELDGETDVIATEVDVTDEGSVEAMVEDVTDRLGPIDVLVNNAGIVENSPAEETSVESWRRVVSVNLDGVFLCAKHVGQQMLNRGEGRIVNISSMSGFDVNVPQKQASYNTTKAGVRMLTQSLAVEWGDQGVRVNAIAPGYMRTELVDEVLEENPEMEETWLENTPMGRLGRPEELKELVVYLASDASSYMTGSTVVMDGGYTSR

SEQ ID NO: 11134 - protein, 204 aa, Geobacter metallireducens GS-15
MKVSSAEFVTSGTRPAHYPPPELPEVAFAGRSNVGKSSLINVLVNRKGLVRTSSTPGRTQLINFFRVNGSLMLVDLPGYGFAKVPLAVKKEWGPMVETYLSTRPNLSCVVLIVDIRREPTEEDQLMLQWLRAYNVAVLVVVTKCDKVSKNERAKQAAIITRTLGLARDEMAFFSALSKEGRDEVWARIEVMLAAGQEEAEESGE

SEQ ID NO: 11135 - protein, 457 aa, Marchantia polymorpha
MASITVGASAVSSKLTLQAQATSAARSSNVAAQAASFKRSSLGEFSGLKASSAVTFGKSSSENGFFDAVASQVAVKAGASGAIKGETSAKLRVAINGFGRIGRNFLRCWHGRGDESPLEVVAVNDSGGVKNAAHLLKYDSMLGIFKADVKVGDDTTLLVDGKPITVVSNRDPLKLPWAELGIDIVIEGTGVFVDGPGAGKHIQAGAKKVIITAPAKGADIPTYVMGVNEGDYSHEVANIISNASCTTNCLAPFVKVLDEKFGIVKGTMTTTHSYTGDQRLLDASHRDLRRARAAALNIVPTSTGAAKAVSLVLPQLKGKLNGIALRVPTPNVSVVDLVINTEKKGLTAEDVNNAFREAANGPLKGILAVCDIPLVSIDFRCSDVSSTVDSSLTMVMGDDMVKVVAWYDNEWGYSQRVVDLAHLVAAQWPGVAKPSGDPLEEFCVTNPDTDECRLHDV

SEQ ID NO: 11136 - protein, 343 aa, Haloarcula marismortui ATCC 43049
MRTAVLVEPTEFELEDRPRPSPGPDEVLVAVRDVGICGSDVHYYEHGRIGDYVVEDPLVLGHESAGKVVEVGENVTDHEPGDRVALEPGVPCRRCAHCKRGDYHLCESVRFMATPPHDGAFTEYVSWPADFAYTLPESVSTAEGALCEPLSVGIHACRRGSVGTGDTVLITGAGPIGLMVLEAARAAGATDIILTDVVKEKLEFAEKRGADLTVDVTETDLDTAVAEYTDGVGADVVVEASGAEPSIKSTIDVVRRGGTVVLVGLASEAEVPFDVLELIDNEVDVHGSFRYKNTYDAAVDLLADGEVDVEGIIDFESELEDIDDAFRRSMEPTVVKGMISLDS

SEQ ID NO: 11137 - protein, 605 aa, Yarrowia lipolytica CLIB122
MPWKTLLSLVYMSRACQVHGKQHVCTMTEEKTHSLSPNDSVSSGIGEIKTTSKWRNFVDSFKEADLHDVDTEGMTELEISQLKAANSPLQRSLKDRHVKMIAIGGSIGTGLFVGSGGALAQGGPAALLIAYTLVGSLLFCTINSLGELAVAFPVSGAFATFSSNFIDPAWGFAMGWNYTLNWFITFPLELVAASITVDLWREFNNSNISPAAWVAIFYVAIVSINFFGAKGYGEAEFIFSIIKVVAVVGFILFSLILVCGGVPGNGYIGGKHFHDPGAFANSFKGVAATFINAAFAFGGTELVGLAAAETENPRRAIPSATKQVFWRCFIFYFLSLLFIGLIVPYNSPELLAQGSVLGSASPFVIAIKNAGVKGLPSVMNVVIMVAVLSVGNSAIYGCSRTVAALAAQGMAPKIFGYIDRTGRPLVGIIACSIFGLLAFVCAAPKEVENEVFFWLLSVAGLSGTFTWGSVNLCHIRWRLAIKKQGRELKREVTFKSRVGIWGSIYSFVFCIVILAFQFWVALFPVGGADPTPRVFFQAYLCVPVILVFYFVYKIWKRTKIWKLADINLDVGRREFDYDALQRQLEAEKIEMATRPWYVRWGNYWC

SEQ ID NO: 11138 - protein, 534 aa, Gibberella zeae PH-1
MASLLDCGAGLASANASFSTATDLSQENGLFSSWFERCSKTQIAVTIFAVLIAYDQFMYIWRKGSIAGPAFKIPFMGPFIQALYPKFDAYLAQWASGPLSCVSVFHKFVVLASDRDIAHKVFKSPTFVKPCIVPMAETLLRPSAWVFLQGRAHTEYRRGLNGLFTNKAISTYLPAQEKVYDDYFERFVAASEANKSKPMAFMRLFREINCALSCRTFFGDYISQDAVEKIAEDFYQVTAALELVNVPLSVYIPFTKCWRGKRTADAVLAEFASCAAACKANMAAGAEPKCIVDQWVLHMMESKRYNDRIAAGETGAEKPKNLIREFTDEEIGQTMFTFLFASQDASSSATTWLFQILAQRPDVLDRLREENLSVRGGNKETPFELSMLESLPYTNAVIKELLRYRPPVIFVPYEATKKFPVTPNYTISKGSMIVPSCYPALHDPQVYPDPETFDPERWITGDAESKTKNWLVFGAGAHDCLARKYVPLTMAAMIGKASLELDWVHHATSQSEEIRVFATLFPEDECQLVFTRQG

SEQ ID NO: 11139 - protein, 352 aa, Candidatus Kuenenia stuttgartiensis
MKAFAMLGIGSVGWIEKEKPVAGPYDAIVKPIAFAPCTSDIHTIEGAIGDRKNLVLGHESVGEVVEVGSEVKYIKPGDRVVVPAITPDWRSVELQDTGLGQHSGGMLAGWKFSNIKDGVFSEYFHVNDGDMNLAVLPDGITLEAAVMLTDMVTTGFHGVELANVEYGDTVVVLGIGPVGLMSVAGAQLMGAGRIVGVGSRPALIEAAKFYGATDIVNYRERSVVDRVLEMTNNRGADKVIVAGGNCDILIDAVKILKAGGAIGNINYFGGDEFIPIPREAWGVGMGHKAINGGLTPGGRVRMERLIELVKYSRLDPGKLVTHVFYGFDKIEEALQLMKEKPADLIKPVVLID

SEQ ID NO: 11140 - protein, 373 aa, Yarrowia lipolytica CLIB122
MTKLSPLKADRLEITLNKSPKQFDSPKDLAPNSSTDYILQVDYTDEAGWDAPKIGPFGPLQIDPTASVLHYAVECFEGLKLYKNKAGNKLILFRPELNMARLNDSCERIGLPRFDEAELLKCLIEYVKLEGRFVAPGGFIYLRPTAIGTNGGLGLKAPTAAKVFVCATMMQAWNAEPLKLYCSDPKDAVRAWPGGFGYAKLGANYGPTLQENSKAVGAGYHQVLWLYDEDKKTVTEAGGSNFFVAIKKKDSDEIELMTCPISTKLILPGISRRSALEYLGEKHKGSNVTVHEREFGIDEIAEAAKENRLVEAFAIGTAFFVAPVQLIRTPEGELINVPLSQGDSGDFAADVKAKLTSIMYGEEENDWATTVDC

SEQ ID NO: 11141 - protein, 194 aa, Arabidopsis thaliana
  misc_feature (86)..(86): Xaa can be any naturally occurring amino acid
MSSNKIVLTSSDGESFQVEEVVARKLQIVKHLLEDDCVINEIPLQNVTGNILSIVLEYCKKHVDDVVDDDASEEPKKKKPDDVAGXVPESTEEGDDASEEAKQNLDAWDAEFMKNIDMETIFKLILAANYLNVEGLLGLTCQTVADYIKDKTPEEVRELFNIENDFTHEEEEEAIRKENAWAFEADTKHEDPKP

SEQ ID NO: 11142 - protein, 315 aa, Klebsormidium flaccidum
EFGINGFGRIGRNFLRCWNGRENSPLEVVVINDTGGVKQASHLLKYDSILGTFDADVKVVGDDAISVDGKVIKVVSNRDPTKLPWGEMNIDLVIEGTGVFVDEAGAGKHLEAGAKKVLITAPGKGNIPTYVIGVNEEKYKHSEKIISNASCTTNCLAPFVKVLDQKFGVVKGCMTTTHSYTGDQRLLDASHRDLRRARAAALSIVPTSTGAAKAVALVLPQLKGKLNGIALRVPTPNVSVVDLVIQTEKKTFAEEVNNAFREAANNELKGILDVNDEPLVSIDFRCSDVSSTVDSSLTMVLGDDMVKVVAWYDNE

SEQ ID NO: 11143 - protein, 693 aa, Wolbachia endosymbiont of Drosophila ananassae
MGSEIKCTQELGLNDYSVFTRKSYTDVSYLVCAQKLLSKPNSFYPCFGTHNVYTFASIMELADKNHPGFEFQRLHGMAKDLYDYAMSELATNVSCRVYAPVGEHSDLLPYLIRRLLENGANSSFVNQISNPNVKIDELISDPLEKAINFNYEPHPGIPLPQDILGPERKNSLGMDISDSVIVSQFADDIKGFSEKKWQVGPIIDGKALFDNAEFIEVVNPAHLENVIGEVSSATSDQALNALEIAHSAFAKWQNVSAEERAKCLEKAADLLEERMKELIYILIVEAGKILSDAIAEVREAIDFLRYYAMIAKNELSDWKKLPGPTGEDNFIFFEGRGVFLCISPWNFPLAIFIGQVSAALAAGNAVLAKPAEQTPIIAYEAVKILHEAGIPKNVLHLIPGDGGYLGKILVPDNRIAGVAFTGSTQTAQIINKMLANRDGPIVPLIAETGGLNAMIVDSSALLEQVTTDVLLSAFRSAGQRCSALRVLFIQEDIAEKQIKMICGAAQELKIGDPIQLSTDIGPIIDKASIDMLTQHTQKMSEDKDSNLLFKVPMDTNSHNGYFFPPYIYEIQKISQLKQEVFGPILHIIRFNKSQLNEVISDINSTGYGLTFSLQSRIQSQIDTISKKISVGNVYINRNQIGAAVGIQPFGGRGLSGTGPKAGGPHYLQRFSTEKVVSVNTTAFGGNTTLMCLD

SEQ ID NO: 11144 - protein, 208 aa, Triticum aestivum
MTLRPNLGNTIGPSLYQKTRLVPVRNSRDIVDPRVRDWSTRTLRDGGRRTQPHPNQQRSIHPPQSEQASDQETITATIIFSASMAAHQQQQPQQAVGFEDYLPVMAERLGEEGLMEELAAGFRLLMDPASGLITFHSLRRNAPLLGLGAMSDDDLRGMLAEGDFDGDGALSQMEFCVLMVRLSPDLMDQPRRWLDDAVAQASHFLFTS

SEQ ID NO: 11145 - protein, 411 aa, Pseudomonas putida
MIKTIVIIGAGLAGATAARSLRAQGYQGKIHMVGEEACVAYDRPSLSKDVLAGKLGDPPFIMDPFWYASADIDLHLGVRVTSIDVVSRQVLFESGHTLAYDRLLLATGVRARRMAIMGCELAGIHTLRDNADSFALRQVLGPGKSLVIVGGGLIGCEVATTARKAGTTVTILEAGDELLLRVLGHKIGAWCRAELELMGVRIELNAQASHFEGKGHVRAVVCADGRRVAADVVLISIGAEPADELARAAGIACERGVLVDATGASSCPEVFAVGDVAAWPLRAGGRRSLETYMNSQMQAETAAAAMLGTPVPAPQVPTSWTEIAGHRMQMIGDFGGPGEIVLRGDVQNGQPLVLFRLLDGRIEAATAINAAKEFSIATRLVVGRVPVSAKQLQDASLNLRELLKTKAQLCT

SEQ ID NO: 11146 - protein, 298 aa, Coprinopsis cinerea okayama7#130
MALITVSGFPSSGKSTRSSQLKAFLDAKLADPDYNGPALTVQIISDDSLNIDRAVYNDSRSEKPARGAIFTAMQREMSPNKILIIDSLNYIKGFRYQMYCAAREAKVRVATLYVVAPPDTCREWNTSRQDGKSYQSETFDNLIQRYEEPSSMVRWDSPLFTVLWEDESVPGEAIWEAITKGNIKPPNSGTLHVAKAPSDALHILEQTTTSMVSSVLAEASNAGGSGGLVTISPSQGIKARVTLPARNVTLSELQRLKRQFVTVHKKAITLGSTERGSVDWGEEQIASKFALYLDEHLN

SEQ ID NO: 11147 - protein, 411 aa, Dioscorea tenuipes
MYNGEKINCTENRSVLHIALRAARDKVIKSDGKNVVPDVWHALDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVTIDGVPLPFETGEIDFGESGTNGQHSFYQLIHQGRVIPCDFIGIMRSQQPIYLKGEVVSNHDELMSNFFAQPDALAYGKVAEQLLNEKVPDHLIPHKTFPGNRPSLESSITFIKCLQRWTVTSNI

SEQ ID NO: 11148 - protein, 341 aa, Shewanella sp. MR-7
MKALSKLKAEKGIWLVDAPKPEMGHNDLLIKIKKTAICGTDMHIYNWDEWSQKTIPVPMVVGHEYVGEVVDIGQEVRGFKIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFHAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 11149 - protein, 352 aa, Burkholderia vietnamiensis G4
MPQSNTANRRIVLNARPVGAPTANDFRVETADVPVPGAGQVLLRTIWLSLDPYMRGRMSDAPSYAPPVALGDVMVGGTVSRVVASNLPAYREGDLVVAGSGWQDYALSDGRDLIPLGRDFAHPSYALGVLGMPGFTAYTGLLSIGEPKAGETVVVAAASGAVGSVVGQIAKLKGCRVVGVAGGAEKVAYVKDTLGFDACVDHRDPQFAARLKDACPDGIDVYFENVGGAVFDAVWPLLNDHARVPVCGIIAHYNDAAYDDTAVSAGRDRVPALMGTILRKRIRMQGFIILDHYATGYAPFLKEMSEWVAQGKVKTLEDVVPDLTEAPQALIGLLAGKNFGKVVVRVGPDQLD

SEQ ID NO: 11150 - protein, 567 aa, Dioscorea tokoro
  misc_feature (238)..(238): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 11151 - protein, 230 aa, Solanum lycopersicum var. cerasiforme
ENVYMAKLADRAESDEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTS

SEQ ID NO: 11152 - protein, 820 aa, Ostreococcus tauri
  misc_feature (1)..(1): Xaa can be any naturally occurring amino acid
XVDLPGYGFANAPEALREKWAEFTREYLLKRETLITVMLLIDSTVKPQRLDLECLDWLGAAGIPVTIVFTKVDKRKKIAAGKRANPQETMEEFCREAMDNWDWDELPPMIYTSSETAEGKREVLNHIASLRQFFKKPLKEDFVKSIQGDAGASVADANTSTTTNPRTTGISDTVARPRVPNVSSRAPVSLRPARPHIGACTPTGSERDVTRVAASPSRAKDGDAAPEPEKPSTSSATDDVTTPIRAKVNSRKKPVKTEDERSVVAIEPEGWEKTLETIKRWRADGPPAAVDTMGCEKIADVEDDRVNVDGDRYRRYLTLTSAMLSSQTKDEINHAAMRRLRAHGCTPENILNTDEDALDAMINPVGFHRRKAQYLRATAKILLDEYDGDIPPSVETLCALPGVGPKMAYLVMNVGWGEPTGICVDVHVHRISERLGWVAKDVMGKNGSPRKKTPEDTRAALESWLPKHEWIEINPLLVGFGQLTCTPLRPKCHACPLAKDGSCPSAFKENPASRATTRDPIVSARIVYKSKHKPHRHRRRQRSRYLAPFAPGCGTYATRADVGAATRAVSTPTPPSPPAVDRVAPIAIAPIPPPSRRLPTPPPRSRPRPSASSSSTPPRPRSPSPSLARLSIVALCRWPHTPPPKSMARLFLDQEPLTQYKDRAFEGTIEAYLDALRASATLYVGNLSFYTSETQARALFARCGVVRRIVFGLDRERRTPCGFAFVEYETRAAAERCARYLNGTKLDDREIRVDFDWGYREGREFGRGKSGGQVRDEYRTYYDSGRGGYGKLLRDELEGMKARGEGGAEVAAGEKRARDA

SEQ ID NO: 11153 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDDKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 11154 - protein, 224 aa, Triticum aestivum
PRVRSGVTLRELIAAAAAAGLALPYAPYWWGLTVGGMLGTGAHGSSLWGKGSAVHEYVVGMRIVTPAPAAEGYARVRVLAAADPELDAAKVSLGVLGVISQVTLALQPLFKRSTTFTERDDDDLAEQVTKFGYQHEFADIAWYPGHGRAVYRMDDRLPMNASGDGVLDFIGFRPTSAEVIKVNRLAEEASERVGNGGSGGKCLTARVTQAALSVAGYGLTRKER

SEQ ID NO: 11155 - protein, 143 aa, Ostreococcus tauri
  misc_feature (1)..(1): Xaa can be any naturally occurring amino acid
XRMMIPDGDNMQRIYSGNNGNVDLWAPELKAYVTHLQNGGSDGGKPWSYRYVGALVADFHRTLCYGGIWLYPPDAKAKEGKARLLYEIAPCSMIVEQAGGMSMRGAKADERVLNVVPEHIHQKSPMFIGSSAAVKDLQAFLKK

SEQ ID NO: 11156 - protein, 1570 aa, Debaryomyces hansenii CBS767
MSEVEKVSILGAKTIHVGYGIQDHIVEETITNTASSTYVIITDTNMASTQPFIKLVEKFTKKLNEKRPESRLLRYNVSPGENNKSRETKAAVEDFLLQQGCTRDTIIIAVGGGVIGDMIGFVAATFMRGVRLIQVPTSLLSMVDSSIGGKTAIDTPLGKNFIGAFYQPQYVFVDVSFLETLPTRQFINGMAEVVKTAAIWNEKEFVRLEEFAEKFISVVTQKDIELSTIRDDLVKTVLESIKVKADVVSSDEKEASLRNLLNFGHTIGHAIEAILTPQALHGECVSIGMIKEAELARYLGILSPVAVARLSKCLVSYQLPVSLDDKVFSKRVGNKRHYVVIDTLLEKMLIDKKNDGSKIRCVILEAIGKCYQLKAHQISKEELKFVLTDEVLVHPFDAEQVPSANTIIPPGSKSISNRALVLAALGSGTVRIKNLLHSDDTKHMLDAVSHLKGAEITTENNGETIVLKGNGGKMITCEQELYLGNAGTASRFLTTVASLVGINQSSSNKHVILTGNARMQERPIGPLVDALRSNGSSIDYMNKEGSLPLKIEAGNGIKGGRVELAATISSQYVSSILMCAPYAQEPVTLSLVGGKPISQLYIDMTISMMKSFGINVTRSTTEEHTYHIPKGAYVNPSEYVIESDASSATYPLAFAAMTGTSCTVPNIGSSSLQGDARFAVDVLKPMGCKVDQTATSTTVTGPPKGQLKPLPHVDMEPMTDAFLTASVVAAIANDPYQSTSITGIANQRVKECNRIEAMITELAKFGVKADELPDGIRINGIDYHNLTTPSIKARGIKAYDDHRVAMSFSLLAGMCVNPVLIQERSCTGKTWPGWWDILHTKFKTTLDGYELPVNTDDPSLLIDKHANGDRSIIVIGMRAAGKSTLSKWMASFMGFKFLDLDEVLEEKYGVKIRPFIKENGWDEFRRLEAIVAKECFETHKKGYVLSTGGGIVEGKEARESLKEYVKSGGIVLHLHRDLDETVVSLSADTTRPAFVNEIKDVWIRREGWYHECSNYHSYSSHCSNELEFKHLRNSFISYLKTITGLHVTEIPKKRSAYVSLTYPDLNEVAESLEEIATGCEAIELRVDLLKDYSKSFVADQTATLRKYVNLPIIYTIKTESQGGKFSDHEVEQIEELSYLGIKLGVEYLDIQLNYPNGLIHKIMERKAFTRIIGSYHDKSGLLNWKNVEWDNKYNQAVSLQVDIIKLTGVASCFQDNLDLETFRSSRDLKPLIAINLGESGKLSSVLNKVLTPVTHSLLPPNATSAQLTIDEVNKSFAEIGGFVNKKFWVVGYPIMHSRSPNLHNAAYKKLNLPYVFDRLETDDASEVYEKLMKQENFGGLAVTMPLKLDIMKYLHELSDAAKAIGAVNTVIPLEGKPGKFLGDNTDWVGITNSFTRYGVPSIENSNVNGLVVGGGGTSRAAAFALHEMGCQTIYMMNRTSSKLYDIKNSLPALFNIEILESVDQVDAAKPVSLVVSCVPADKPIDDNLLNMLERMLHQGILIKHGSFTPTLLEATYKPRLTPVMRIAEEKFEWNVIPGVEMLVNQGERQFELHTGFTPPYSVIHHAVVSE

SEQ ID NO: 11157 - protein, 459 aa, Streptomyces coelicolor A3(2)
MSEYPGFPPGFVFGAATASYQIEGAATEDGRGPSIWDTYSRTPGLVVNGDTGDVACDHYHRYPEDVALLRDLGVDSYRFSIAWPRIVPDGSGAVNPKGLDFYSRLVDELLAAGIEPAATLYHWDLPQALEDRGGWRVRETAERFAEYTAVVAEHLSDRVPRWITLNEPWCSSFLGYSIGRHAPGAKEGRGALAAAHHLLVGHGLAVKALRAAGVREVGITLNLDRNLPATDSPADLAAVVRADTQHNLVWTEPILAGRYPATEEETWGELITGEDFRRDGDLELISQPLDFLGVNYYRPIVVADAPHRESDPARRVATDNRYEEVRHPGVRHTAMNWPVVPDSFTDLLVALKRQYGDALPPVHITENGSAEDDAAAADGTVHDTDRVAYLRDHLTALRAAIDAGVDVRGYYVWSLLDNFEWAYGYDKRFGIVRVDYDTQRRTPKDSYRWYREMIAANRG

SEQ ID NO: 11158 - protein, 491 aa, Pseudomonas mendocina
MDTTRPAYQNLELQPLAGQWRAGSSGRPLEVFDPYNDELLLRIALASREDLDAAYRKARDSQREWATTAPAERARVLLEAVKIFDERREEIIDWIIRESGSTRIKAQIEWGAARAITLESASLPNRVHGRIIASNISGKESRVYRAPLGVIGVISPWNFPLHLTARSLAPALALGNAVVVKPASDTPITGGLLLARIFEEAGLPAGVLSVVVGSGAEIGDAFVEHPVPALISFTGSTQVGRNIGRIASGGEHLKHVALELGGNSPFVVLADADVEQAVNAAVVGKFLHQGQICMAINRIIVEQPLLEDFTRRFVERVKALPYGDPSKPGTVVGPVINARQLAGLKEKIATAKAEGATLLLGGEPQGNVMPPHVFGNVTADMEIAREEIFGPLVGIQSARDAEHALELANSSEYGLSSAVFTASLERGVQFARRIHAGMTHVNDIPVNDEPNAPFGGEKNSGLGRFNGDWAIEEFTTDHWITLQHSPRPYPF

SEQ ID NO: 11159 - protein, 435 aa, Geobacter metallireducens GS-15
MKTQIEIAREGTISSQMMAVAAEEHVSPDYVRQMVAEGKIVIPGNHSRKPRAVGIGKGLRTKVNASIGTSSDIIDYGAEVRKALAAQEAGADTLMELSVGGDLDRVRREVIAAVDLPVGNVPLYQAFCEAARKYGDPNKLDPEMLFDLIEKQCEDGMAFMAVHCGINLYTIERLKRQGYRYGGLVSKGGVSMVAWMMANRRENPLYEQFDRVTSILRKYDTVLSLGNGLRAGAIHDSSDRAQIQELLINCELAELGREMGCQMLVEGPGHVPLDEVEGNIQLQKRMSGGAPYYMLGPISTDVAPGFDHITAAIGAAQSSRYGADLICYITPAEHLALPNEEDVRQGVKAAKIAAYIGDMNKYPERGRERDKEMSKARRDLDWKKQFELALFPEDAKAIRASRTPEDEATCTMCGDFCASRGAGKLFAADLRGDKI

SEQ ID NO: 11160 - protein, 541 aa, Oryza sativa (japonica cultivar-group)
MGQCCTGGGKAVAGDEAEPGTSKAAPPSRGTSSKNGSAKQQPCSPAAKAAATEAAAAASSSKKPAGPIGEVLERPMEEVRTTYSIGKELGRGQFGVTHLCTHKATGEKLACKTIAKRKLANKEDVDDVRREVQIMHHLSGQPNIVDLRGAYEDKHNVHLVMELCAGGELFDRIIARGHYTERAAAALLRAIVGIVHTCHSMGVIHRDLKPENFLLLSKGDDAPLKATDFGLSVFFKEGEVFRDIVGSAYYIAPEVLKRKYGPEADIWSIGVMLYIFLAGVPPFWAESENAIFAAILRGQIDLASEPWPKISSGAKDLVRKMLNINPKERLTAFQVLNHPWIKEDGDAPDVPLDNVVLNRLKQFRAMNQFKKAALRIIAGCLSEEEIKGLKEMFKNIDKDNSGTITLEELKNGLAKQGTKFSDNEIEQLMEAADADGNGIIDYEEFVTATVHMNKMDREEHLYTAFQYFDKDNSGYITKEELEQALKEQGLYDANEIKDVITDADSNNDGRIDYSEFVAMMRKGSGCAEATNPKKKRRDLVL

SEQ ID NO: 11161 - protein, 143 aa, Debaryomyces hansenii CBS767
MLLKSLFLLFLTAIAFASELQIGILTSVPDDKCKVKSKPGDLISVHYEGKLEDGTVFDSSYSRGQPISFQLGIGQVIQGWDQGLTRMCIGEKRKLTIPSHLAYGDRGVGPIPAKATLGMFYFTPNFIYLIFNIRVLTEFSFCC

SEQ ID NO: 11162 - protein, 459 aa, Haloarcula marismortui ATCC 43049
MSTATIRNVLRGDGDRFVYIVSALAALNGLLFGFDTGIISGAFLFIQDSFVMSPLVEGIIVSGAMAGAAAGAAVGGQLADRLGRRRLILIAAIVFFVGSFTMAVAPTVPVLVAGRLIDGVAIGFASIVGPLYISEIAPPEIRGGLTSLNQLMVTTGILLSYFVNYAFADAGAWRWMLGAGMVPAVVLAIGILKMPESPRWLFEHGRTDEARAVLKRTRSGGVEQELDEIQETVETQSETGIWDLLAPWLRPALVVGLGLAVFQQITGINAVIYYAPTILESTGLGNVASILATVGIGTINVVMTVVAIMLVDRVGRRRLLLVGVGGMVATLAVLGTVFYLPGLEGGLGIIATISLMLFVSFFAIGLGPVFWLLISEIYPLSVRGSAMGLVTVANWGANLLVSLTFPVLTDGVGTSATFWLFGLCSLAGLVFVYRYVPETKGRTLEAIEDDLRQNISLAD

SEQ ID NO: 11163 - protein, 211 aa, Bacillus licheniformis ATCC 14580
MSQFVYFVSCGNVVAAVRMNGRDEGGFFMKKAYVFLIDGFEEIEAIATIDVLRRAEVETVTVSLDPSRSVKGGHDIVVEADVMFDDADWQEADMLILPGGNVGSKKMLEHQALHKMLTEAANAGKYVAAICAATMTLGKTGLVSGKKATCYPGVEEHLTGADVTAHENVVVDGNIITSRGPATTIPFALKLAELLNGKEKAGAVAKGMLVC

SEQ ID NO: 11164 - protein, 376 aa, Karenia mikimotoi
LTTKGGILARAAVPSGASTGIHEACELRDGDKIRYVGKGVLKAVAAVNEKLAKELVGMDVREQATLDKKMCEIDGTKNKSNLGANAILGVSMAAAKAAAAGKGVPLYRHIAELAGNDKEMTLPVPCFNVINGGSHAGNKLAFQEYFIIPVGAENFREAMRIGCECYHTLKGIIKKKFGGDATLIGDEGGFAPPCDERQGVELIKEAIDKAGYADKCAIGMDVAASEFKTEGKDEYDLGTFYSEAEKSESLKMTGAQLGEFYASLCKDYNIITIEDPFDQDDWDAWVGMTANLGVPTQIVGDDLTVTNVERVKTAIEKKACNALLLKVNQIGSITESIDAVKLCKQKGWGVMCSHRSGETEDTTIADIAVGLCTGQI

SEQ ID NO: 11165 - protein, 514 aa, Synechococcus sp. WH 8102
MPYTLTTPLYYVNDRPHLGSTYTTLACDALARFQRLNGKAVVFITGVDEHGQKIQRTAEARQLSPQQHCDAISGSYRDLWSRWGISQDRFVRTTDPRHLQLVDQFFARVKGSGDVISGRQTGWYCVGCEEYKDDSAEAVDPSCPIHQKPLEWRDEENLFFRLSHYQSQIEELVARDDFIQPANRRQEVRNFVAQGLRDFSISRVNVSWGLPVPGHEGHTFYVWFDALLGYLTALLDDGGPVALERLEQCGWPASVHVIGKDILRFHAVFWPAMLMSAGLPLPKTVFGHGFLTREGLKMGKSLGNVLDPERLLERCGSDAVRWYLLRDIQFGDDGDFQQQRFVDLVNNDLANTIGNLLNRTSSMARKWFADAVPPHTDAVGPHHPLAVAANTAVTTVLTSMPSLGFKPAAEAVLQLAIAANGHLNDTAPWSRMKQPGKEAEVGDDLYAVLEATRIVGLLLSPLLPELSTRILEQLGTSINPDGWTEKLSWGGLVSGASLPKPSPVMQRLELEESL

SEQ ID NO: 11166 - protein, 324 aa, Bacillus licheniformis ATCC 14580
MEEALTKEKAVWMYQKMLEIRYFEDQVHQLFAKGILPGFVHLYAGEEAVAAGVCAHLNDEDTITSTHRGHGHCIAKGCDLKGMMAEIYGKSAGLCKGKGGSMHIADFDKGMLGANGIVGGGFPLACGAALTAKYKKTKNVSVCFFGDGANNQGTFHEGINLAAIWKLPVIFVAENNGYGEATPFSYASSCESIADRAAAYGIPGVRVDGKDAAAVFQAAGRAIERAKNGEGPTLIECMTYRNYGHFEGDAQRYKTNEEKAVHQEEKDAIAVFKSELLAKGLMSEEEQSRIEKEVEEAVEEAVAFSEKSAYPEETELLTDVYVSY

SEQ ID NO: 11167 - protein, 344 aa, Bacillus licheniformis ATCC 14580
MTREISMSAALNEAIKLAMRRDDHVILMGEDVAGGANVDHLQDDEAWGGVLGVTKGIVQEFGRERVLDTPISEAGYIGAAMAAASTGLRPIAELMFNDFIGTCLDQVLNQGAKFRYMFGGKAEVPITIRTTHGAGFRAAAQHSQSLYALFTSIPGLKVIVPSTPYDAKGLLLAAIEDQDPVIFFEDKTLYNMTGDVPEEYYTLPIGKADIKRKGADVTIVAIGKQVHTALQAAEQLSARGIEAEILDPRSLSPLDEEAVLASVEKTNRLVIVDEANPRCSIAADIASLAADKGFDSLDAPVKKVTAPHTPVPFSPPLEDLYLPTPEKVVNTVLEMLGETSTHTV

SEQ ID NO: 11168 - protein, 377 aa, Bacillus licheniformis ATCC 14580
MAVEVVMPKLGMSMKEGTVSVWNKKVGEAVEKGESIASINSEKIEMEIESPANGTVLDIQVSEGEGVPPGTVICRIGNENEQTQESQTKQPDPTKERIKISPAARKIAQSANIDIKTLKGTGPGGRITKADVLQALPGRPNKQAAKAEAEERPPASPMRKTIAARMTESLQNSAQLTITMKADITKLTVLQKQLNETAQSRYDTKLTITDFAARAAVFSLLDHPAMNSVYQDGRLATFEHVHLGVAAALDEGLAVPVIRHAERLPLIELAKKIKWYAKKAREGRLLHDEIEGSTFTITNLGAYGVEHFTPILNPPETGILGVGQMYSAPVYQDGELTKGAILPLSLTFDHRALDGAPAAAFLSDVKNYLEDPASILL

SEQ ID NO: 11169 - protein, 458 aa, Bacillus licheniformis ATCC 14580
MTLAIIGGGPAGYVAAITAAKNSREVILIEDGSLGGTCLNEGCIPTKALLESADMFEKIKSAGAFGIGLSGESPTVQWEAVQSRKREIIQRLAGGIEYLMNKNKIKVLQGKASFLSEHDILVEKDGKQEVINAGHVIIAAGAAPAALPFASFDGSWIIHSGDAMSLPSIPETIFIIGGGIIGCEFASIYSRLGANVIIAEQAEQILPEEDPDIAAFLRTSLEESGVRVFTSVQVERLDPARQRVFLKNGDDSFNIQADRCLVAVGRKPRTDDLKLDHIGVQYDRKGIHVNQHMQTNIPHIYACGDITGGVQLAHAAFHEGTVAASHASGRDMKVNSDIIPRCIYTSPEIASVGLNEKKARERYRDVRIGEFPFSSNGKALILNETAGKVKIIIEPEYQEIVGVSIVGPGATELIGQAAVMLHAELTADAMEHFIAAHPTLSETIHEALLQAAGRAIHC

SEQ ID NO: 11170 - protein, 445 aa, Marinobacter sp. ELB17
MVAPRNKTNDSSPHHIVIVGGGAGGLELITSLGNTLGKKGKARITLVDASLTHVWKPLLHEVASGSLDANANEINYRAHARKHHYEFQLGRMSGLKCATKTLVVAPFMGEDGEEVVPEREIAYDTLVISVGSTANDFGTPGAQENCLFLDSLLQARRFHNLMLNAFLRKNHEAQQGRQHRLHINIIGAGATGVELAAELRLASRELPVYGMNHLRASDVSISVIEAADRILPALPTRLSSAATRELEHQHVKVLTGQPVSEIKEDSIVMKDGTELPSDMTIWAAGIKAPVFLSKLEGLEVNRDNQLVVLQTLQTTHDTDIFALGDCAACPQPGSERPVPARAQAAHQQADALFKTLCNRLHGKAAVPFVYNDHGSLINFSRYTTVGNLMGNLSGRSMYIEGRVARLFYVSLYRMHQVAVHGFLRTGVIWLMDKISRAMQPRLKLH

SEQ ID NO: 11171 - protein, 626 aa, Campylobacter upsaliensis RM3195
MRYITTPIYYVNDVPHLGHAYTTIIADTLARFYRLSGHKTLFLTGTDEHGQKIEQAAKNKNYSPKEYADKISLEFKKLWDEFEISYDIYARTTDERHIKFVKQVFLKMWEKGDIYKGEYEGYYCVSCESFFTQSQLISQCGCPDCGKETKLLKEESYFFRLSKYEKNILKWYESEPIVPKNKKAELVNFIENGLKDLSITRTSFEWGIKIPSNLNDDKHVIYVWLDALFIYISSLELDEKSENLGFLPAFVHLVGKDILRFHAIYFPAFLMSADLPLPKYIAAHGWWTRDGKKMSKSKGNAIHPKIIADAYGLEVFRYFLLREVPFGNDGDFSETMLINRINAELSNEFGNLLSRIIGMSLKYSNGEILQNEVLNFYKAELKEANLHLQNALEFIENFQFNRYLEELFKALSVANLSISKYEPWNLIKANETSKANALVSLCANILAKVSLLLHPALPKSTQKVAKALSFDITLQNYQKLILNDELLNFKANACETLFPKIEKPLLNSVKEELKKDENPKIKIEDFAKIELKVALVKQCENVKGSEKLLKFILELDNKETRQVLSGIAKFYKPEELIGKQVCLISNLKKAKIFGYESDGMILSAKSGDKLVLISPNELVENGSLIG

SEQ ID NO: 11172 - protein, 103 aa, Glycine max
  misc_feature (13)..(13): Xaa can be any naturally occurring amino acid
MSGRGKGGKGLGXGGAKRHRKVLRDNIQGITKPAIRRLARMGGVKRISGLIYEETRGVLRIFLDNVIRDAVTYTEHARRKTVTAMDVVYALKRQRGTLYGFGG

SEQ ID NO: 11173 - protein, 973 aa, Marinobacter sp. ELB17
MLNYYDPGTQSYEAGKSILNPDFDFGTPARVSENLVTVSIDGREIAVPEGTSVLRAAALAGINIPKLCASDNLEPFGSCRLCAVEIEGRRGYPASCTTPVSEGMDVTTQTGKLAKLRRNIMELYISDHPLDCLTCPANGDCELQDVAGAVGLREVRYGFDGKNHLDAEIDDSNPYFSFDPSKCIVCSRCVRACEEVQGTFALTIEGRGFDSIVSASQNEPFMDSECVSCGACVQACPTSTLMEKSVIDAGQPEHSVITTCAYCGVGCSFKAEMKGEEVVRMVPYKGGEANHGHSCVKGRFAFGYATHKDRIKEPMIRESINDPWQVVSWDEALAFSAKKLRGIQTEFGRESIGGITSSRCTNEETYLVQKLVRAAFGNNNTDTCARVCHSPTGYGLKTTLGESAGTQTFDSVMKANAIVVIGANPTDAHPVFGSLMRRRLRQGAKLVVIDPRRIDVLKTPHADEGLHLPLRPGTNVAMVNAMAHVVITEGLEDKEFINSRCDTEAYNAWRTFIAEARNSPEAMEEVTGVPAAKVREAARIYAEAENGAIYYGLGVTEHSQGSTMVMGIANLALATGNIGREGGGVNPLRGQNNVQGSCDMGSFPHELPGYQHVSDPEVRERFKAVWGVEIDHEPGLRIPNMFDAAIAGTFKALYVQGEDIAQSDPNTHHVEAALKALDCLIVQDIFLNETAKFAHVLLPGSTFLEKNGTFTNAERRINRVRKVMEPIAGMEDWEVTMALSNALGYPMNYNHPSEIMDEIALLTPSFTGVNYDKLERLGSIQWPCNDEHPDGTPTMHTLDFPIGKGRFAVTEYLATEERASRRFPLLLTTGRILSQYNVGAQTRRTANSDWHEEDLLELHPSDAELRGVKEGDWLGISSRVGHTVLRAKLSTRMLPGVVFTTFHHPGSGANVITTDNSDWATNCPEYKVTAVQVEKVSQPSDWQRNFVDFDKRQQDFAKPAEEHSSDAHASALK

SEQ ID NO: 11174 - protein, 281 aa, Campylobacter upsaliensis RM3195
MQELVKLIQEAVIDISNALKFPDTSYSEEKNSSGDTQLKFDILSDEIITHHLSKSKALKALISEEKEEILKLNENAQFIVAYDPLDGSSLMDVNFAIGSIFAIYKEKVSPKNLKAALYSVYGARLELVCCEGKEVKLYRLNEGGKFDFVKELKMAEKGKINATGGTQKFWDNKHANFIKELFEEGYRLRYSGAMVSDIHQILLKGGGLFSYPATKDAPNGKLRAFFEIFPLAFIIEKAGGATTNGQNASLLELEFNQIHATSPCFFGSEYEINKLLKAYNG

SEQ ID NO: 11175 - protein, 609 aa, Zea mays
MDMALASKASPPPWNATAAEQPIPKRDKAAANDSTYLNPQAHDSVLGIILGGGAGTRLYPLTTASVPRPAVPWGVSHCPPITPPALSRPLPRARFDPPPMATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 11176 - protein, 126 aa, Pyrococcus furiosus DSM 3638
MKEVIFAENAPKPIGPYSQAIKAGNFLFIAGQIPIDPKTGEIVKGDIKAQTRQVLENIKAILEAAGYSLTDVVKVTVYLKDMNDFAKMNEVYAEYFGESKPARAAVEVSRLPKDVLIEIEAIAYKE

SEQ ID NO: 11177 - protein, 161 aa, Aspergillus nidulans FGSC A4
MPLLEPTKLTSHRSFIAIKPDGVQRGLVGPIISRFENRGFKLAAMKLTSPSRSLLEQHYSDLKEKPFFPGLVTYMLSGPIVAMVWEGKDVVKTGRTILGATNPLASAPGTIRGDFAIDVGRNVCHGSDSVESAKKEIGLWFTPEEIQNYKLNAFGWIYEKE

SEQ ID NO: 11178 - protein, 219 aa, Shewanella sp. MR-7
MTESHIDFRRAKFLISAPDIAHLDQYLPGDVGVEIAFAGRSNAGKSSALNALTEQKNLARTSKTPGRTQLINVFELDAQRRLVDLPGYGFAQVPLAMKLKWQQSLGEYLQKRACLSGVVVLMDIRHPLKDLDMQMIEWAVASEIPVLALLTKSDKLAQSAKMKTVNEVRKALVEFGDWVQVEPFSALKGTGKPKVLSILNEWCHPQWLADELENQEDAE

SEQ ID NO: 11179 - protein, 205 aa, Klebsiella aerogenes
MNSYKHPLRVGVGGPVGSGKTALLEALCKAMRDTWQLAVVTNDIYTKEDQRILTEAGALAPERIVGVETGGCPHTAIREDASMNLAAVEALSEKFGNLDLIFVESGGDNLSATFSPELADLTIYVIDVAEGEKIPRKGGPGITKSDFLVINKTDLAPYVGASLEVMASDTQRMRGDRPWTFTNLKQGDGLSTIIAFLEDKGMLGK

SEQ ID NO: 11180 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPRAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 11181 - protein, 221 aa, Triticum aestivum
RHEAEDELKEKHANLNGEVLDNDRMLSPSNDGPIRMNTGNDSAIVEENSSPMQRGMVLPFLPLSLTFDNIRYSVDMPLEMKAQGVVEDRLELLKGVSGSFRPGVLTALMGVSGAGKTTLMDVLAGRKTGGYIQGNISISGYPKKQETFARVSGYCEQNDIHSPQVTVYESLLFSAWLRLPEDVDSNKRRMFIEEVMELVELKPLKDALVGLPGVNGLSTEQ

SEQ ID NO: 11182 - protein, 567 aa, Dioscorea tokoro
  misc_feature (112)..(112): Xaa can be any naturally occurring amino acid
  misc_feature (129)..(129): Xaa can be any naturally occurring amino acid
  misc_feature (238)..(238): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDXKNVVPDVWHVLDKIKEXSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 11183 - protein, 360 aa, Coccidioides immitis RS
MSTTATVPVRALVASSASARLFQQSCLKASLRPSAVAAIGIRSTAGVPFHNYIAPNRPKYFTTTSSNKLREFFPPPKTKHVVETETHFEHPVFTEKEMKDIVVAHRQTRDWSDWAALGTVRMLRWGMDLATGYKHPPAGKEQKKVKPFTMDERKWIIRFIFLETVAAVPGMVGGMLRHLRSLRRMKRDLGWIETLLEEAYNERMHLLSFLKLAEPGWFMRLMVLGAQGVFFNAFFLSYLVSPRTCHRFVGYLEEEAVLTYTHAINDLENGKLPRWKDMNAPDIAVTYWKMPEGHRKILDLLYYVRADEAKHREVNHTLANLDQKYDPNPYAAKYNNPQDPHPTKSASIMKPTGWERKDVL

SEQ ID NO: 11184 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 11185 - protein, 567 aa, Dioscorea tokoro
  misc_feature (503)..(503): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWXINSFDQWGVELGKSLASQVRKQLHLSRTKAEPVEGFNFSTTTLLTRYLEAETGVPSDQSQLPKL

SEQ ID NO: 11186 - protein, 249 aa, Xylella fastidiosa 9a5c
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRASEMVANQGKAK

SEQ ID NO: 11187 - protein, 1428 aa, Shewanella oneidensis MR-1
MIELRIDNKIVSAEPSDNLLHAARKAGIAIPSLCDPTDASRQLDTQAHAEKQDCNLCLVQIENSDASLRCVKACETPAQTGMKVITQSAFLTKQRQAALNAILSDHFADCEAPCQQACPAGVDVQRYLYHIAQGDHTQAVKVIKETLPLPLSIGRVCPAFCETECRRGLIDDPIAIRQLKRHAADLDLADDEHGNSYQPPRLADTGKKIAIIGSGPAGLSAGYYLSNQGHNIEIFEAMPKAGGWLRYGIPEYRLPKAILDKEIELLCRNGLTIHTQMRLGHEIHLNQLITDFDAVCLAIGAQKAVPMHYKGSELAGCYLGVDFLKDHCLDKQLKLGKKVAVIGGGNTAIDCARTAVREGCDVTLIYRRTRAEMPAEAYEVHEAEVEGVKFHFLTNPLENHSDADGRVQSVTFSKMTLGEADASGRRAPVDTGETFTEAFDTVIAAVSQAPDLSFMQDPKGQLSHGELALSRWNTLMGCEQTMSSGVEKLFVMGDARRGPATAVAAIGDGRKAAKAIDKMLQIGLSCDLHAHEFNSVKTIPGSLKQAEVKSAEASSPLYPHTKRQPRLKMPELTALQRLLNYSEVELGFPADAAMQEAARCLECACQANTDCKLRDYATDYGVESKSLATENARYFSVDKSSPFIQFDANRCISCGKCVDVCQQQSGHCAIQFAKDSYQVLPQSISPADERRAPRVGFSASMADSHCVQCGNCVQVCPTGALVDARDKRQGDCTELTTASTICTYCGVGCRLDLKIDPSTNRIRHIEGNKDSVVNQGMLCVKGRFGFDFIHSDKRLTTPLIRKNGKLQPCSWPEAIDYVAKRLTEIKQKDGSNAFASLASAKATNEDNFVLQKFVRSVLGTNNIDHCARLCHSSTVTGLQQSIGSGAMTNDILSIKDSDVIFILGSDTTCAHPIIASKIQQAVNLYGARLIVADPKRVGIAEKAELYVAHRPGTDVMLLNAIMAEIIRNNWQDKDYIAKRTEGIEALYAELAKEDYSLEKAALITGVKAENIARIARTIGTAQKTAVYYAMGITQHTTGHDNVTAISNLQLLCGNIGVSGAGINPLRGQSNVQGACDMGALPNYFTGYQKVTDIHARMRFESHWQTPLSGEIGVTATHMMHDIAKGKINALYVMGENPVLSDPDQAHVLNALSQIEFLVVQDIFLTETAELAHVVLPAAAFVEKRGHFTNTERRVQRLEQALASPGEALPDWQIVQAIANAMGANWDYKDEAAIWAEINALTPQYRGILWERLTAGEDGQIPQGIQWPCPDEKHPGTPIMHQGQFTRGLGLFTPVSYRLPAEMPCNEYPLTLSTGRLLEQFHTGTLTRKTPGLDLLGAPKVMISVYDAEQLGINNGDKIRLTTRRGEIEIDAFVTKRAQAGVLFLPFHFVEAAANKLTINALDPVAYIPEYKVCAVRVEKVTKQMCEPT

SEQ ID NO: 11188 - protein, 478 aa, Burkholderia vietnamiensis G4
MDITYDALHLFIDGEWIGASERETAPVINPATQIQIGRVPLATAADLDRALQAAVPAFDVWRNTVPAERARILKRAAELMRERAEHIATVMTLEEGKPLAESRDEVLRAADYFEWFAEEARRIDGRVVPSNRPGVQQLVKKQAIGPVAAFTPWNFPAITPARKLSAALAAGCSVIIKPGEESPATALALARALDDAGLPKGVLQVVFGVPDQVSTQLIASPVIRKVTFTGSVPIGRLLSARAAEGVKPITLELGGHGPVLVFNDADVEKAAVEGAANRFRGTGQVCISSTRFLIQREVYDEFVGHFVRATSALKVGNGMDAGTQVGPLANPRQLAKMEELIADAVERGATILAGGKRIEGEGYFFEPTVLADVPKDARVMHEEPFGPIAVLMRFDALADGLAEANRLPYGLSAYAFTSSARTAIDVADGLEAGMIGINQYRIVSTELPFGGMKESGHGSEGGTEGIEYYLTHKFISQA

SEQ ID NO: 11189 - protein, 233 aa, Betula pendula
QRGAVSKVFTPAGEGVEGSVWHLAKAYAAVNDSGYHQLISHWLNTHAVIEPFVIATNRQLSVLHPIHKLLHPHFRDTMNINALARQILINAGGVLEKTVFPAKFAMEMSAVVYKNWVFTEQALPDDLLKRGMAVPDSSYPHGLRLLIKDYPYAVDGLEIWSAIKNWVSEYCSFYYPTDDMVQHDSELQSWWMEVRNKGHGDKKDEPWWPKMQTQAELIQACTIIIWAGSALHA

SEQ ID NO: 11190 - protein, 438 aa, Karenia mikimotoi
TFVKLVSWYDNEWGYSNRLVDLACHMACVDGIVPPAAKVVSIKAREIFDSRGNPTVEVDLLTDMHLFRAAVPSGASTGVYEALELRDGDKKRLLGKGVLKAVENVNNLIGPKLVGMDVTKQSEIDKFMVETLDGTQNDWGWSKSTLGANAILAVSMAICRAGAASMQIPLYEYIAYLSGRSTDKFVMPVPCFNVINGGSHAGNRLACQEFMILPVGATSFKDALITGAEVYHTLKSVIKKKYGQDACNVGDEGGFAPSVQDNNEALDVLMDAIKQSGHEAKIKIATDVAASEFWINGKYDLDFKNKDSPPEMKKTGDELADYYMKWFDRYPFVSIEDPFDQDDWGAYSKFMERVGDKMQIVGDDLLVTNPKRVAKALDCCACNALLLKVNQIGSITESIEAANMSMRAGWGVMVSHRSGETEDSFIADLVVGLRTGQI

SEQ ID NO: 11191 - protein, 168 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVIKEVEEVKKEYPDAYVRIIGFDNMRQVHCVRFIAFKPPC

SEQ ID NO: 11192 - protein, 243 aa, Betula pendula
FMLDHHDAYLPFLDRINALDGRKAYATRTIFFLTPLGTLKPIAIELSLPLSGPTSRSKRVITPAVDATTNWMWQLAKAHACSNDAGVHQLVNHWLRTRACLEPFILAAHRHMSAMHPIFKLLDPHMRYTLEINALARQSLLNADGVIESCFTPGRYAMEISATAYKSYWRFDMENLPADLIRRGMAVPDPTEPHGLKLLIEDYPYATDGLLIWSAIDNWVRTYVNHFYPNSSLICNDRELQAW

SEQ ID NO: 11193 - protein, 156 aa, Triticum aestivum
  misc_feature (66)..(66): Xaa can be any naturally occurring amino acid
RENAPDVKAKFIIEAANHPTDPEADEVRVLYHQTTYDKFSSLRNIKSTTIVQFCFLNVSLLLYVLXILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 11194 - protein, 792 aa, Heterocapsa triquetra
MAVKMGINGFGRIGRLVFRAGMENQSVTVAAVNDPFMDLEYMKYLLKYDSVHKQFVGNVETKKEGDAEYLVVDGLPIRVFHEKDPGAIGWGAVGAAYVCESTGVFTTQEKAALHLKGGCKKVIISAPPKDDVKMFVMGVNHLDYSKDLTVVSNASCTTNCLAPLAKVINDKFGIVEGLMTTVHAMTATQLTVDGPSRGGKDWRGGRCASQNIIPSSTGAAKAVAKVVPALNGKLTGMAFRVPTPDVSVVDLTCRLEKGATMDEICTAIKDAAALDKAKGGMKDVLGFVDEEVVSTDFATCPLSSIFDKCAGIALTEKFVKLVSWYDNEWGYSNRLVDLACHMAVVDGVVPPPAKIVSIKAREIFDSRGNPTVEVDLVTDAHLFRAAVPSGASTGIYEALELRDGDKTRLLGKGVLKAVSNVNELIAPKLIGMDVTKQKEIDKLMVETLDGAQNDWGWSKANLGANAILAVSMAVCRAGAASMQMPLYEYIANLAGKPTDKYVLPVPSFNVINGGSHAGNRLACQEFMILPVGATSFKEALIMGCEVYHTLKDVIKKKYGQDACNVGDEGGFAPSVQDNNEALDVLMTALEKSGHAGKVKIGTDVAASFYKEGKYDLDFKNPDSDKSAWKTGAEMAKYYMEWFDKYPFVSIEDPFDQDDWEAYSGFQAMVGDKMQIVGDDLLVTNSKRINKALDVKACNALLLKVNQIGSITEAIDAACLSMRNGWGVMVSHRSGETEDSFIADLVVGLRTGEIKTGAPCRSERLSKYNQLLRIEEELGAKAVYAGENFRCPK

SEQ ID NO: 11195 - protein, 532 aa, Frankia sp. EAN1pec
MGRSRSPRLVSVSQPRRGHRHLRLEERFVTIAAASTATPQVIVIGAGFGGMSVALELKACGIDTFTVLERAPEVGGVWQANDYPGAACDVPSVIYQFSSHLKANWSRRFGSQAEIRDYVRQVSIESGVRPHIRFGTEVVSASFGESTNRWTVELADGEQLSADVLVAATGQLSRPRTPQIEGRDTFTGAQFHSAEWDHSVDLRGRRVTVVGGGASTIQVVPAIVDTAAHTTLIQRSPSWVVGKYDWSPGPLERSLSRVPGFLRLYHGAMWQWFEAKYPFVLRRYDAGRTLYEAFWRRRIRAALKDEQKIAACLPDYRIGCARILLSKAWYPTLAREDVSVFRDGVTVMTEDGVLTSDGRHIPTDVVIWCTGFTATEYLAPIRVTGRGGLDLHTVWKDGPEAYLGLAVPGFPNFFMSYGPNTGSLTNTITSMLEYQASYIRQAIEHIGRSRLAYSVRQDVHDSFNAELGRRLPQTVFSTGCPGWYATPSGKITTVWVGSHREYRRRTRFFDPTVYDEAVPAPTWSTPDVSLTQ

SEQ ID NO: 11196 - protein, 329 aa, Arabidopsis thaliana
MTSSNGDNKGLVVSFGEMLIDFVPTESGVSLSESSGFLKAPGGAPANVAIAVSRLGGRAAFVGKLGDDEFGHMLAGILRKNDVDDQGINFDKGARTALAFVTLRSDGEREFMFYRNPSADMLLRPDELNLELIRSAKVFHYGSISLITEPCRSAHMKAMEVAKEAGALLSYDPNLREPLWPSPEEARKQIMSIWDKADIIKVSDVELEFLTGNKTIDDETAMSLWHPNLKLLLVTLGENGCRYYTKDFHGSVETFHVDAVDTTGAGDSFVGALLNQIVDDQSVLEEEERLRKVLRFANACGAITTTKKGAIPALPTDCEALSFLKIQVE

SEQ ID NO: 11197 - protein, 1084 aa, Oryza sativa (japonica cultivar-group)
MRRRPPPPPPPLLPMATLNTQTLITLFLLLLLAAAAAAADAGGGGEREALLRFKAGVASDPGGLLRGWTTAASPDHCAWPGVSCGGNGEVVALNVSSSPGRRLAGALSPAVAALRGLRVLALPSHALSGQLPAAIWSLRRLLVLDLSGNRLQGEIPPALACAGLQTLDLSYNQLNGSVPASLGALPGLRRLSLASNRLGGAIPDELGGAGCRSLQYLDLSGNLLVGGIPRSLGNCSKLEALLLSSNLLDDVIPPEIGRLRNLRALDVSRNSLSGSVPAELGGCVELSVLVLSNPYTPIGGSNSSDYGDVDDFNYFQGGIPDAVVALPKLRVLWAPRATLEGELPRNWSACQSLEMINLGENLFSGGIPNGLVECSHLKFLNLSSNKLTGAIDPSLTVPCMDVFDVSGNRFSGAMPVFEQKGCPSSQLPFDDLVSEYSSFFSYQALAGFRSSSFVLGTDLTSYHSFAQNNFTGPVKSLPLAADKLGMQGSYAFLADGNNIAGQLQPDLFSKCNSSRGFIVDVSNNLITGGIPVEIGSLCSSLVVLGVAGNQLSGLIPTSIGQLNYLISLDLSRNHLGGEIPTSVKNLPNLERLSLGHNFLNGTIPTEINQLYSLKVLDLSSNLLTGEIPGALADLRNLTALLLDNNKLTGKIPSAFAKSMSLTMFNLSFNNLSGPVPANSNTVRCDSVIGNPLLQSCHMYTLAVPSAAQQGRGLNSNDYNDTSSADSQNQGGSNSFNAIEIASITSATAIVSVLLALIVLFIYTRKCAPRMSSRSSRRREVITFQDIGVPITYETVVRATGSFNASNCIGSGGFGATYKAEISPGVLVAIKRLSVGRFQGVQQFHAEIKTLGRLRHPNLVTLVGYHLGESEMFLIYNYLPGGNLERFIQERSKRPVDWKMLHKIALDIAKALAYLHDTCVPRILHRDVKPSNILLDTEYNAYLSDFGLARLLGNSETHATTGVAGTFGYVAPEYAMTCRVSDKADVYSYGVVLMELISDKKALDPSFSPYGNGFNIVAWACMLLRQGRAREFFIDGLWDVGPHDDLVETLHLAVMCTVDSLSVRPTMKQVVQRLKQLQPPIREHR

SEQ ID NO: 11198 - protein, 298 aa, Coccidioides immitis RS
MASSGAGTGGSFQPIRQGQAQQQPGYEKHMTPTSEATKLESEGRFVEYVGSNKLKGKKALITGGDSGIGRSVAILMAREGADVTIVFLPEEQEDANDTKKAVEREGKKCLLVPGNLMNNDNCKKAVDEHVSAYDRVDVLVNNASKQIMCKDFAQIDLDNVASTFQSNILQMFAITKFAIPHMKKGSSVINTTSVVAFRGSSSMVDYSSTKGAIVSFTRALAKNLAPKGIRVNAVAPGPVHTPIQPASRPPEQMEGFGSGSMIGRPGQPSEIAPTFIWLASNEGALYYGQIMHPYALGD

SEQ ID NO: 11199 - protein, 268 aa, Pneumocystis carinii
MTSRENLVYLAKLAEQAERYEEMVESMKKVASSDQELTVEERNLLSVAYKNVIGARRASWRIVSSIEQKEENKGNLSQAGLIKEYRSKIESELTSICNDILAVLDAHLIASASTGESKVFYYKMKGDYYRYLAEFAVGDKRKAPSDASLAAYKEASDIAGTDLPPTHPIRLGLALNFSVFYYEILNSPDCACHLAKQAFDDAIAELDTLSEESYKDSTLIMQLLRDNLTLWTSDMQDSNEKNDSKEAVSEVPDPGKPSETEASKTDDI

SEQ ID NO: 11200 - protein, 490 aa, Escherichia coli B
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPNGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGMMTLQSYTQVKSIQVEMAKFQSIF

SEQ ID NO: 11201 - protein, 345 aa, Pseudomonas fluorescens PfO-1
MSEIDILSFGETMAMFVAEQSGDLAFIDQFHKRIAGADSNVAIGLSRLGFKVAWLSRVGADSLGRFVVETLAREGLDCSHVEVDPAHPTGFQLKSRNDDGNDPTVEYFRRGSAASHLSPQSITPKLLGARHLHATGIPPALSASAREMSRELMTRMRNAGRSVSFDPNLRPSLWAGEREMIREINRLAALAHWVLPGLSEGRLLTGFEDPADIAAFYLDQGAEAVAIKLGPQGAYYRTHLDQGFVAGVPVETVVDTVGAGDGFAVGMISALLEHQSFPEAVRRANWIGSRAVQSRGDMEGLPTRSELAVEFEAAIAGKSNRLSAAPTVSVEYTKPVGAGLPAMRP

SEQ ID NO: 11202 - protein, 111 aa, Nostoc sp. PCC 7120
MQKFLKLVLVTFLFLISTLTPPANAENTINGEQIFSVHCAGCHINGSNIIRRGKNLQKKTLKKYGMDSLEAIEAIVTNGKNNMSAYKDRLSEQEIQDVAAYVLEQAEKGWR

SEQ ID NO: 11203 - protein, 168 aa, Debaryomyces hansenii CBS767
MLTRLGLNTTAPYHFLFYSIVFGGSVFHSFIVSPIAFKHLSRPEFSNLQNKIFPTYFLGQALSPLVLGLTTPLKLCPFTIGLLALSSATGALNYFVLLPWCQQIKDQRNKLVSDKLHEVIENGEVKPSEEMVRLNKQFGKYHGISSLVNILSILSLGAYGVILSKRLL

SEQ ID NO: 11204 - protein, 124 aa, Bacteroides fragilis YCH46
MKKVICSEKAPGAIGPYSQAIEANGMVFVSGQLPIDAATGVMPDGVEAQARQSLENIKHILEAAGLTMADIVKTTVFLQDMSLFAGMNGVYATYFDGAFPARSAVAVKALPKDALVEIECIAAR

SEQ ID NO: 11205 - protein, 537 aa, Glycine max
  misc_feature (462)..(462): Xaa can be any naturally occurring amino acid
MASSLRISRLISRSFSSTSFFSRGGNGFLGSRHCKYSTSSAIEEEPVKPSVQVEHTQLLIDGKFVDAASGKTFPTLDPRTGEVIAHVAEGHSEDVDRAVAAARKAFDHGPWPKMTAYERQRILLRAADLLEKHNDELAALETWDNGKPYEQAAKIEVPMLVRLIRYYAGWADKIHGLTVPADGPYHVQTLHEPIGVAGQIIPWNFPLLMFAWKVGPALACGNTIVLKTAEQTPLSALYAAKLFHEAGLPAGVLNVVSGFGPTAGAALASHMEVDKLAFTGSTDTGKVVLELAAKSNLKPVTLELGGKSPFIVCEDADVDQAVELAHFALFFNQGQCCCAGSRTFVHESVYDEFVEKAKARALKRVVGDPFKGGIEQGPQIDSDQFEKILRYIRSGVESGATLETGGDKLGNKGFYIQPTVFSNVKDGMLIARDEIFGPVQSILKFKDLGEVVQRANNTRYGXLAAGVFTKNMDTANTLTRALRVGTVWINCFDTFDAAIPFGGYKMSGQGREKGEYSLKNYLQVKAVVNPLKNPAWL

SEQ ID NO: 11206 - protein, 304 aa, Synechococcus sp. WH 8102
MHQFLPYAWFQGQCVPFEEARISIATHALHYGTGAFGGMRAIPDPQSSGSMLLFRADRHARRLSRSARLLLTDLSEATILEALTAMLQANKPQQPIYLRPFVYTSDLGIAPRLHDIETDFLIYGLPLGDYLSPDGVSCRISSWTRQEDRSLPLRGKISGAYITSSLAKTEAVQSGFDEALLLNSRGKISEASGMNLFLVRDGQLITPGVDQDILEGITRASVIELAKAMQIPVVERPVDKTELFIADEVFLTGTAAKITPIRQIESTQMNTDRPVMTALKTRLVSITEGRDTAYEHWVTRIPIA

SEQ ID NO: 11207 - protein, 476 aa, Haloarcula marismortui ATCC 43049
MAEQPVDVDPAGENIAGEAPAEEPEAVTDDTVVHDDDVELERTIGLVGGLAIGIGTMIGAGIFVFPGLAAANAGLAATLSFAIGGLIALLVALPTSELATAMPRSGGGYYFISRGMGTAYGAIVGLGLWLGLMFASAFYLVGLGHYASAVFAELGIGLPFSPVIGIGLLFGVALTALSIGGTENTAKLQNVVVGVLLVVLTGFLSYGVLDAVGVFGGGTVPEQFFSRGYFRVLTTAALVFTSYLGFAQVATVAGEIKQPSRNLPLAMVGSVLIVTVFYVVTIFVATSAFGAERLGEFGETAMVEVARDFLGLPGAVAILGAGLLATFSSANASILSASRAVYALSRDALLPRKASEVNLRYGTPHVALLSAGGPILVLVATGRVELLAEVASFLHLIMYGLMCIALLVLRRRNPEWYSPSYRVPGYPLVPVVGALASFGLIVFMQPASIGIGVVVMLASYLWYRYYAGDVTLKGDI

SEQ ID NO: 11208 - protein, 238 aa, Debaryomyces hansenii CBS767
MSVIEIESESQFTELTKSDANKLIALYFHTPWAGPCQTMNSVFKTLAEANKSVLFISINADDHPDISELFEVSAVPYFILIRNSTILKELSGADPREFISALNQFTEKKDTAAPAAAAAAAPAAPAQSPIEESPEALNERLKKLTGAAPVMLFMKGSPSAPQCGFSRQLVAILREHQVRFGFFDILKDDSVRQGLKNFSDWPTFPQLYISGEFQGGLDIVKESIEEDSSFFENAVKSA

SEQ ID NO: 11209 - protein, 231 aa, Oryza sativa (indica cultivar-group)
MEGGRGVTRVLLVDDSPVDRRVVQLLLSSSACAGSFHVIAVDSAKKAMEFLGLKEEGKEQAIDMVLTDYCMPEMTGYELLKAIKALSPLKPIPVIVMSSENEPQRISRCMNAGAEDFIVKPLQSKDVQRLRKCSPANTQCCDAGSDGKPPLLLLPSDHVVVDATAASPPPPPSRRRAHFAGVAMVLHSSSVELSHYFPFLFKFILLVYAILCLGELLHRWSNGCFLNLWCA

SEQ ID NO: 11210 - protein, 237 aa, Sinorhizobium meliloti
MRSEMEEFHKVRRLPPYVFEQVNRLKASARAAGADIIDLGMGNPDLRTPQSIVDKLCEVVQDPRTHRYSSSKGIPGLRRAQAAYYARRFGVKLNPETQVVATLGSKEGFANMAQAITAPGDVVLCPNPTYPIHAFGFLMAGGVIRSISVEPDESFFPPLERAVRHSIPKPLALILNYPSNPTAQVATLDFYKDVIAFAKKHDIIVLSDLAYSEIYFDDAPPPSVLEVPGATDVTVEF

SEQ ID NO: 11211 - protein, 231 aa, Leuconostoc mesenteroides subsp. mesenteroides ATCC 8293
MNEKNFQKKQAALAALNYIQTDMIIGLGTGSTVSYFLDALAASQYNVIGVTTSTITSQRCAELNIPIVDIDAIDHIDVTVDGADEVDSYLNGIKGGGAALLMEKIVAKNSKKNIWIVDRSKVHNTLGSFPLPVEVIPYGSGQLLRQFANKGLFPKLRRHPGNNQPVITDAGHYIIDCHMTTINNPYALAEYLESQVGVVEHGLFLNICDRIIIGDNTVEIKERQQAHVEIN

SEQ ID NO: 11212 - protein, 807 aa, Enterococcus faecalis V583
MLVSYKWLNEYVNLSNVTPQELADKMSVTGIEVEGVAVPEEGLKKIVVGEVKECVPHPNSDHLSICQVDIGEEELSQIVCGAPNVKAGIKVIVALPGSRIAGNQKIKKGKMRGEVSNGMICSLEELGYSDNVVPKAYAEGIYYLPQEAVNGTPVFPYLDMDDAIIELSITPNRADALSMRGVAYEVGAIYRQTPQFNDPELKEDASDNVENYVTVTVEDSQDAPAYQIRVIKDVTIAESPQWLQNRLMNEGIRPINNVVDVTNYILLLFGQPLHAFDYQKLDSKEILVRRATATEELITLDGETRQLTEENIVITNGKTPVGLAGVMGGANSEISQETTTVALEAALFNPLSIRKTSKQFNLRSESSSRFEKGINQATVGLACDVAAAMIAELANGTVVSGTAVGSEVAVKEAQVAVTLERINQYLGTALDEATVNEIFEALGFAYEVNQGAYEITIPPRRWDIAIEADIIEEVARIYGYDHLPSTLPSGETVAGSLTKAQHVTRQLKSLLEGHGTSEAISYALTTEEKSRQFMMKESQTTRLQWPMSEERSVLRMNLISGLLDDVAYNVARKNNNIAFYEVGRVFYQTEDPTKNLPTEENHLALALTGNTMVKDWQTKATAVDFYTVKGLVESIVAVLGLTEKISYQATTAIPEMHPGRTAWIYLEGEVVGFVGQVHPTTAKAYDIPETYVAELNLQQLVAIEAGGVTYEAVSKFPAVSRDIALLVDETVTNQELVKTISDNAGKYLKEIHLFDVYQGEKLGAGKKSMAYSLTFVNAEATLVDEEINRSMEKVEKALIEKHQVEVR

SEQ ID NO: 11213 - protein, 300 aa, Parvularcula bermudensis HTCC2503
MADPQTLSFADALEGDRADRAAFASALVQSLKDTGFVILIDHGIDLTRLNDVYETVAAFFAQAEDDKARFIVGRDGQRGYTPFGRESAKDTAIPDLKEFWHVGREAVAPNVWPDHPPAFRSEISWLYEALDATGHGLLAALEEGLGVGAGDLTRLAEGGNSVLRLLHYPPVTATAPPGSLRAAAHEDINLITLLVAASAEGLELLSRDGEWRAIDAPPDALIVDSGDMLARLTNGFLPATTHRVVRPRTVNRSRYSLPYFLHPRPDALLACLDGFRDGSEAPPILAADFLAQRLAAIGLT

SEQ ID NO: 11214 - protein, 441 aa, Parvularcula bermudensis HTCC2503
MTAAGSNDYPSTELLVARRNDACPMGLPSKSGLYAERAEGAEIWDVDGKRYIDFIAGIGVLNVGHRHPKVQEAIKSQLDKVVHTAFGVAQYEPYIALAERLNELVAKAGNGASAYKTMFVNTGSEATEQVCKFARRITGRPGLIAFEGAFHGRTLLATALTGKAEPYKAGFGPFPPDIYHAPYPNPYMGMSVEGALNCLHHIVGTSIRAEDVAAVIIEPVQGEGGFIPAPIDYLRGLKEFCETHGILLIADEVQTGFARTGRMFAIEHAGVEPDFLICAKSIAGGLPLGAITGKASLFDKIAPGGMGSTFGGNPVACAAALAVLDVIEQEGLIERAEVIGQRIEARWRDLAEGPARGIFGDIRRAGAMAAIECVRDADAREPNPDFAAALQSMARDKGLIFLTAGRKAHVIRTHVPLTIADDLLEEGLDLFAEATLATLKG

SEQ ID NO: 11215 - protein, 371 aa, Malus x domestica
MGKGGMSDGDHADRCCGEAINGDVQQENMAAWLLGVKNLKIQPYKLPNLGPHDVRVRLRAVGICGSDVHHFKNMRCVDFIVKEPMVIGHECAGIIEEVGSEVEHLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLLIAKSLGADAVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 11216 - protein, 373 aa, Haemophilus somnus 129PT
MAKRDYYEILGVQKGADDKEIKRAYKRLAMKYHPDRTKGDKESEEKFKEINEAYEVLADKEKRAMYDQYGHAAFEQGGGAGGFGGFSGADFGDIFGDMFGDIFGGGRSRQRVVRGEDLRYDIEISLEEAVKGCKKDIQINTLVHCGTCHGSGAEAGSKIESCPTCHGAGRVRRQQSFFVTEQTCPHCHGTGKKIEKPCHTCHGEGRVHKTQNLTVTIPMGVDTGNQLRLAGKGAAGENGAPAGDLYVVIHVKKHHIFERDGNNLYCEVPISFTMAALGGEVEIPTLDGRLKVKIPAETQTGKLLRLRGKGITSRGYAGDLICEIVIETPIKLNEEQKELLRKLEESLEGKTLQRPKSSGFLDGVKKFFDNLGK

SEQ ID NO: 11217 - protein, 309 aa, Haloarcula marismortui ATCC 43049
MAKRPAERAGVADIDCTGMQVLVTGSTSGIGREAALSLGRLGADVIVHGRDADAGAAVVSELSGLGVDAAFVQADFAAVDEVRSLAATVRDETDGLDILVNNAGGLFRQGRLTDIGVEYTFHVNHLAPYLLTTELLDHLNAGARVVTTASSAHRGTSLDLDRVTTVDSYTGTWAYSHSKLANVLFATELARRLETTGRDVVSNCLHPGAIPGSGFSRFLPGPIPQFVKLFDAVPGITSVEDGAAEILHLAVSSRIGDVSGRYFAGQRPATPSHAARDRAAASRLWRRSADLLGIDVPLGDVQSSAPTEN

SEQ ID NO: 11218 - protein, 254 aa, Oryza sativa (japonica cultivar-group)
MKGHNCHPVPLWEREFCIYVGGISWHRFCDNKRYVCMYKNIEQWDDSEAFDNFKNAKARFWANYHGQPSDISLPDPDMYIDKIDHNSKIDPELIADLKMVRLPFERDDELLPADGLGSTDTDNKCQQKQNQSGNWDIYVEKPTEVNKWEQDSRSNMDWGTKHESWNEWSKNCSGWGSALADSSALADSSWGNWNNSNNHHSSNNRDSFNGVNRNRYQDPNSISGRKRNSGGHIQQRNSRQRNQTEGYQGSTPRW

SEQ ID NO: 11219 - protein, 403 aa, Anabaena variabilis ATCC 29413
MSFDWITPADRIQQLPPYVFARLDELKAKAREQGIDLIDLGMGNPDGATPQPVVDAAIQALQNPANHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALGRIKQAGIRYRPEALVSTPE

SEQ ID NO: 11220 - protein, 426 aa, Zea mays
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTWAEKRTFLRQRVEARLAALLLENQEYTEALTLLTSLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPIDHVEKKLSQMILDKKFAGTLDQGAGCLIIFEDPKTEEIFPATLETISNVGKVVDSLYVRSAKIMA

SEQ ID NO: 11221 - protein, 320 aa, Leuconostoc mesenteroides subsp. mesenteroides ATCC 8293
MIMKVYYEDAKKTFDVEIEALTRVKSSLGKSFDEAVDKILSTKGRVIFIGIGKSGIIADKIAASFSSVGLASFYIDAGTAYHGDLGRVSSDDVVIFISNSGETQEVLQALSALQNIHNNELATIAMTGSEDSTLAKNTDIVLSIDVAEEADITKLAPTSSTTATLVMGDALLVAIETAKEFDRESFAMYHPGGSIGKILLQNVKNSMHTKIPYVHVDTSINEVIYRISDYGIGITLVKDEQENVIGIITDGDIRKKFLNISKVKGSTAKDYMTQGFISISEDKRNREAWRKMANYNISNLVVLDKDKKVVGVVTIHDVLE

SEQ ID NO: 11222 - protein, 517 aa, Campylobacter upsaliensis RM3195
MMNSLILVLDFGSQYTQLIARRLREYGVYTEIVPYFEKLDFIKAKNPKGIILSGGPASVYEEGAYKPDSRVFELGIPVFGICYGMQYIAHFFGGSVVRAEAQEFGKAVLEIADLNLALFKGVKQDSIVWMSHADKVESLPSGFVELAKSGNTHYCAIADFKRNVYALQFHPEVVHSECGGEILRNFAVGICGADTSWNMRNFAESEIAKLREKVLGGDKVLCAVSGGVDSSVVAILLYRAIGENLIPVFVDTGLLRKGEREAVEAMFKENLKVPLIVADARELFLRRLKGVTEPEQKRKIIGETFIEVFEAEAKKHNTKGEIKFLAQGTLYPDVIESVSVKGPSKTIKSHHNVGGLPEWMKFELIEPLRELFKDEVRALGRELGMPESMLMRHPFPGPGLAIRIMGEVNSADLELLKEADSIFIEELHKWGLYDSVWQAFCVLLNVRSVGVMGDNRTYDNTICVRAVEAQDGMTASFSHLPHAFLESVSNRIINEVVGINRVVYDITSKPPGTIEWE

SEQ ID NO: 11223 - protein, 484 aa, Aspergillus nidulans FGSC A4
MLAGPGLKGRIARQQAAAFARSTRSISRFSPRNSKVLGGNTSWRAPVPFIALPTARFNSTSTTAPTEVTPETQPSSELDVSNIDLTQIPERIGYLKDLGLDYGWGPSAIVEFMIEHIHIYSGLPWVGSIIATGIFFRLAMAPLFWRAGDTSARLANAQPILAPIKEKMLNAARSGNQVEAQKWRAEMAKTNANLGIVPRNTFMPLVFQLPIGFGCFRVIEGMAGLPVPGLAAEQFAWINDFTVADPTYILPILCCTVLHLSIRKGGETGSSMSGDMATIRKGMMYGIPAFSFFFVAFFPAALQAYFLTTGFLGLLQAYAFANATFRKATGMTVIEKLNPVQPSGSNPAEPNRALRLITEALERENAKLNEAKKIAAEQPKISFIDRAINNIKESKEKLTKETTQKMQELSGQGPKKNADGSLAEPPRLSEKDRKLAEDYERRRKEEEDWKREERNHARREAYRQAMERERQRAKAALNKSEVKQ

SEQ ID NO: 11224 - protein, 419 aa, Desulfotalea psychrophila LSv54
MPISTDFKERVYPHLRQIADHYHTPFHIYDEAGIKQTGTRLKQAFSGIDGFREYFAVKALPNPAIMKIMQEMGFGFDCSSVAELILSRKLGAKGDEIMFTSNNTSPEEFIAAAEDGGCILNLDDISLIAKVPKMPETICFRYNPGERRTGNDIIGTPVEAKYGVSHEQIIEAYRLAKKAGAKRFGLHTMLASNELNYSYMVQTAQMLLALVEKISAELDIKFDFINIGGGLGIPYQPEQNELDLESMAREITAIFDLFKEKNDYCPALYMESGRFITGPHGILVTSVINKKEIYRDYVGVDACMNALMRPALYGSYHHIEVLGKETGATTKKVDVAGSLCENNDKFAIQRDLPICENGDLLIIQDTGAHGHAMGFNYNGKMRPQELLFDSEGNTALIRREERLSDYFATLEFAEDKLTL

SEQ ID NO: 11225 - protein, 1135 aa, Zea mays
MSSPSNNRGTCSRSSSARSKHSARVVAQTPVDAQLHADFEGSQRHFDYSSSVGAANRPSASTSTVSTYLQNMQRGRYIQPFGCLLAVHPDTFALLAYSENAPEMLDLTPHAVPTIDQRDALTIGADVRTLFRSQSSVALHKAATFGEVNLLNPILVHARTSGKPFYAILHRIDVGLVIDLEPFNPADVPVTAAGALKSYKLAAKAISRLQSLPSGNLSLLCDVLVREVSELTGYDRVMAYKFHEDEHGEVISECRRSDLEPYLGLHYPATDIPQASRFLFMKNKMRMICDFSATPVLIIQDGSLAQPVSLCGSTLRASHGCHAQYMANMGSVASLVMSVTINDDEEEDGDTDSDQQPKGRKLWGLVVCHHTSPRFVPFPLRYACEFLLQVFGIQLSKEVELAAQAKERHILRTQTLLCDMLLRDALVGIFTQSPNVMDLVKCDGAALYYQNQVLVLGSTPSESEIKSIATWLQENHDGSTGLSTDSLVEAGYPGAAALREVVCGMVAIKISSKNFIFWFRSHTTKEIKWSGAKHEPFDADDNGRKMHPRSSFKAFLEVVKWRSVPWEDVEMDAIHSLQLILRDSLQGEDANRNNIRSIVKAPSDDMKKLQGLLELRTVTNEMVRLIETATAPVLAVDIAGNINGWNKKAAELTGLPVMEAIGRPLIDLVVADSVEVVKQILDSALQGIEEQNLEIKLKTFHEQECCGPVILMINSCCSRDLSEKVIGVCFVAQDLTRQKMIMDKYTRIQGDYVAIIKNPSELIPPIFMINDLGSCLEWNKAMQKITGMKREDAINKLLIGEVFTLHDYGCRVKDHATLTKLSILMNAVISGQDPEKLLFGFFGTGGKYIESLLTVNKRTNAEGKITGALCFLHVASPELQHALEVQKMSEQAATNSFKELTYIRQELRNPLNGMQFTYNLLKPSELTEDQRQLVSSNVLCQDQLKKILHDTDLESIEQCYMETNTVEFNLEEALNTVLMQGIPLGKEKRISIERDWPVEVSHMYIYGDNIRLQQVLADYLACALQFTQPAEGHIVLQVIPKKENIGSGMQIAHLEFRIVHPAPGVPEALIQEMFQHNPGVSREGLGLYISQKLVKTMSGTLQYLREADTSSFIILIEFPVAQLSSKRSKPSPSKF

SEQ ID NO: 11226 - protein, 307 aa, Triticum aestivum
GIHKSIYPLGLSNVTILKKFIQKSRLVPVRNSRDIVDPRVRRGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQNIRSQGGKILLGGSAIESEGNFVQPTIVEISPSAPVVREELFGPVLYAMKFQTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 11227 - protein, 410 aa, Rickettsia sp. IRS3
DSEFAELKIRGKIFKLPILKASIGEDVIDISRVSAEADCFTYDPGFMSTASCQSTITYIDGDKGILRHRGYDIKDLAEKSDFLEVAYLLIYGELPSSEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFTTHCTKYKVNPIIKNALNKIFILHADHEQNASTSTVRIAGSSGANPFACISTGIASLWGPAHGGANEAVINMLKEIGSSENIPKYIAKAKDKNDPFRLMGFGHRVYKNYDPRAAVLKETCKEVLKELEQLENNPLLQIAIELEAIALKDEYFIERKLYPNVDFYSGIIYKAMGIPSQMFTVLFAIARTVGWMAQWKEMHEDPEQKISRP

SEQ ID NO: 11228 - protein, 479 aa, Prochlorococcus marinus str. MIT 9301
MAERFSQKNLRVRPSSDEEKIVTNAKKHFEKTLVEISGELVGSVAALEHPTKNKKLNYGEIFLRDNVPVMIYLITQKRYEIVKKFLSLCLELQSTNYQTRGVFPTSFVEENGKLIGDYGQRSIGRITSADASLWWPILCWYYVNKSGDYAFGKSQSVQRGIQLLLDLVLHPTFEGTPVLFVPDCAFMIDRPMDVWGAPLEVEVLLHGCLKSCINLMELSRADHVSRLLDQRLILTNQWVKDLGGFLLKHYWVTSQTMQILRRRPTEQYGDDQHFNEFNVQPQVVPSWLQDWLENRGGYLIGNIRTGRPDFRFYSLGNSLACMFGVLPPEEQRALFRLVLHNRQHLMAQMPMRICHPHMDVEEWQNKTGSDPKNWPWSYHNGGHWPSLLWFFGAAVLLHQKNYGSDDVILMEEMKSLIEESYWCQLNQLPKQEWAEYFDGPTGTWVGQQSRTYQTWTIVGFLLMNHFLRNDYNDLDMFKI

SEQ ID NO: 11229 - protein, 115 aa, Oryza sativa (japonica cultivar-group)
MEIESVKCECCGLREDCTQDYIASVRASFYGQWLCGLCCEAVRDEAGRKKAHPGVEEAVRAHMAFCRMFRSNPAVRVADGMRQMLRRRSGDMSKPDTSKKYSTVQVVDESSVSLY

SEQ ID NO: 11230 - protein, 279 aa, Coprinopsis cinerea okayama7#130
MTLSGPKQSKVQSQNSGAPLTNFSWNEKNPHYIVTSSIDTTCTVWNLDTSSAMTQLIAHDREVYDVAWLPGSTDIFVSVGADGSLRAFDLRSLEHSTILYETPAPKNVPPPSASPSASARPPTSPLLRIAFNPADSNYMSTFHMDGNEIQILDMRSPGQPVMELRGHAASVNGLAWGAGEHPLLATCADDCQVLLWDLSNYTQGPASPRSAGSRLNSPRPDAKKKVISDPFMAYTASSQVTNLAWSPVIQGLQMNTGHSTSTGEWLAIACGKSIKALKV

SEQ ID NO: 11231 - protein, 319 aa, Zea mays
  misc_feature (18)..(18): Xaa can be any naturally occurring amino acid
MFEALREALIEEMNLDPXVCVMGEDVGHYGGSYKVTKGLAEMFGDLRVLDTPIAENSFTGMGVGAAMKGLRPVVEGMNMGFLLLAYNQISNNCGMLHYTSGGQFKIPVVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIVDNFWDYLDAPIMCLSSQDVPTPYAATLEDATVVQPAQIVAAVEQLCA

SEQ ID NO: 11232 - protein, 335 aa, Hypocrea koningii
VPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 11233 - protein, 337 aa, Hypocrea koningii
APIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 11234 - protein, 174 aa, Haemophilus somnus 129PT
MIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 11235 - protein, 715 aa, Nostoc sp. PCC 7120
MSELWTYFFNSTPFIPHGHCYLWQTDLVWLHIISDGLIALAYYSIPATLFYFVRKRQDLPFYWIFLLFSGFIVACGTTHIMEVWTLWYPTYWVSGFLKAITAIISVFTALTLIPLVPKALLLPSSAQLERANKDLQNEIGERLKVEAELRKYQNHLEELVTIRTNEITNANEKLQQQINERQHIVEILRESEERYRYLAEAIPQLVWTADANGECDYFNQNWCDYTGLNLEESLGSGWLAALHLEDLERSYETWSKAVETGALYENEYRFKRAADGSYRWLLGRGLPLKDHQGRVVKWFGTCTDIHEQKQILEERARLLELEQTARAEAETANRIKDEFLAVLSHELRTPLNAILGWSKLLQERKLDPTRTFQALATIERNATLQVQLIEDLLDISRILQGKLVINITKVNLVTVILAALETMRLAAESKLIQVLTNFPPNIGQVMGDSARLQQVVWNLLSNAVKFTPNGGKIEVTLDKMEGYAQIVVSDTGKGIQPEFLPYVFDYFRQADSSSTRRFGGLGLGLAIVRKIVEIHGGTVTAQSLGEEQGASFTVRLPILPEEDGSVTYQQHRSASLVTNSLPLEGIKVLVVDDDADSRDFLAFILEQEGADVSLATSALEVLQLLPEIKPDVLVSDISMPDMDGYTLIRQMRTWTAEQGGAIPAIALTAFARQYDREQALQAGFQLHLPKPLNAEEFIAAVVELVKSQHSIVSFH

SEQ ID NO: 11236 - protein, 144 aa, Glycine max
HASATLVPHVAAERFPLTESYTIPKGAIVFPSAFESSFQGFTEPDRFDPDRFSEERQEDQIFKRNFLAFGAGPHQCVGQRYALNHLVLFIALFTTLIDFKRDISDGCDEIAYVPTICPKDDCRVFLSKRCARYPSFPSVEDLVK

SEQ ID NO: 11237 - protein, 451 aa, Mycobacterium sp. JLS
MSPETSSEATEQVQDEPATGGKLKRKITGSLLFLFILGDVLGAGIYALMGVLAQDVGGVLWAPLLVALLLALLTAGSYAELVTKYPKAGGAAVFAERAFKRPVVSFLVGFSMLAAGVTSAAGLALAFAGDYLSTFIDVPAIPAAMVFLGLVAALNARGINESVKSNVVMTVIELSGLLIVIVAVAMMVGGGRGEVGRVVEFPDGATPALAILAGAIVAYYSFVGFETSANVAEEIRNPSKVYPTALFGALIAAGVVYALVGVASAVALPADQLSESSGPLLDVVSAAGVGVPDWLFSAIALVAVANGALLTMIMSSRLTYGMAEHGLLPSVLSRVLPQRRTPWVAIVATTVVAMCLTLVGELSTLAETVVLLLLFVFISTNVAVLVLRRDHVGHDHFRVWTAVPVLGVASCVLLMTQQTAKVWAFAAIMLAVGAVLYGLARIATKREGTAV

SEQ ID NO: 11238 - protein, 551 aa, Synechococcus sp. WH 8102
MGKPGRSSIPSVGVHHQGPMSFPDFSASDAQIQWQRFCDLLWYHEDLGIWLDISRMHVNPSHLEQLQPGFDKAFAAMAELEAGAIANPDEQRQVGHYWLRTPQLAPNEAVRDQIATEIDQIDQFGRDVISGVIKAPGGQPFTDVLWIGIGGSGLGPLLMIRALQGHGSGLPFHFFDNVDPNGMSAVLAELDDRLATTLVVTVSKSGGTPEPHLGMEQARHRVESRGGRWADQAVAITMVDSKLDREAQQDGWLKSFSMFDWVGGRTSITSAVGLLPGALIGADIRDFLAGAAQMDDATRLADLRRNPAALMAASWFVAGDGKGRRDMVVLPYRDRLEVFSRYLQQLVMESLGKRLDRDGNEVNQGIAVYGNKGSTDQHAYVQQLRDGVDNFFATFIEVLEDVSDIPVIKDECPGDFLDGFLQGTRSALTEGGRQSLSISMRRFDARRLGALIALFERAVGFYGDLVNINAYHQPGVEAGKKAAAAILDLQSRVEAVLKDGAPRTVSEIRQAVGDGSDEAIFWIMRHLAGNDRGYRAEGDWANPASIRFSCS

SEQ ID NO: 11239 - protein, 81 aa, Glycine max
  misc_feature (49)..(49): Xaa can be any naturally occurring amino acid
  misc_feature (65)..(65): Xaa can be any naturally occurring amino acid
IYLLSTFTRHITPHTIAEPQKAKIYHYYVPVFLCCEQHITEHHCHFIHXQYIPSLVIGYTAPQSXHKTTLVFALDYHFETI

SEQ ID NO: 11240 - protein, 256 aa, Bacillus clausii KSM-K16
MGKPIQKTDGSTPQRPLICAPLVGKTKAALIEEIDAVAAKKPDLLEWRVDFYKHIGKTEDVLETASLLKAHSKGIPILFTRRSIREGGEPITVSEQEVTALYEQVMKLGLVDVVDVELSCPEAEKERLRAIAKETETQWILSYHDFQRTPSEADILAKLQEAEANGADVGKVAVMPETMADVLTLMQATQKAASTLTIPVITMAMGRLGTLSRMAGGACGSALTFAIANESSAPGQMPIDELRSVLDVIDRYVTGQ

SEQ ID NO: 11241 - protein, 965 aa, Arabidopsis thaliana
MALTLTPTSSVHLLSSISVARPRIFAADFNLRSRWRRRRPVTSISNFRLRLPSKTSLHCLCSSSSASSPMSLEVSSPNSQFLDCLIYSRAYWVTQGVIAWNVDVGEGSCYFYASKSAGLSFSEDGIDGYDLRIKLEAESGSLPADVIEKFPHIRNYKSFKVPKDLDIRDLVKSQLAVVCFDAEGRLIQGTGLQLPGVLDELFSYDGPLGAHFTPEGVSLHLWAPTAQAVSVCIYKNPLDKSPMEICPLKEANGVWSTEGACSWGGCYYVYKVSVYHPSTMKLETCYANDPYARGLSADGRKTFLVNLDSDDLKPEGWDNLADKKPCLRSFSDISIYELHVRDFSANDETVEPENRGGYLAFTSKDSAGVKHLQKLVDAGLTHLHLLPTFQFGDVDDEKENWKSVDTSLLEGLRPDSTEAQARITEIQNDDGYNWGYNPVLWGVPKGSYASDPTGPCRIIEFRKMVQALNCTGLNVVLDVVYNHLHASGPHDKESVLDKIVPGYYLRRNSDGFIENSTCVNNTASEHYMVDRLIRDDLLNWVVNYKVDGFRFDLMGHIMKATIVNAKSAIGSLRKETDGVDGSRIYLYGEGWNFGEVAENGRGINASQFNLGGTGIGSFNDRIRDATLGGSPFGHPLQQGFITGLLLQPNAHDHGSEATQELMLSTAKNHIQTGMAANLKDYMLTNHEGKEVKGSEVLMHDATPVAYASLPTETINYVSAHDNETLFDIISLKTPMEISVDERCRINHLASSMIALSQGIPFFHAGDEILRSKSLDRDSYNSGDWFNRLDFSYSSNNWGVGLPPKGKNEHNWPLIKPRLQDPSFKPKSSHIVATLHNFLDLLRIRYSSPLFRLDTARAIQERVRFHNTGPSSIPGAIVMSIEDGHRGIPSVSQIDPIYSLIVVIFNARPSEFSYPSPALKDRKLELHPVQVMSADEIVKKSVYDSFSGGFTVPARTTTVFVESRNG

SEQ ID NO: 11242 - protein, 749 aa, Streptomyces avermitilis MA-4680
MSSAAEQEAVQEERAGEEHAARPAAVLNGRRPAAPAPPVWPGAPTPLGARFRTGPDGVTGTNFALWAGGAEAVELCLFDETGAEIRVPLTELTHEIWHGFVPGVLPGRRYGYRVHGRWDPWTGARWNPAKLLLDPYARAVDGDFSLPPEVYGHVRDWPQQQVADTVRDDRDSAPYVPKGVVVHDDDDWADDHRPKTPWADSVIYELHVRGFTKTHPGIPEELRGTYAGLAHPAAIEHLVGLGVTAVELLPVHQFAHEDHLLRKGLRNYWGYNSIGYFAPHAGYAAAGTNGQQVGEFKRMVRALHAAGIEVILDVVYNHTAEAGELGPTLSLKGIDNRGYYRLQPDARRYADYTGCGNTLHVVQPHVLRLITDSLRYWVTEMGVDGFRFDLAAALARSMHDVDMLSPFLAVIAQDPVLRRVKLIAEPWDVGSGGYQVGAFPPLWTEWNDRYRGAVRDFWRGALPDVRDLGYRLSGSSDLYAWGGRRPYASVNFVTAHDGFTLRDLVSYERKHNEANGEGNRDGSDDNRAWNCGAEGETDDERVRSLRRRQLRNLLTTLLLSTGVPMLVAGDELGRTQRGNNNAYCQDNEISWVDWELLEEPGWRALRDLTARLIALRHAHPVLRRRAFFSGRAHSADGLRDLAWFTPRGAEMTERDWYAPAATLGMYLSGRDIPGRDARGVPVVDDSFLAVLHAGHRPVSFVLPGPPWAERYEVVVDTSREDQAAAPGTAHRAGATVTVAARAVLLLRVG

SEQ ID NO: 11243 - protein, 143 aa, Citrus junos
MGSKTSASLALFLAVNILFFALVTACGSCPSPKPKPKPKPTPSPSGASCPRDALKLGVCANVLNGLLNVTIGTPPVQPCCTLIQGLADLEAAVCLCTAIKANILGINLNIPLSLSLLLNVCSKGCPVVSSVLNDDHIFLYLRL

SEQ ID NO: 11244 - protein, 223 aa, Brassica napus
MSTYPSSLPPHSPSENYVTPPLTVILTVILLVFFIGFFTLYFCKCFLDAMMQAWRLRHGGEAEATENSIQPPEAPMVNPGLELRIINSFPTFPYSSVKDLREEKYGLECAICLLEFDGDHVLRLLTTCYHVFHQECIDLWFESHKTCPVCRHDLDPPPPENTTITLPNVDEMIIDVIQENSDDDQHHQITTQIDTWPSSGQNSCLNSERSRKEQTLADKFSRS

SEQ ID NO: 11245 - protein, 886 aa, Escherichia coli
SERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 11246 - protein, 204 aa, Oryza sativa (japonica cultivar-group)
METDRSQPAPIDPRRARFPCCIVWTPLPLISWLIPFIGHIGICREDGVILDFAGPNFVSVDNFAFGAVARYIQVNSDECYKLLEPEGASTWDDALRKGVQEFQHRGYSLFTCNCHSFVVNNLNRLFYSGHDKWNVVSLAAVMFLRGRWVSTASVVKTFFPFALVITIGTLLGGATFLIGLLAFAAVMTGWFLVGTYCIKSLVEL

SEQ ID NO: 11247 - protein, 264 aa, Zea mays
NETAEHRRLAEIIEMIHTASLIHDDVIDDSGMRRELTVSRKGTIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 11248 - protein, 452 aa, Pseudomonas fluorescens PfO-1
MAYDFDLYVIGAGSGGVRAARFAAGFGAKVAVAESRYLGGTCVNVGCVPKKLLVYGAHFAEDFEQSSGFGWNLGEADFDWATLIANKDREINRLNGIYRNLLVNSGVTLHEAHAKIVGPHEVEVNGERYTAKNILIATGGWPQIPEIPGHEHAISSNQAFFLKELPKRVLVVGGGYIAVEFAGIFHGLGANTTLLYRGDLFLRGFDGSVRNHLKEELTKRGMDLQFNADIARIDKQSDGSLKATLKDGRVLEADCVFYATGRRPMLDNLGLENIDVQLDDKGFIKVDEQYQTTEPSILALGDVIGRVQLTPVALAEGMAVARRLFKPEQYRPVDYKMIPTAVFSLPNIGTVGLTEEEAREAGHDVVIYESRFRPMKLTLTDCQERTLMKLVVDGKSDKVLGCHMVGPDAGEIVQGLAIALKAGATKRDFDDTIGVHPTAAEEFVTMRTPVGA

SEQ ID NO: 11249 - protein, 331 aa, Parvularcula bermudensis HTCC2503
MTGPAEPRGHPTPAAQTNRLSSFGHIDWQQTLDDICTDILPHLGKGQVADYIPALASANPKAFGIAFSTIEGTTYTAGDWNTAFSIQSISKVFMLSVALAEEGEKLWRRVGREPSGSSFNSIVQLEREHGRPRNPFINAGALVVTDTVISHCGDEAGIDRLLAFLRESSGDQAIVVDEKIARSEAAYGDRNRALAYFMKSFGILREDVPITLETYFRQCAIEMSVANLSKAGLYLAAEGLCPISNRAVANDAHTNRVNAIMMLCGHYDRSGDFAYRVGLAGKSGVGGGIIAIIPGVGCVAVWSPPLNDAGNSYAGTLALEWFSHRTGVNLF

SEQ ID NO: 11250 - protein, 461 aa, Oryza sativa (japonica cultivar-group)
MPHRAGEVSSSSSPGSMSKAMQCFGFAGWERDERRGRSSAVASAAAATTRSLSARSNSSTSTDRDARRSGSECSLNVSSEISAESFGRYRQLSLPQRASNNLRIFTFQELKSATRGFSRSLVLGEGGFGCVYRGTIRSVLEPRRSVEVAIKQLGRKGLQGHKEWVTEVNVLGVVDHPNLVKLIGYCAEDDERGMQLLLVYEFMPNGSLADHLSSRSPRPASWAMRLRVALDTARGLKYLHEESEIKIIFRDLKPSNILIDENWNAKLSDFGLARLVSQDGSHVSTAVVGTIGYAAPEYIHTGRLSSKNDIWSYGVVLYELLTGRRPLDRNRPRGEQNLIEWVKPYSTDSKKLEIIMDPRLEGSYSLKSAAKLASVANKCLVRHARHRPKMSEVLEMVQKIVDSTDLGTPEHPLISKSRELTRDEKKRKGLDLKRRFADIKAGGDQRWFTWQRWRPKLVRTQ

SEQ ID NO: 11251 - protein, 147 aa, Brassica napus
MPHGTLEVVLVSAKGLEDTDFLNSMDPYVQFTCRTQDQKSNIASGQGTTPEWNETFIFNVSEGTTELKAKIFDKDVGTEDDPVGEATIPLEPVFLEGDIPPSAYNVVKDGEFKGEIWIALSFKPSENRSRGVEEESYGGWKNSEASY

SEQ ID NO: 11252 - protein, 530 aa, Zea mays
  misc_feature (183)..(183): Xaa can be any naturally occurring amino acid
  misc_feature (201)..(201): Xaa can be any naturally occurring amino acid
  misc_feature (241)..(241): Xaa can be any naturally occurring amino acid
MTLSGMAVAFKASTSSVTQQHWASPTKDQCQYGFTHLSRQKCRKRALCVTAISGKLDLDFTDPSWNQKYQEDWNRRFSLPHINDIYDLEPRRTTFSLKKNRIPLGDGDGSSTDMWNGYVNKNDRALLKVIKYASPTSAGAECIDPDCTGVDTGVHRAGPRKEIYYAFEEVKAAIVTCGGLCPXGLNDVIRQIVFTLETYGXVKNIVGIPFGYRGFFEKGLKEMPLSRDVVENINLSGGSFXLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMHASLSSGQIDVCLIPEVSFTLDGEHGVLRHLEHLLNTKGFCVVCVAEGAGQDLLQKSNATDASGNVILSDFGVHMQQKIKKHFKDIGVPADLKYIDPTYMVRACRANASDAILCPVLGQNAVHGAFAGFSGITSGVCNTHYVSLPITEVITTPKHVNPNSRMWHRCLTSTGQPDFH

SEQ ID NO: 11253 - protein, 371 aa, Oryza sativa (japonica cultivar-group)
MSTTAKFLALAVFAAAAILSLDSRSDVRQLEIRDGDVELIPLLDGAAGPESIVFGDAGEGPYTSVSDGRVLKWLPPPERRWVEHSCSVPELLDSCRGSKDTKREQECGRPLGLKFNSKTGELYVADAYLGLRVVSPGENVSRPLVPKWTESPFSFSNGVEIDHETGVIYFTETSTRFQRREFLNIVITGDNTGRLLKYDPKENKVEVLVDGLCFPNGLAMSNDGSYLLLAETTTGKILRYWIKTPKASTIEEVVQLHGFPDNIKMSPRGGFWVGLHAKRGKIAEWSISYPWLRKVILKLPAQRIQRITSFLTGFGRQVIALRLSEDGKTIEAMSVHGDVRKLFKSISEVEEKDGNLWIGSVLSPFLGLYRI

SEQ ID NO: 11254 - protein, 635 aa, Parvularcula bermudensis HTCC2503
MNKPTSQAEFATPRVTTGPLPASQKVYVQSDRFDDVAAPVRYISVHPSANEPPLPVYDSTGPYTEDGFEAAVEQGLPRKRTAWILERGGVETYEGRQITPEDNGGATGDYLARAFPRAHSPMREVEGGDGKARLLTQLDYARAGIVTKEMEYIAIRENLGRRQAAAHAAETLADGESFGAEIPEFVTAEFVRDEVARGRAVIPANINHPEAEPMIIGRNFLVKINANIGNSAVTSSVEEEVDKMVWATRWGADTVMDLSTGRNIHNTREWIIRNSAVPIGTVPIYQALEKVGGVAEDLTWEVYRDTLIEQCEQGVDYFTVHAGVRLPFIHLTADRVTGIVSRGGSIMAKWCLAHHKESFLYTHFEEICEIMRRYDVTFSLGDGLRPGSTADANDRAQFAELETLGELTKIAWRYGVQVMIEGPGHVAMHKIKANMDKQLKVCGEAPFYTLGPLTTDIAPGYDHITSGIGAAMIGWFGTAMLCYVTPKEHLGLPDRDDVKTGVITYKLAAHAADLAKGHPAARLRDDALSRARFEFRWEDQFNLGLDPETARDFHDQTLPKEAHKTAHFCSMCGPKFCSMKITQDVRDYAGGLSDNERKALEEMSEEERRKGMAEMSEKFEEGGGRLYVSAPGAGS

SEQ ID NO: 11255 - protein, 314 aa, Magnetospirillum magnetotacticum MS-1
MRALVWHGTQDIRCDTVPDPQIEDDRDAIIRVTACAICGSDLHLYDHFIPAMKKGDIMGHEFMGEVVETGRGVNGALKKGERVVIPFTIICGECDQCKRGFFSVCERSNRNRSMAAKVFGHGTAGLFGYSHLTGGYPGGQAEYVRVPFADRTHIKVPDSLTDEQVLFLGDIFPTGWQAAVQADIQPHDTVAVWGAGPVGQMAVRSAILLGARQVICIDSVPERLDMARAGGAITIDNSVESPVERLNELTGGKGPEKCIDAVGMEAHSPRALEQVYDRVKQAMMLESDRASVLREMIYVCAPPASSRFPASMAA

SEQ ID NO: 11256 - protein, 399 aa, Parvularcula bermudensis HTCC2503
MAEKSFDIIVWGATGFTGRLVAQHLLRTYGAEGNLKWAMAARNPDKLAMVAKEIGAEDVPHLLANADDRESLDRLAAAAKVIITTVGPYQLYGEKLVAACAEAGTDYVDLCGEPGWMAGTIARYHDIAQRTGARIVHSCGFDSIPFDLGVHYVQKLYREAYGRPAPLVKGVLKGAKGGLSGGTYASLMETVKAAETDQEVRRALGNVYGLAQDSEAKRPRQPDVRKPRKDEDVGAWLAPFIMADINMPNVHRSNMLTDYAYGQDFRYLEMMRVPNRVVAWGLAVGLGSFMSLVKNKSTRGLVQRLLPDPGEGPSEKERESGFFKVLMIAKDEKGLSLRAEITGDKDPGYGGTSRMLSEAAMTLLHHPEGQTGCLTTAPAMGDALIDRLEAHAGLTFRKL

SEQ ID NO: 11257 - protein, 761 aa, Thermus thermophilus HB8
MAWLNPFWSSPKAYVRPPKRGLAPELWASRIPFTHLENFYEVFRALWENRDNLPYAWRILKDGVCDGCALGTSGLEDWTLHGVHLCNVRLRLLRLNTLPPLDPKVLEDVEALKGRKSRELRRLGRLPYPMLRRKGERGFRRVSWDEAMGLATEYLRRHLPEGAFFYLTSRGVPNETYYVVQKAVRALGCNHVDNAARICHSPSTVVLKEALGVAATTCSYTDLIGTDLVVFLGSNVANNQPVMMKYLYHAKKAGTKVAVVNPYREPGMERYFVPSDLESALFGTRIADRFFQILPGGDIAFLHGAAKWMLEEGWVDPGFIRAHTAGFEAYKALLEAIPFAELEKAAGVSREEMRAFAEMVGRAERAVFVWGMGITQHTHGEDNVRAIVNLALLKGFVGREGCGLMPIRGHSGVQGGAEMGAYATAFPGGLPVNPENARRLAELWGFPVPDRPGLTTPEALDRALEGRLGVLWAIGGDFREVMPDPEAVEEALRRVPLRVHQDIVLSSQMLLEPGECVLLLPATTRYEVPGGVTETSTERRVIFSPEIPGPRPPEARPEWEVFQELVHRLRPELKDRFRFASTAEIREEIARVIPLYEGIQRFKAKGDQFQYGGRRLCEGWRFPTPDGKAHFRPVPLPQKEVPEGAFRVVTRRGKQFNSIVHEDQDPLTGAFRDAVYMNPKDAARLGLKPGDPVVLENAFGRYAGRVYLAEVKEGTLEVHWPEGNVLVDPKARSPLAHIPAYKEILAHLRRGEAEAPSPLRP

SEQ ID NO: 11258 - protein, 410 aa, Terrabacter sp. DBF63
DPRTVVVVGASVAGVRTAQSLRTEGFGGRIVLVGDEPDLPYDKPPLSKQFLAGCWSVERIALLTAEAAAAVGIELRLGVAAQRLDVAGRQVVLIDGSTIDYDAAVLATGAAARPAPWSATSGVHVLRSMADARALRDDLEVDRPVVIIGGGFIGAEVAATAHALGREVTVVDPLSAPIGRVVGREVGELFVDLHTRHGVTTKFGVGVESVEGEAGDLTVQLTDGSQLAAGTVVVGIGAVPNDGWLAGSGLLVDDGVVCDEHCRAVDAADVYAVGDVLRWFHPGHGEHVRVEHWTNAVESAAVVAHNIAHPEELRSHCPVEYVWSDQYDWKIQIVGRPVGATRHTLVGDLTSAHPRGAAVYTDDSGDLRGAVAVNWPKALLVCRRAVGAGASFDDVVAQLDRLSAAGAAPA

SEQ ID NO: 11259 - protein, 420 aa, Zea mays
MADTATVPLLTSHKADPAKVPPTSIDDMIEKYIGDTGGAVQLLKAVFVAFAWAFDAQQVFISVFTDAEPQWHCVDVAGGNNSSCTPAAASPCALPPGTWAWDRPAKTSVVSEWALQCAGPAPALASLPASSFFAGCLVGGFVLTTLADSVLGRKKTLLLSLVSMSVAGLLTALAPNVWAYAALRFVSGFARSTVGTCTLVLSTELVGKRWRHTESPRWLLVRGHKRDAIESLRQIATLDDSGGHTTTNLSMLELELEACVSMHNEDGASSSGSGVFATLQVMWERPWAIRRLAAIMVAGFGVGMVYFGMPLTVGSLGSNLYLSTAYNALAEVPSSILSWLLIARANRRTSVVVLAASAGVLSLACAAMPQRAEAARMAGELLSFFATCTAYDVILVYSIELFPTSVRNSAVGRWCGRRWC

SEQ ID NO: 11260 - protein, 459 aa, Propionibacterium acnes KPA171202
MPCQGVYAWCGNPVSGGDGCHPSWQDMPLRADMPYEAWPSAKSSLEPSKRQGRQVTLVGVCIVSTMNPILGADMTTYQYLIVGGGMAADSAARGIRDIDKKGSIAILSADVDAPYPRPALSKKLWTDPEFTWDQADLATVADTGAELRLGTEVLSIDRDGKTVLTASGQVFGYQKLLLVTGLTPSRIDDDGDAVLYFRSARDYQQLRALAQPGHQFVVVGGGYIGAELAAGLVQQGCEVALVTPDPTLGGSQFPAQIASEYQKLFADAGVHLVTGKRVCSVRKHEAAEVTLDDGTILQADDVIAGLGASPVTKLAEEAGLTVNDGVIVDEQLRTNDPAIWAAGDIANYPDPVLGRTRVEHVDNAIAMGKAAGRIMAGSKDSYTHTPMMYSQIFGVRWEAVGTLDSSLATTSVEAGDGQVVYYLSDGKPVGVLLWNLPGRTDKAVTVLADPPEDLSTAIS

SEQ ID NO: 11261 - protein, 202 aa, Triticum aestivum
  misc_feature (73)..(73): Xaa can be any naturally occurring amino acid
  misc_feature (118)..(118): Xaa can be any naturally occurring amino acid
  misc_feature (147)..(147): Xaa can be any naturally occurring amino acid
  misc_feature (179)..(179): Xaa can be any naturally occurring amino acid
MRPPRGGGGFRGRGGDRGGRFGGGGRGGGGRGRFGGGGGGFRDEGPPAEVVEVSTFLHACEGDAVTKLTNEKXPYFNAPIYLQNKTQIGKVDEIFGPINESYFSVKMFEGVIATSYNXGDKFFIDPMKLLPLSRFLPQPKGLDSRRXGGRGGRGGGRGGFGGRGGFRGRGAPRGRGPPXRGGGRGFRGRRQILGCSFKFAVC

SEQ ID NO: 11262 - protein, 108 aa, Coprinopsis cinerea okayama7#130
MRDRDTGRSRGFGFVTYSATEEADAAIASLHDQELDGRRIKVNIANARGSGGGGGGGYSGGGGYGGGGYSGGGGYGGGGYGGGGYNQGGQGGYGGGGYNQGGGYGGGY

SEQ ID NO: 11263 - protein, 381 aa, Mycobacterium sp. JLS
MSSPQQRHQRVVVVGAGPCGLAIARQLLHEQRIEPLVLDRATAPASTWRDRYEGFRLNTCGYWSHLPGQPIPRRYGRWPKRDDMVDYFDSYVRRQRIPLSLGVTVTRIDRDGDRWLITTDGDTYTADAVVIATGNYHTPALPAWPGMEGYTGDLLHSADYRNPWPFAGRDVLVVGSGNSATDIALQLSDEVAGRVRLAVREPPHLMPRSAAGIPVDAFSAAFSRLPVPVIDHAAALASRLWFGDLTSAGLPAPRRGIYRALLDDGSIPTLGDELVPQIKAGRIEVVAAVESFEGDSVVLADGRTIRPDVVIGATGYRHGLEPLVGHLDVLDEDGAPLVNGLPPAAPGLWFAGYEEPIIGPLQSFRLQAGPLAAEVAGFAAG

SEQ ID NO: 11264 - protein, 371 aa, Triticum aestivum
  misc_feature (61)..(61): Xaa can be any naturally occurring amino acid
  misc_feature (78)..(78): Xaa can be any naturally occurring amino acid
  misc_feature (92)..(92): Xaa can be any naturally occurring amino acid
  misc_feature (306)..(306): Xaa can be any naturally occurring amino acid
  misc_feature (361)..(361): Xaa can be any naturally occurring amino acid
MPATAGRVRMPANNRVHSSAALQTHGIWQSAIGYDPYAPENNKQQAPSSSVSANAAAAAAXPAAEAAAPPSSDPGASXSENAYTSFQGLLAXSPGVTGSNSDETRGACKKCGRVGHLTFQCRNFLSVKELAMDDDIQAGMLSAAQAKAKFEEITKKASGARDADEEGSDEEDEDEIDSDSSDSDIDPELEKIIAERERAKSRGGKRSGEEDKKTSRHKSKSRGRSKHRRSRKSDSEDDSEEERTKDKKKNRRKKHRSSDEDSESDSDRKRHMKSRKDRKRRRTHRRKDDSSEDDESGGEERRHHRXHKRRHHRRDASGSDSDGSESPHERKRSSKQKSHKRSESHGLGEDERHCPQGASRXGEKSREHKRG

SEQ ID NO: 11265 - protein, 967 aa, Debaryomyces hansenii CBS767
MSPSKDQAPVKKDSVSSEPEPQLSKKQNPPKEEELSEEDQHLKDELEMLVERLNEPSQKVELYNEYLNSLKAFIKDSTTSMTAVPKPLKFLRPHYPLLTDLYDKWCGDYKGDSDLVIKLADILSVLAMTYSDDGKNDSLKYRLLSSSDTIVDWGHEYMRHLALEIGISYQENLGSDEDLINRLIKLAMQIVPFFLEHNGEADAVDLLLEIENIDKLPQFVDENTFTRVCLYMVSCVPLLAPPDDVSFLNTAYAIYLSHNQLTQALTLAIKLDDEKLMRQVFEVTDDELMHKQLGFILSQQNSSFKYGGDNDEVQECVSNTKLHEYYGYLVKELNLLDAKVPEDIYKSHLENSKFGLGNSGSIDSAKQNLASAFVNSFVNLGHGSDKLIQTEEDNKSWIYKTKGHGMISTTASLGSIHQWNINDGLQHLDKYTYSSEDEVKAGALLGTGIVSANVHDDVEAALALLQEYVSDPKKIFQTSAINGLGIAFAGSSNEEVLSLLLPLVSDLDISIEVSSLAALALGHVFVGTCHGDITSTILQTLLERDFTQLTNKFIRFMSLGLGLLYMGKTEQVEDVLETIDAIDHPISKTLKVLVNICAYAGTGNVLQIQSLLQMCTAKPKDNFAEEKKLEESEEDQLKKEDEEGQAKVKADPSADVEMEDTANDTNDKTNDANDKDSKKEEKSESTPEEDDDEEDEELYQGFAVLGLACIAMGEDIGQDMAFRHFSHLMHYGNPLIRRAVPLAMGLVSTSYPQMKVFDTLSRYSHDPDLEVAQNAIYAMGLVGAGTNNARLAQLLRQLASYYIKSADSLFMVRIAQGILHLGKGTLTLTPFNTERSILSKVSLASLLTISVALLDPKSFILNDSNSETTHELLYYLTPAVKPRMLVTVDESLNPIKVNVRVGQAVDVVGQAGKPKTITGWVTQSTPVLLNYGERAELENTDEWISLTNSLEGVVILKKNPEYMEVEN

SEQ ID NO: 11266 - protein, 80 aa, Oryza sativa
  misc_feature (34)..(34): Xaa can be any naturally occurring amino acid
MSEEAGRPLPKFGEWDVNDPASADGFTVIFNKAXDEKKGGNGQDTDSPCKETRTERVESYAPKTNSKKWFCCVTSSPTQS

SEQ ID NO: 11267 - protein, 314 aa, Debaryomyces hansenii CBS767
MLIEAPQIDLKSFQHACINVIDNKYWFHETSAEGFPGQAFALEIDQILYHVHSQYQDILIFKSTTFGNVLVLNGIIQCTERDEFAYQELITHLPIMCHASPRRVLVIGGGDCGVVRELIKHLDEGVDEITMVEIDDMVIKLLAKFLPEMAKFHDHPRVKMIIDDGFKYLKSLSAQAHEKYDVIITDSSDPDGPAEDFFQTNYFKLLSNALNPDGIVIMQSSENIWLNINYLSQLMQKANRVFNNVAYSQCYMPSYTSGQLGLIVATNDTSNVLSIPSRKFSPEKELHLFKYYSSSVHQASFVLPTWAHKTLNNN

SEQ ID NO: 11268 - protein, 520 aa, Brassica napus
MATMAAIGSLKVPSSSSNHTRRLSSSSQRKTLSFSSSSLTGEKLNPTQEIIISNLPRGNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 11269 - protein, 567 aa, Triticum aestivum
MASPALISDTDQWKALQAHVGAIHKTHLRDLMTDADRCKAMTAEFEGVFLDYSRQQATTETVDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAESAKGRQLRFLANVDPVDVARSIKDLDPATTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLHSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 11270 - protein, 1164 aa, Oryza sativa
  misc_feature (1125)..(1125): Xaa can be any naturally occurring amino acid
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSKPFYAILHRIDVGVVIDLEPARTEDPALSIAGAVQSQKLAVRAISRLQALPGGDVKLLCDTVVEYVRELTGYDRVMVYRFHEDEHGEVVAESRRNNLEPYIGLHYPATDIPQASRFLFRQNRVRMIADCHAAPVRVIQDPALTQPLCLVGSTLRSPHGCHAQYMANMGSIASLVMAVIISSGGDDDHNISRGSIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEVQIKDIIEWLTMCHGDSTGLSTDSLADAGYPGAAALGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSSRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVSYLSSFSIPEGNTYSHAGISCVEFGRGQVKYLVKFIFVGHICCSTXRFACPGEGLPPEIVQDMFSNSRWTTQEGDLGSSDGEPSL

SEQ ID NO: 11271 - protein, 420 aa, Oryza sativa (japonica cultivar-group)
MAVEYHCCGAAFFEHVVIIVVLVLFAGLMSGLTLGLMSLSLVDLEVLAKSGTDQDRKHAAKILPVVKNQHLLLCTLLICNAAAMEALPIFLDSLVTAWGAILISVTLILLFGEILPQSICSRYGLAIGASVAPLVRVLVWVCFPVAYPISKLLDHLLGKGHTALFRRAELKTLVTLHGNEAGKGGELTHDETTIIAGALELTEKKAKDAMTPLCQTFAIDINAKLDRDLMQKVLDKGHSRVPVYYEKKTNIIGLILVKNLLSINPDDEIPIKSVTIRKIPRVSEDMPLYDILNEFQKGHSHMAVVIRQTNANYAAEPPANDGGTLEVAISIDDKHGEKVVKNLPPLRRWKSCPNSQNSNRGNRNRKWSKDQSDVLQIHEEPLPTLNEDEEAVGIITMEDVIEELLQEEIYDETDVHVEEQ

SEQ ID NO: 11272 - protein, 199 aa, Oryza sativa
MGEEANCNVAMESAAPKENGHTTDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESRE

SEQ ID NO: 11273 - protein, 380 aa, Orpinomyces sp. OUS1
NSSVSSYIDKEDEEMSESSIYLKKFSIYTASASQPKNPRPSGTLPAICKEDCGEDAFFILDQPSFSALGIADGVGGWTFLGYDPSLFAWDLMNCCKECATTNSWPDPQDILVGGYNKVVEKNEIEAGSSTACILTLDKTTGTVYSSNIGDSGFIVIRNGKVTYQTHELQHYFNAPYQLTVLPDEMKNDPINIMDSPNDAIIDQCTVEEGDVIVLGTDGLWDNIFNEEIITKLASSIEKIDDIQIQIKQINKKLYQLKQKRQQKEHNGLKENTENIIESNKNENENKNQNNDQVMENQINEDKLKENKIVEKNEIDIKNESENEIVEEEIKINNDEVKDNNNADNADNADNEVKTEPNKIKETEYVNKENSVSSLQDINEF

SEQ ID NO: 11274 - protein, 432 aa, Haemophilus somnus 129PT
MTTSATLFSRAQQVIPGGVNSPVRAFKGVGGTPVFIEKANGAYIFDTEGKQYIDYVGSWGPMILGHNHPSILSAVLKTAENGLSFGTPTPLEIELAELICQLVPSIEMVRMVNSGTEATMSAIRLARGYTKRDKILKFEGCYHGHSDSLLVKAGSGSLTLGQPSSPGVPEDFAKHTITCEYNNLQSVKNAFEQYPDQIACVIVEPVAGNMNCILPKQDFLQGLRQLCNEYGSLFIIDEVMTGFRVALGGAQSYYEVTPDLTTLGKVIGGGMPVGAFGGKKEIMQYIAPTGPVYQAGTLSGNPIAMSAGIACLNELKKEGNEQRLAMLTKKLALGLKNLANQHNIPLVVNYVGGMFGIFFTTQNEVTSYQQAIQCDVEKFNLFFHKMLEQGVYLAPSAFEAGFMSLAHTDADIDRTLQAADIAFASLCSSSFS

SEQ ID NO: 11275 - protein, 243 aa, Brassica napus
  misc_feature (233)..(233): Xaa can be any naturally occurring amino acid
TPACSDSRRAIMSLFSFSLGLTILVIIISGLVFTFTRWNSKTKKRLNLPPGPPGWPVVGNLFQFARSGKQFFEYAEELKKTYGPIFTVRMGTRTMIILSDAALVHEALIQRGSLFATRPAENPTRTIFSCDKFTVNAAKYGPVWRSLRRNMVQNMLSSTRLREFGSVRRSAMDKLIERIKSEGKEHDGLIWVLRNARFAAFCILLEMCFGIAMDEESIEKMDEMMKTVLMTVXPRIDDYLPIL

SEQ ID NO: 11276 - protein, 448 aa, Streptococcus pyogenes MGAS8232
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDETDKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPIEANIYTMTMEERNEAGIIDLPSTLHNALKALQKDDVVQKALGYHIYTNFLEAKRIEWSSYATFISQWEIDHYIHNY

SEQ ID NO: 11277 - protein, 116 aa, Brassica rapa subsp. pekinensis
AVMNSTQGKYFGTKFAVNMWKPEVQVPNEFSLAQTWLVSGVGTTRNTIEAGLQANGYQGTGCYNNDCAGFVQRSNKIAVGGTYNTASQYDGDQYELSVLIWKDGENWWLQIGEEIV

SEQ ID NO: 11278 - protein, 398 aa, Streptococcus pyogenes MGAS8232
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSKGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 11279 - protein, 358 aa, Oryza sativa (indica cultivar-group)
MATAGVTEHLLSPRAGAGDDMSAGDGEGWCNALAKYEALASSLPSCHGLGSAPYRRYGGFWYPAHLMPATLAARDTFVARPSDVILATMPKSGSTWLKALAFCVVHRGRHTPAAGQHPLLHSSPHDLVPFLHSIYEISRSCRVAPGHRLDAMPSPRILAVHEPLSSLPASVKASGCRVVYLCRDPKDAFVSLRHYLDEIKPEGSTMTPFDEAFELLCDGVSPYGPMWDHAAEYWKESLARPEEVVFLRYESLKEDGVGSVRRLAGFLGCPFTGEELAGGVPETIVELCSMERMRNVEANRDGEHGATWSSFKNSAFFRKGEVGDWKKHMSPEMARRLDDVVEEKLRGSGMSLIRHRQY

SEQ ID NO: 11280 - protein, 520 aa, Aspergillus oryzae
MAKVDQKVVLVVIDGWGVAGPDSRKDGDAILAAETPFMSGFAEADSKTAQGYSELDASSLAVGLPEGLMGNSEVGHLNIGAGRVVWQDSVRIDQTLKKGELNKVDNVVASFKRAKEGNGRLHLLGLVSDGGVHSNITHLIGLLKVAKEMEIPKVFIHFFGDGRDTEPKSATKYMQQLLDQTKEIGIGEIATVVGRYWAMDRDKRWDRVEIAMKGIVSGEGEESSDPVKTINERYEKDETDEFLKPIIVGGEERRVKDDDTLFFFNYRSDRVREITQLLGDYDRSPKPDFPYPKNIHITTMTQYKTDYTFPVAFPPQHMGNVLAEWLSKKDVQQCHVAETEKYAHVTFFFNGGIEKQFAGEVRDMIPSPKVATYDLDPKMSAEAVGQKMADRIAEGKFEFVMNNFAPPDMVGHTGKYEAAIQGVAATDKAIGVIYEACKKQGYVLFITADHGNAEEMLTEKGTPKTSHTTNKVPFIMANAPEGWSLKKEGGVLGDVAPTVLAAMGIEQPEEMSGQNLLVKA

SEQ ID NO: 11281 - protein, 341 aa, Streptomyces avermitilis MA-4680
MRIGVLTAGGDCPGLNAVIRSVVHRAVTMYGDEVIGFEDGYAGLLDGRYRALDLNAVSGILARGGTILGSSRLQRDRLREACENAQDMAREFGIDALIPIGGEGTLTAARMLSDAGLPVVGVPKTIDNDISATDRTFGFDTAVGVATEAMDRLKTTAESHQRVMVVEVMGRHAGWIALESGMAAGAHGICLPERPFDPAHLVKMVEERFARGKKFAVLCVAEGAHPVVGSMDYSHGAIDQFGHERFQGIGTALAAELEHRLGKEAKPVILGHIQRGGTPTAYDRVLATRFGWHAVEAAHRGDFGRMTALRGTDVQMVPLAEAVTELKTVPKDRMDEAESVF

SEQ ID NO: 11282 - protein, 231 aa, Oryza sativa
  misc_feature (153)..(153): Xaa can be any naturally occurring amino acid
MAPPPISSSLSLMASNPIPSPPVAKPGRPLTVAACSNSSSSSSSSSPSSTSCSAAWSLPVATSAGRRGLLALGAGFLASPGLLCPAGDAGATRIEYYATVGDKLCDMNVVKSGLGYCDVEVGTGAQPPRGQLINVHYTARFTDGIVFDSTYKXRGRPLTMRLGAGKILRGLEQGISGGGGVPPMLVGGKRKLMIPATLAYGPEPAGCFSGDCNIPGNTTLLYDIFLVGFYK

SEQ ID NO: 11283 - protein, 460 aa, Propionibacterium acnes KPA171202
MGINNLLSDIGLPGLGCKPVLTDSKPRVVIVGAGFGGLAAAEKTAEAGCDVTLIDRNPYTTFQPLLYQVATGGLNPGDVTYRLRSFAANNGPHTHFRRACVTGIDTENRIVEVDNGDPISYDYLVLSQGVGANFFGTPGAAENSYTIYTRASSLRARDAIFTYLEDLDTQRDKTFDVIIVGGGPTGVEMAGTLAEMKSIGIPAIFPDVSTDRVHVTLVEMANHLLMPFDPALRHYTRRQLQKRGVDVRTNTAIAEVREDSVLLKDGQTLPADMVIWAAGVGAHKSVTNWGFEQGRGGRIATDGTLLVKGQDRIFAVGDGAINTEDPKPQLAQPAIQGGECVARQIVHLELGEPLEKFEYNDKGTMATIGRNSAVVQLSEKLKFTGIGAWLTWVTVHIFTLLGGRNRLQAMINLGARYIAFHREAGAIVGDVLSEEGKENMNKNALRDDDEKGAKPIDGKE

SEQ ID NO: 11284 - protein, 447 aa, Kineococcus radiotolerans SRS30216
MDRQQEFVLRTLEERDIRFVRLWFTDVIGTLKSVAIAPAELEGAFGEGIGFDGSAIEGLSRVSESDMLLKPEPSTFQVLPWRASDEHQGTARIFCDILTPDGQPARSDPRFVLKRALDRAAQRGYTFYTHPEIEFYLFKTPLERGAVPEPVDYVGYFDNHPGSTTTDFRRTAISTLESMGISVEFSHHEGGPGQNEIDLRYADALTTADNIMTFRTVLKEVARDQDVYASFMPKPLAGEPGSGMHTHLSLFDGDANAFYEAGAEYQLSRTGRQFIAGILRHAAEITAVTNQFINSYKRLWSGGEAPSYVCWGHNNRSALVRVPMYKPSKGQSVRIEYRALDSAANPYLAFALLLSAGLKGIEEGYDLPDGAEDDVWSLTDAERRSMGIEPLPQSLEHAIAVMERSELVAETLGEGVFDYFLRNKRQEWADYRAQVTPFELQRYLPLL

SEQ ID NO: 11285 - protein, 513 aa, Candida glabrata CBS 138
MSSDEEDFNDIYGDEHQDQQQTVSNESKPVDSTTAPSTESASVPMDPLAALQALSSNLNNSNNTDNNNDKDTSSGSQTTADGNAVSSEQNGSNVSSEPQVSNQTQNSEQRESIEEANRRQVKADLSRENCKMFIGGLNWETTEDGLREYFSKYGNVVELKIMKDPNTGRSRGFGFLSFDAPSSVDEVVKTQHILDGKVIDPKRAIPREEQDKTGKIFVGGLGTDVRPKEFEEYFSQWGTIIDAQLMLDKDTGRSRGFGFVTYDSPDAAEKVCESRYREFKGKQIEIKRAEPRHQQKQAGQQAVSPPVAGMGMNPMSNPMANPMAGMYQNPMMGGFNPMFNPQAMQDYYQKMQEYYQQLQQQTGMDYSQMFQQQMSMMMPGFQMPPMNADGSGSPLNNAGSENTPSGDDHNGSDNSSSSNVQTIGGDSNDSNSASNERNEDGSNRMKKNSLPKNIPRGPRGPSERNDRGSYHRDRSGGSRHGGYHGSSNGSYRRERGGYNGGRRSNGYHPYNRS

SEQ ID NO: 11286 - protein, 277 aa, Dehalococcoides sp. CBDB1
MRFTEGHFKGCQEYNCYYQALLPNGSPKAIVLVVHGLGEHSGRYSELAHYLADRSYAVYAYDHFGHGKTDGKAGYVSSYDVYIYDLISAFSMVQAKHPTSKIFIFGHSMGGLITAAYASKNQYDAAGLIFSSIALKPNTGMPGVINQLIKPLSKIAPMLGVRKINASTISHNKDVVKAYNEDPLVLHHRMSAQMAAEFLRICQDLPDFLKNISLPSLIIHGEEDHLVNIKGSRELVQRIRSKDKTLITYPGMYHEVLNEPDCPQVWNDLFFWLENHI

SEQ ID NO: 11287 - protein, 351 aa, Thermoplasma volcanium GSS1
MNPGCRLRGPMGYPDYLTGPLSLSCINIKTKRNIQKAYFRMFDVNPMPIDPQVRKYLDAMSKVSVPELNKTPIEDLRKIFDTPASGAPKVKISVVEDMILDTDAAKLPARLYDDSNSDSLVLYFHGGGFVFGSIETHDSLCRRIAKYSGSKVISVGYRLGPENKFPVAQIDAFNSYLYVLKRSEELGVDSDKIALMGDSAGGNLAAVASLMARDKGIKLPRLQVLVYPSTGPDMTSKSYLEYSSIYLTKELLNWFSSQYLNSIEDALNPYFSPILADLSGLPEAIVVTDEYDPLLEQGETYSATLRDSGVPVTSIRVNGMIHGFLSNFHLFRAADVSLMMISGAIHTILES

SEQ ID NO: 11288 - protein, 861 aa, Mycobacterium sp. JLS
MAEAHPVGFQWVVEAKARGTEVVHIDPRFTRTSALADRYVSLRAGSDIAFLGGVINYILSNELDFREYVTAYTNASFIVDERFSDAEDLDGLFSGYDDATASYDPSTWQYQTTDPEEGGAEAKEQSSGDRSGSGGPPVEGGAGDIPRDPTLQDPRCVYQILKRHYARYTPEMVERVCGVPAEQFLEVARKWAENSGRERTAALVYSVGWTQHTMGAQFIRAGAIIQLLLGNIGRPGGGVFALRGHASIQGSTDVPTLFNLLPGYLAMPHAGQETLADYLDDIKSRNQKGFWYNADAYMVSLLKEYWGEHARADNDFCFDYLPRISGDHGTYRTVMDMVDGKVFGYFLLGQNPAVGSAHGRLQRLGMANLDWLVVRDLVEIESATFWKSGPEVETGEITPQTCRTEVFLFPAASHVEKAGTFTQTQRMLQWREKAVEPPGDARSELWFFYHLGRILREKLAGSTDERDRPLLELSWDYVMDGDEPSGEDVLRRISGVDLTSGRAVDDYMSLRADGTTMSGCWIYSGVYADEVNQAARRKPHDQQGPYENEWGWTWPMNRRVLYNRASADPQGRPWSERKKLVWWDTEKQEWTGYDVPDFEKHKPPDYRPAPGAVGVEALHGDDPFIMQADGKAWLFAPNGLADGPLPTHYEPHESPVRNPLYAQQGNPARKVYGRADNPSNPSPPELHGEVFPYVFTAARLTEHHTAGGMSRQLPYLAELQPGLFVEVSPQLAAERGLTHMEWAHVITSRAAVDARVFVTDRMRPLRIDDHVVHQIWMPYHWGNAGLIDGDVVNDLLGVVADPNVFIQESKVATCDIQPGRRPRGPALLEYIAMYRDRARITVDTGTDLDTTKRSTEHTEET

SEQ ID NO: 11289 - protein, 453 aa, Oryza sativa (japonica cultivar-group)
MASTAARRLRELQGQAGNKTCVDCAQRNPQWASVSYGVFMCLECSGKHRGLGVHISFVRSVTMDSWTEAQLRKMEAGGNDRLNAFLAARGVPKETPHVAKYNSNAAAAYRDRIVAVAEGRPWTDPPVVKETPGSGAPAPTRKPPLPAGGGGGGGGGWDDWDDDFRPDMRRNQSVGSFGESGAESGRQPPRSKSTQDMYTRQQLEASAANKDSFFARRMAENESKPEGIPPSQGGKYVGFGSSPAPSANRNGAAAQGDVMQVVSQGIGRLSLVAASAAQSAASVVQVGTKEFQSKMREGGYDQKVNETVNVVANKTAEIGSRTWGIMKGVMALASQKVEEYAKEGGNGWGDDWQRREQGSEPYHRFERETNGNGWNSSSHDGSSKNYNSNSWDDWDEPVKKDEPAKERQSSDSWAGWDDGKDDNFDSYNHSTPSKGSNQNGTTGGSYWTEGGFR

SEQ ID NO: 11290 - protein, 176 aa, Brassica rapa subsp. pekinensis
KAIFKPPTPIRGGIPVLFPQYANTGPLPSHGFARQRFWEIDAHPPPLPSHPSSSAHVDLILKSSEADSKIWPNKFVYRLRVALGHGGDLILTSRVKNSDVKPFNFTVGLHPYFSVSDISKIQVEELQNLDYLDRQKNRTRFTDHGKFITFSSQLDRLYLRTPKKIRIVDHNKKKTI

SEQ ID NO: 11291 - protein, 207 aa, Haloarcula marismortui ATCC 43049
MSLTHRDVATVGIGGPVGSGKTSLLTALVPELRDQGLDVGVIANDILTQEDADVLRERFAGVVPEDLVAGVETGACPHTGIREDPSMNLQQIDSFLADHPELDLVLVESGGDNLAATFNPELADYSLYVISVAEGEDIPRKRGPGVVDCDLLVVNKTDLAPHVGADLDVMEHDANEVRDGPVVFTNCKDETNIDTVLSHVRDGVLFA

SEQ ID NO: 11292 - protein, 201 aa, Brassica rapa subsp. pekinensis
PGTDTAAAVVVWAMTYLIKYPEAMKKAQDEVRNVVGDKGYVSEEDIPNLPYLKAVIKESLRLEPVIPILLHRETIADAKIGGYDIPAKTIIQVNAWAVSRDTAAWGDNPNEFIPERFMNEQKGVDFKGQDFELLPFGSGRRMCPAMHLGVAMVEIPFANLLYRFDWSLPKGIKPEDIKMDVMTGLAMHKKDHLVLAPRTHI

SEQ ID NO: 11293 - protein, 326 aa, Candida albicans
MTGSSSQFQQLEKLGEGTYATVYKGRNRATGALVALKEISLDSEEGTPSTAIREISLMKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQHPHQPIIDQQY

SEQ ID NO: 11294 - protein, 544 aa, Listeria monocytogenes str. 1/2a F6854
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEDAALANNDATSAPATGGNGTPSSKKDPNGLVIAMPSVRKYAREKGVNIAEVAGSGKNNRVVKADIDAFLNGEQPAAATTTAQTEEKAAAPKAEKAAAKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 11295 - protein, 207 aa, Vicia faba
DYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGSRDDVSAVKKGGCCSA

SEQ ID NO: 11296 - protein, 459 aa, Leuconostoc mesenteroides subsp. mesenteroides ATCC 8293
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLAAVPAIILFVGVLRLPESPRFLVKTHKLAEARQVLTYIRTASEVDPELEDIQNTVAIESGAQKNITLSTLFSSKYRYLVTAGIGVAAFQQFMGANAIFYYIPLIVEKASGQAASSALLWPIVQGVILVLGALLYMVIADKFKRRTLLMVGGTVMALSFLMPSALNALVGADKFPPMLIVVFLSIFVAFYSFTWAPLTWVLVGEVFPLAIRGRASGLASSFNWLGSFAVGLLFPIMTAAMPQATVFAIFGVISIIAVLFIKFAVPETHGRTLEEIEAQGTNH

SEQ ID NO: 11297 - protein, 474 aa, Kineococcus radiotolerans SRS30216
MFSNAEEVLAFIAQEDVKFVDIRFCDLPGVMQHFTIPAKSLDLDALSEGQMFDGSSIRGFQAIHESDMKLIADPTSAFLDPFRKEKTLVINHSIVDPFTNEAYSRDPRNIAAKAESYLKTTGIADTVFFGPEAEFYIFDDVRFETNQRESYYHIDSIEAAWNTGRKEEGGNLGYKTRYKGGYFPVAPIDHFSDLRDEMVVELEKAGLQVERAHHEVGTAGQAEINYKFDTLKNAGDQLLLFKYIIKNVALRNGHTVTFMPKPLFGDNGSGMHCHQSLWKDGEPLFYDEKGYGGLSDLARWYIGGLLHHAPSLLAFTNPTVNSYHRLVPGYEAPVNLVYSARNRSACIRIPITGSSPKAKRIEFRVPDPSANPYLAFAAQLMAGLDGIKNRIEPADPVDKDLYELPPEEHANIKTVPYDLGSVLDALEADHDYLLEGGVFTPDLIETWIDYKRTNEIDPIRLRPHPHEFELYYDI

SEQ ID NO: 11298 - protein, 78 aa, Triticum aestivum
MEAALLPCLPARELQAVDRSLQSSHQIDVERHARDFMQATNKLQSCFIDMQREDHPTDVINAYRRRLLHERQPREGGC

SEQ ID NO: 11299 - protein, 289 aa, Leuconostoc mesenteroides subsp. mesenteroides ATCC 8293
MTNINGEYAKQNFPKQSQPEPGLQSKMSPTPDDGAASYVGHDRLKHKKALITGGDSGIGRSVAIAYAHEGADIVLNYLPEEEPDAQEVKGIIESLGRKIKLVPGDLKNESFSQKLIDEAVSFFGDLSILTLVAGKQQAEVDIANLSTQQITDTYATNVFSLVWLVKAALPHMQPGSSIITTNSIQAEQPSSFLVDYAGTKAAIKNMTMSLAKQLANRGIRVNSVAPGPIWTPLQIVGGQLPENIPTFGQSTPIGRAGQPAELAGAYVFLASNESSYVTGESINVTGGLK

SEQ ID NO: 11300 - protein, 296 aa, Desulfotalea psychrophila LSv54
MPVIRKNILGGTFMIVGATAVYGIIGNPVSHSMSPLMHNAAFESLGIDAVYVPFRVEDVESAVQGLRGLNICGVSVTIPHKEAVIPLLDEVDPVAGKIGAVNTIVSSMRDGRPFLKGFNTDWIGANRALQAVVSLKGKQVLLLGAGGSARAIGFGLLEAGAEVILCSRTPSRGRQLADEFGCLWLSLEDIGSVRADIVVNATSVGMAPQEDVSLMTVEQLSGVEAVMDIVYSPHRTRLLANADKAGCAIVSGLEMLLYQGVQQFELWQGREAPLAVMRHTLYRLLGYDAVLKEKEI

SEQ ID NO: 11301 - protein, 307 aa, Oryza sativa
MATELPTTNGHSAQDGENNFAVKAGLARMLKGGVIMDVVNAEQARIAEEAGASAVMALERVPADIRAQGGVARMSDPKMIKEIMETVTIPVMAKARIGHFVECQILEALGVDYVDESEVLTPADAVHHVDKHPFRIPFVCGCRNLGEALRRISEGAAMIRTKGEAGTGDVIEAVRHMRTVNAEIQRASSMSSTELYNYAKELGVDYNLLKETAKLGRLPVVNFAAGGVATPADAALMMQLGCDGVFVGSGIFKSGDAAKRAKAIVQAVTHYKDPKVLMEVSMDLGEAMVGINCGDLGEKDRLAKRGW

SEQ ID NO: 11302 - protein, 203 aa, Triticum aestivum
MMTRSLEPAAEQKASSSFGNLLSIFLRVSSSEPKPPRRSFDAEGVVGLGIVAAMSRACLTAQPIAIGAAARRRAREEDELSESYTCVITHVAAGAGEGGSMRKRVYFGFGDGGDSWFVEAAEEAPARADDFLSRCCLCNKRLDGLDIYMYRGEKAFCSSECRCHQMLMDDHAEKCGSEALRASSYSASPCSAPMSFSPSVAAA

SEQ ID NO: 11303 - protein, 226 aa, Desulfotalea psychrophila LSv54
MHSRKICVSLGQPTMPQALEASLRIFGADVIEVRLDYIDVPEIDPFVESLATDLLFTCRPTWEGGLFAGTEEDRLALLAEAVRAGAAYIDLELRSAEESHQYLRTYLAERETELILSYHDFESTATLAKLTGIIDQMQDAGADIGKLITTANSAADVVRVFQVLEYAAKKGLPLIAFCMGEAGAVSRVASCDLGGYMTYCCADGAEVTAAGQITISEMRGIFARYP

SEQ ID NO: 11304 - protein, 353 aa, Oryza sativa (japonica cultivar-group)
MTEQEHRAYARVGLLGNPSDMYGGKTLSFTISNFWATVHLAPSDDGGPLVIRPHPRHDLVDFASLPQLVTRLQNEGYNGGVRLLMAICKVFYSHCIQHGIALKEQNFTLSYDTNIPRQAGLSGSSAIICAALSCLLDFYNVRHLIKVEIRPNIILDAEKELGIVAGLQDRVAQVYGGLVYMDFGKEHMDTLGHGVYTPLDINLLPPLHLIYADNPSDSGKVHSTVRQRWLDGEEFIISSMEEVARLALDGRKALLDKNYRELARLMNRNFDLRRQMFGDDVIGTVNIKMVEAARSVGAAAKFTGSGGAVVALCPDGEAQVLLLEKACRDAGFLVQRIQVAPSPLPLTEGNPPF

SEQ ID NO: 11305 - protein, 534 aa, Frankia sp. CcI3
MRNAHTVEQVRGAEAPLLASLPPGALMQRAVHGLVAHAARRLGRVYGARVVVLAGGGDNGGDALWAGARLAARGARIDAVAPGRTHPEGTAALLAAGGRLHHPGPVVGAGGPAGAGQPIDDERLRILFAAADLVLDGLLGIGGRGGLREPYARLAVLAPPERTVAVDVPSGVDADTGAVAGPAVRASSTVTFGTRKRGLWLMPGAAHTGPVELVDIGLDLPEPDLCALDDADVAAALPVPSPTASKYSRGVLGLVAGSDAYPGAAVLAVGGALRGGAGYLRVVTAGHAEKVAGEAVGAVVSRAGDFVRMAHPEAVVTVIEAGDADTMLAAGRVQAWAIGPGLAPGPAVRTLLTALLATDLPVLVDAGGLDPLAEIIAARPAVAERAAPVLITPHEGEFQRFVSVALGRDAQATVAELADDRLAVLRRAAAATGAVILLKGARTLVVRPDGSALVNTTGSAWLGTAGTGDVLTGLIGSLLAAGLAPATAGAVGAYLHGRAAERAPAPLAANDLPALLPQVIGDLLDRRRMPRGVA

SEQ ID NO: 11306 - protein, 902 aa, Trichodesmium erythraeum IMS101
MIIPSQISTPKEAKPSKLEGIKENSNLLREPLASQLLEDTNHFTEEAVQILKFHGSYQQHNRDNRIKGQEKDYQMMLRTRNPGGFIPPQLFLTLNKLSNEYGNGTLRVTTRQGFQLHGVLKKNLKKVISSIIKSMGSTLGACGDINRNVMSPPAPYKNRPEYEYAKDYANKIADLLTPQTGAYYEIWLDGEKVISAQEASEVKVARLRNGNGTIFPNSEEPIYGTHYMPRKFKCAVTVPGDNSIDLYTQDVSLVVITNEVGELEGFNVLAGGGLGRTHRKEETFPCLAQEIGYVTKEDIFDFMKAIVATQRDYGDRSNRRHARMKYLLHDWGVEKFKAKLIEYFGKSIAPFKPLPEWKYLDFLGWHEQGDGRLFLGISVENGRVKDEDSFQLKTALRKIVDLFKLPMLLTANHNIILYEIKPQQQQAVEQILNKHGISTEKNIDPLVRYSMACPALPTCGLAITESERTLPGILGQIRLLLDKVGLGQEHFVVRMTGCPNGCARPYMAELGFVGSAADSYQIWLGGSPNQTRLAKPYIDKLHINNLEAELERIFIYFKQQRQPDESFGDFCNRVGIEAIRKFVTNYQSSFSMNTDINNSSLTSINSEKNIPIVTDVTETTPDTKSQEESTSKNLENNQEVIPMNSPVTQSTNMTQTTTTSTTISEAQPLSTHQTPKTPTFSSDTNTTISTPSTLGKQEGQPTVETTPSTSVQQEDKLTVETTSGQQEGQTTVEPTIPSTSGQQEGQTTVEPTIPSTSGQQEGQPTGEPTIPSTLGKQEGQPTVETTIPNLDKQEAQPNRESTISDNLDKQEAQPTSESTISANLDQQEAQPIGQLESSPDKPKDTSKMRHRVSVRDEIYTKLKEESKRQGKPVVQLATEAIAEYLEKIRKNESLTTTNETNF

SEQ ID NO: 11307 - protein, 623 aa, Ashbya gossypii ATCC 10895
MSNGRKAAGPQPFIKRDQLRRDFLRTRVKRNGPGKGGVKKEDPDSMEEQTRQMLQGGGGGVKREDDDYQEFPLRAANAQDLKNVKVHLLKFQSKKKIEPTKDFHLPVRLHRKDTRNVQFQLTRAEIVQRQKEIAEYKRRLEGEQGATPVSASSRESGGAEGTEGTPGDSGGALQPLAAEKPGPTTKLPEAGLAEDPTKVGLVKYDGKEQVDFDFQSGTIDPFADVAPDGGGRFKRGNSKRKTRQLKLLDEKARKLRFEEFYPWVMEDFDGLNTWVGSYEAGNSDSYVFLSAENDGSFTMIPADKVYRFTARNKYATLTIEEAEKRMEKNGAGAPRWLMKHLDNIGTTTTRYDRTRRRLKVVDGNDRQEEDDRVDNSEVELDYDEEFADDEEAPIIDGNEEENKESEQRIKKEMLQANAMGLRDDDAVEDEDDLFGEKKIDEEGEKVKKALLKTDLGALYESDDDSNPYLSESDLDDDDDKKIKKEDQDEDSLSRKSSPKKKASRSPHAGHIYVKSIKNCIIVISADKSILNNFPKGEWNPSSANHDNGAKDRTDFASRDGAPAPHELLTEQDIIDAVQGKEITLKQLIKELRSKFKHPENKDRLKLFVKRLVKLNGTFLELAR

SEQ ID NO: 11308 - protein, 545 aa, Bacillus clausii KSM-K16
MLMREETIGSLLERMAEESPSTEALVYPDRHLRLSYKDFNHSCRQLAKGFMQLGIQRGEHMAVWATNCPEWVTTQFATGKMGAVLVTVNTNYQQSELAYLLKQSDTTTLLVMEGYKGTSYLEMLYRLIPELQTAEPGKLESAEFPYLKHIVYLGKERKPGMWLYDDIVKMGDQVTDAALDRLMSELDVDDAINMQYTSGTTGFPKGVMLTHRNLIHNASNIAACMELSQQDRLCIPVPFFHCFGCVLGTLACVSVAATMVPVEEFHPEKVLHTVQAEKCTALHGVPTMFIAELNLRTFDTYDLSSLRTGIMAGSNCPVEVMKDVIEKMGITEITIAYGQTESSPVITQTRVDDSLERRTDTVGRALPNVEVKIVDPDTQEEVAAGVQGELLTRGYHVMKGYYKQPEETAKVLTGDGWLHTGDLAIMDEDGYCKITGRLKDMIIRGGENIYPREIEEFLYTHPSILDVQVVGLPDPKYGEIVSAWIRLKADHSLTAAEVQDYCKGQIAHFKIPQVVEFVDHFPMTASGKVQKFKLREQKEKQEEKA

SEQ ID NO: 11309 - protein, 245 aa, Bacillus cereus G9241
MIFVQQFEEVRSILEKAKKITVLTGAGASTESGIPDFRSANGLYADANVEMYLSRGYYNRSPKEFWKHYKEIFQINTFHQYKPNRGHRFLAELEEQGKDITILTQNIDGLHQVGGSKHVIDLHGTLQTAHCPKCKAGYDLQYMIDQEVPRCEKCNFILNPDVVLYGDTLPQYQNAVKRLYETDVLIVMGTSLKVQPVASFPQIAKREVGATTILVNEELTGQEYNFDYVFQNKIGEFVEGLSSIK

SEQ ID NO: 11310 - protein, 128 aa, Oryza sativa
  misc_feature (39)..(39): Xaa can be any naturally occurring amino acid
  misc_feature (46)..(46): Xaa can be any naturally occurring amino acid
  misc_feature (97)..(97): Xaa can be any naturally occurring amino acid
  misc_feature (102)..(102): Xaa can be any naturally occurring amino acid
  misc_feature (115)..(115): Xaa can be any naturally occurring amino acid
MSRVPETATHGCARRRRWRCVCAEICCHDAAACAKATPXSAGVVVXPRLQCISDAIRVCPHFPKQCIMFNDITPLLLRPGVFNDAVDIFVERYRGIXIAAVXGIDARGFIFVPAXIALAIGAKFIPLR

SEQ ID NO: 11311 - protein, 993 aa, Dehalococcoides sp. CBDB1
MRSQFSRRDFLKISGGTAGLFATAGLFRGPIKGVEPKMVDTRPRWVKETTTICPFDASGCGFICYTDSAGNLTNMEGDPDNPVNRGSACSKGASLIQLHNNKHRLEKVLYRAAGANDWEEKSWDWAFGEIAKKVKASRDSGFIAKNAAGKTVNRTEAIASLGGATLDNEECYLLSKMLRALGIVYLDSQARLSTASSLEALAASFGRNAMTNSWTDVSNANVILDMGGNPAENYPACFSHLGEAMGKGAELISVDCRLTRTAAKAGTFVAARSGSEIAFIGGLIKYVISDIEAHPANYNLTYITEYTTAGMVVNSNFKGPADLDGMFVGYNTASHSYDQSNWNFTKASNGEPVIDKTLTNPNCVFQLLKKQYARYTPEMVSATCGCSQADFAKVCAFFAATGKADKAGAIVYAMSSTQHTSGAQTVRAYAVLQMLLANIGVSGGGLFALGGESNVQGAADNGVSWNKLPGYLSAPNEDDTTFAAYASKAGDQSAASLLKAWYGSNASSSNGFGFGFLPKTDNNTNYSYVNAIKQMAAGKIKGAFAWGANPVVESAAAGQATQALAKLDWLVVTDMFESETAAFWKKDGVTSQTEVFLLPTACSYEKEGSVTNADRWIQWRNKAVSASGEAKSELEVISSLLSRLQTLYQGESGLNAEAITKLSWTYSTNPSAADVAKEMNGYKISSLQQLESPEDLRADGTVACGNSLYIGSFTNAGNQMARREQTGAFHAGWAWSWPMNTRIMNNRASVDLSGKPFNAAKPVISWNGMSWTGDNVDGKNAPFNQSGGLPFKGTNGNTAQLFAAMADGPMPEHYEPWESPVDNALSGTQNNPTAMVFEGDTQGSAGEYPVICTTIRTVEHSLGGQLTRNMPFLVELAPAAYVEISEQLASEKGIKAGDIVKLTSARGSVSVAAAVTKRLKPFSIGGKTVHQVAIPNHWGFMGIAQGDSANVLAPNTADSNSSTPEFKAFLVKVEKAADGTVPTITGRYKVLED

SEQ ID NO: 11312 - protein, 656 aa, Oryza sativa (japonica cultivar-group)
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKALSKTAASILESILKKDPHEAEFIQSIQEVVHSLEPVLVKNSQHVQILERLLEPERCFIFRVPWVDDRGEAHVNRGFRVQFSQALGPCRGGLRFHPSMTLSVAKFLAFEQTLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPELVFFLCSEDVFLCFRLVSTQKLIDLSMQVVGAWCKHMCVS

SEQ ID NO: 11313 - protein, 188 aa, Brassica napus
  misc_feature (152)..(152): Xaa can be any naturally occurring amino acid
DVSQFGVSLLPNSFLPLPIGVSLGRNSHVFSVDGCRRGRKTASTRSSSKFISAESLTLRHDSISRSEIAWMLADEHRKRVVIIDTSNKIGGDGDVPHFGIGRARRMQVPNVNLQYDVMIEAVENHMPETIIIDEIGTELEALAASTIAQRGXGPPTFTCVVEMISRNECRVHRRLDVTVDAILVGKLN

SEQ ID NO: 11314 - protein, 575 aa, Arabidopsis thaliana
MRAKNTITWNSLLIGISKDPSRMMEAHQLFDEIPEPDTFSYNIMLSCYVRNVNFEKAQSFFDRMPFKDAASWNTMITGYARRGEMEKARELFYSMMEKNEVSWNAMISGYIECGDLEKASHFFKVAPVRGVVAWTAMITGYMKAKKVELAEAMFKDMTVNKNLVTWNAMISGYVENSRPEDGLKLFRAMLEEGIRPNSSGLSSALLGCSELSALQLGRQIHQIVSKSTLCNDVTALTSLISMYCKCGELGDAWKLFEVMKKKDVVAWNAMISGYAQHGNADKALCLFREMIDNKIRPDWITFVAVLLACNHAGLVNIGMAYFESMVRDYKVEPQPDHYTCMVDLLGRAGKLEEALKLIRSMPFRPHAAVFGTLLGACRVHKNVELAEFAAEKLLQLNSQNAAGYVQLANIYASKNRWEDVARVRKRMKESNVVKVERVKVPGYSWIEIRNKVHHFRSSDRIHPELDSIHKKLKELEKKMKLAGYKPELEFALHNVEEEQKEKLLLWHSEKLAVAFGCIKLPQGSQIQVFKNLRICGDCHKAIKFISEIEKREIIVRDTTRFHHFKDGSCSCGDYW

SEQ ID NO: 11315 - protein, 417 aa, Shigella flexneri 2a str. 301
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 11316 - protein, 357 aa, Kluyveromyces lactis
MALIKASQARAVRENPHVSHQFNISSFLGDPFAIGTLSIALISWIIALAGSIAVAASTSPFPRFSWWTIVYEILLMITLFIVYCLDLVDYYRMFITCAVGIAFVYTTISTNSIVYYEGSKSGAAAAGFILLSMINLVWVIYFGGDNASPTNRWIDSFSLRGIRPSVLETSMAIARSQRLPVKPSYPYQYQEDLRSASLPDVHHDDEGEGHSGNMYAPELQSSTKYVSSTVLNGFENTDHSSSKPNLDVNAQNTATLNTQATGTFITDTTNANTDTTMGDTLGLYSDIGEELNSFPYTAEALYTYQADQTDAYEISFEQGEILRVGDIEGRWWKAKKSNGETGIIPSNYVKLLDGKSH

SEQ ID NO: 11317 - protein, 564 aa, Zea mays
MASSHIILPKEEEEEAAAAAVAEVGLGAAVEADHDHRPYQEQGPGKAALPFSATCVRISRDSYPNLRALRNASTMTLHDDDAAFVKLEEGDYGYVLDDVPHLTDYLPDLPTFPNPLQDHPAYSTVKQYFVNADDTVPEKVVVQKNSPRGVHFRRAGPRQRVYFESEEAKACIVTCGGLCPGLNTVIRELVCGLSHMYNVSNVFGIQNGYKGFYSSNYLPMTPKSVNDIHKRGGTVLGTSRGGHDTKKIVDNIQDRGINQVFIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANRMKSREDAKKQSTPVLANGEK

SEQ ID NO: 11318 - protein, 293 aa, Oryza sativa (indica cultivar-group)
MADDPSLDFGEFPQPFCSQQVVSFQPSVTTSGSGGMPVYLDCSSGMDSNTVMLSTTPSVVVSTTSSNTVADPGQNLKYGGPLAADWSRLELDVLKDGLQKYGNEQGIMKYIKIAASLPSKTVRDVAMKCQWLGKRENSRRRKSEDHHTGRKMKERKAKMAEPSLWGTNHPVQTDTRVPSFVSHNAIQNNQILTGATEIDRAMQQLLVQNDRLLDQIEANMLACQPQNNIELFHRTRRNINGLLQTMNQMPGIMSKMPPLPVSVNENLASFVLPGLTVPQFLGGSQLKEEPRGW

SEQ ID NO: 11319 - protein, 432 aa, Glycine max
RVSYVGPPRRNRKALGDIGNLANIRSAVEVKPNRPITRSFGAQLLANAQAAAAAGNNKKQACANVAGPPAVANGGVAVAKRVAPKPGPKKVTVTVKPKPEEVIDIEASPDKKEVLKDKKNEGDANSKKKSQHTLTSVLTARSKAACGITNKPKEQIIAIDASGPTRPLAAVEYIDDIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLSEGSASQHS

SEQ ID NO: 11320 - protein, 247 aa, Streptomyces clavuligerus
MPSALQGKVALITGRELGHRRATARALAPEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVTVRNAAVYQATKFGVNAFSETVRQEVTERGVRVVVIEPGTTDTELRGHITHTATKEMYEQRISQIRKLQAQDIAEAVRYAVTAPHHATVHEIFIRPTDQV

SEQ ID NO: 11321 - protein, 330 aa, Arabidopsis thaliana
MTMRSSSPSSSSSYSLAFTSLSNRLETIFKKASELCTLCDIEACVIYYGPDGELKTWPKEKEKVRDIALRYSLLNEALRRKKSVNLHGFLNKKKNKGLKNPNKKMKTSLKNVNILKYPLADHYPPDQVSPLIQSLELHVSKFQERLRFLESQKQNQTKPDHQSLTPSSLNHYTQSLNPSQFSLFMYNHGDNTLSQIPVSASNFNQDYFSALLEESELKNQLMKPEICGYDQNQNMSMGDITNNKFQDPCVSNKEAVQESVNNFGLNQLMYKEFYGCDQNMSMGNINSNSFQNPCVSNTQHYSAVEESVKNPWLNQLMQNELYGYGYAGFC

SEQ ID NO: 11322 - protein, 1250 aa, Oryza sativa (japonica cultivar-group)
MDLLPPATEPPAGGGGGGGGAPAPGRRLRRGVGFRSLKMVSVSMDEPLPAEPVGVAYGRLANGLAYYVRSNPKPRMRAALSLAVKVGSVVEEEDERGVAHIVEHLAFSATSRYTNHDIVKFLESIGAEFGACQNALTSSDETIYELLVPVDKPGLLSQAISVLAEFSSEVRVSAEDLEKERGAVLEEYRGGRNATGRMQDSHWALLFEGSKYAERLPIGTEKVIRTVPHETVRHFYHKWYHLSNMAVFAVGDFPDTQAVVEMIKEHFGQKAPPSCPPPVIPDFPVPSHVEPRFSCFVESEAAGSAVVVSCKMPADRIKTVTDYRDSLAESMFHCALNQRLFKISRRNDPPYFSCSSAADALVRPVKAYIMTSSCRERGTVEALESMLLEVARVRLHGFSEREISIARALMMSDIESAYLERDQMQSTTLRDEFLQHFLHEDPVVGIEYEAQLQKTLLPHISSAEVVKFAANFSTISSCVIKHFLHEDPVVGIEYEAQLQKTLLPHISSAEVVKFAANFSTISSCVIKVVEPHAHASLEDLKAVVLKVNTLEQDNAIPPWDEEQIPEEIVSQSPEPGSILDKVEHPGIGATEMILSNGMRICYKCTDFLDDQVVFTGFAYGGLSELSEDEYTSCSMGSTIAGEIGIFGYRPSVLMDMLAGKRAEVGTKVGAYMRSFSGDCSPSDLETALQLVYQLFTTKVEPREEEVKIVMQMAEEAIYAQERDPYTAFANRAREINYGNSYFFKPIRISDLKKVDPIRACEYFNNCFKDPSAFTVVIVGNIDPSISVPLILQYLGGIPNVGNAVLPLTRDDLKGLPFKFPETIIREVVRSPMVEAQCFVQLGFPVVLKSTTMTEDIHYVGFLSKLLETKIMQVLRFKYGQVYSVNVGVFLGGNKPSRSGDIRGDISVNFSCDPDMSSKLVDFVLEEISFLQNEGPSEEDVLTILEIEQRAHENGLQIQDEGRLKVREALTPQSMQMALQRVVPFPCRKQFTVVILMPKSSCWNSFKALLTWSPGGFSRDAKVVALNESVAGSVKSVFKPWEQRLDTSGGFLESNEGDPELLVFIPSHYKKVHVQIHLVLLIHLFLLSIACCVDLCMRFTSDVKIKSISVVGGADGTSPSRMRALVSELYLFCYLTHLFVPLNRMFINREGIDFNDAQNMQPVQEWELAENLQGVLEYQTRYSRFQGVANLTLHFPENFGGDTTKIYYIGLRGEATQNKRDVVATIVYEIMPNPSDHKTKSETGGGFSHVE

SEQ ID NO: 11323 - protein, 77 aa, Glycine max
  misc_feature (30)..(30): Xaa can be any naturally occurring amino acid
  misc_feature (52)..(52): Xaa can be any naturally occurring amino acid
TTVNRAGAGMVAPFTGLKSMAGLLTKKTNXDITCIATNRGRVQCMHVWPRVXQEELETLSYLTTMDDTQYQTEAEYL

SEQ ID NO: 11324 - protein, 135 aa, Brassica napus
  misc_feature (132)..(132): Xaa can be any naturally occurring amino acid
MASTTFRRFGVAAAAAAFIALAAFGSASASKTAFVKSTVKAHDVVIFSKSYCPYCKRAKAVFKELELKKDPYVVELDQREDGGEIQDALSDMVGRRTVPQVFIRGKHLGGSDDTVDAYESGELAKLLNISVXDDL

SEQ ID NO: 11325 - protein, 724 aa, Zea mays
  misc_feature (68)..(68): Xaa can be any naturally occurring amino acid
MVTPASTAPASTASAAAATGSGRGVLRLLRYPARCLLPLAAAPRTGTRLTTVLRARTQPAEPELVEQXVNTIRFLAVDAVEKAHSGHPGLPMGCAPLGHVLFDEFLRFNPKNPAWFDRDRFVLSAGHGCMIQYALLHLAGYNGVKMDDLKTFRQWRSRTPGHPENFETPGVEVTTGPLGQGFANAVGLALAEKHLASRFNKTDMKVVDHYTYVILGDGCQMEGVSNEAASLAGHWGLGKLIAFYDDNHISIDGNTDIAFTEDVLARYEALGWHTIWVKNGNTGYDDIRTAINEAKGVKDKPTLIKVTTTIGFGSPNKANTYSVHGNALGSKEVEATRSNLGWFHEPFHVPDEVKRHWSRHIDEGASLEAEWNARFVEYEKKYNQEAAELKSIISGELASGWENALRNYTPEMSPDATRNLSQQCLNALAKVIPGFLGGSSDLATSNMTLLKKFGDFQRDTPEERNIRFGVREHAMGAISNGIAVHSPGLIPYCATFFVFTDYMRASIRLSALSESGVIFVMTHDSVGLGEDGPTHQPVEHLFSLRAMPNILMLRPADGNETSGAYKIAVLNRKRPSVIALSRQKLPQLRGTSVDAVSKGGYIVSDDSSGNKPDFILIGTGSELEIAENAAGELRKKGRTVRVVSLVCWELFEEQPEEYKESVLPSEVTSRISIEAGVTFGWEKYIGQKGKAIGIDRFGASAPAGKIYNELGLTVEHVIAAAEAL

SEQ ID NO: 11326 - protein, 556 aa, Frankia sp. CcI3
MQRSSAGRGAEPTDTGAVRDVPRSPADGPSGPSAVGPAGYDTVLVIDFGAQYAQLIARRIRECHVYSEIVPWDMSVDEILARRPSALILSGGPKSVYSPGAPRVDPALFATGVPILGICYGHQVMAQALDGAVARTGTAEYGATRLSVSDPGVLFDGLPVVQQVWMSHGDSVTAAPPGFRVTASTPSAPVAAFEDPARRLYGVQFHPEVVHSERGMDVLRHFLLVGAGCRPTWTMINIVDEAVAAVRAQVGTGRLICGLSGGVDSAVAAALVHRAVGDALTCVFVDHGLLRAGEAEQVERDFVATTGVDLVHVKAADRFSAALSGVTDPERKRKIIGREFIRVFEESARELEVRAEAEGATIDFLVQGTLYPDVIESGSPTAAKIKSHHNVGGLPEDLRFDLVEPLRTLFKDEVRRLGEELGLPEEIVWRQPFPGPGLAVRIIGEVTPERLDVVRAADAVIREEIRKAGLDREIWQVFAVLLADVRSVGVQGDERTYGFPIVLRAVTSEDAMTADWARLPYGLLERISNRVVNEVPQVNRVVYDITSKPPGTIEWE

SEQ ID NO: 11327 - protein, 567 aa, Ashbya gossypii ATCC 10895
MVASTRRALRAIQKFHITTPIFYPNAKPHLGHLYSSLICDVQARWQKLRDSEVLFTTGTDEHGLKIQTASEQQGYASPKVFVDKLCTHFISLDEQANIGYTRFIRTTDKDHISNVLRLWELCKANGYIYKGEHSGWYSVSDETFYPATKVVQVIDGREFPVMDGSTVTEGAEYINTETRNRVIHQTEVNYFFRLSSFRERLISHLKENPGFILPPSRSAQILDLLLKAELPDLSISRPKTRLKWGISVPGDESQKIYVWFDALCNYVTSIGGVDAVLEDRPIANLVHSIPQGSVSGSSKEWWNATTHLVGKDIVKFHTIYWPAILLAAGLPLPEKVVVHGHWLSDGVKMSKSLGNVVVPEEMIEKYDTDPMRWFILEHDTIEHDASFSEEGLCQTRELLCSKWGNLLHRCGGPKFNIHRAVQKFHHKPITDLTKNNPELYGNLLSRLTTLADEIDQLLSKYDTANALRLIWSIINDANMVVQHGEPWKKPLEEQDLIIYTAVEAARIVSIAAQPFIPVLANRFLDRLDVHFDKRSLEYASVGADSSYGTTANVRGREVPISSLSRQR

SEQ ID NO: 11328 - protein, 665 aa, Listeria monocytogenes str. 1/2a F6854
MLPEEKNTFYITTPIYYPSGKAHIGHAYTTVAGDAMARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNFDLANDLGNLLNRTVAMINKYFDGEIPAYQGNVTEFDQILVDFKNNVVKEYEGSMDHMQFSVALNQLWSLISRTNKYIDETAPWALAKDEDKRTELASVMTHLAENLRIIAVLLQPFLTRTPGEIFLQLGLQEENLKKWDSIYGYGEIPAGTTVVKKGTPIFPRLDAEVEVTYIQDEMKGSAPAPAEEVAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEASSALPNGAKVK

SEQ ID NO: 11329 - protein, 436 aa, Pseudomonas putida KT2440
MNPRLAAARALAAVLSGKASLNSSLPAQLDKVDERDRGLTQDLAFGTARWQPRLDLLAAQLLQKPFKAADADVQALLLVGLYQLFYTRIPAHAAIGETVGCADKLKKPWAKGLLNAVLRRAQREGEELLAGMERDPVVRTAHPRWLQKALKAFWPEQWEAICAANNAHPPMILRVNRRHHSRDAYLALLAEAGIGASACQYSRDGIVLAEACDVRGLPGFAEGWVSVQDEAAQLSADLLELAPGQRVLDACCAPGGKTCHLLEAEAGLANMVAIDLEAKRLTRVRENLDRLQLDAELIACDARDTASWWDGKPFQRILLDAPCSATGVIRRHPDIKMTRQADDIPALATLQGELLDALWPTLEVGGMLLYATCSTLPTENTEVIKAFLARTPGARELDLATEAGLRQPHGRQLLAQEGGHDGFYYAKLIKIAASRG

SEQ ID NO: 11330 - protein, 174 aa, Triticum aestivum
MAPAVMVSSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 11331 - protein, 274 aa, Pseudomonas putida KT2440
MDQYVVFGNPIGHSKSPLIHRLFAEQTGQDLEYATLLAPLDEFSDCARGFFKQGSGGNVTVPFKEEAFRLCDSLTPRARRAGAVNTLSKLADGTLQGDNTDGAGLVRDLTVNAGVELAGKRILILGAGGAVRGVLEPILAHKPQSLVIANRTVEKAEQLAREFDELGPVVASGFAWLQEPVDVIINATSASLAGELPPIADSLVEAGRTVCYDMMYGKEPTPFCQWATKLGAAKVLDGLGMLAEQAAEAFFIWRGVRPDTAPVLAELRRQLARG

SEQ ID NO: 11332 - protein, 568 aa, Arabidopsis thaliana
MAAGRRKLSESAPLEEEGNDGNGAVVGKKPSKSVKRTTKKKVVVKDEPLEEISEFLVDNDDVLDKESIVSALKPKKTRTRKKASSDVEEVKTEKKVRRKRTVKKDKDVEDDLATIMDAEVSDVEEALAVESTDTESEEEEIDLSKHEGEDISHTYGWPPLVCCFGSAQHAFVPSGRPANRLLDYELHERMRDAKWAPEKYIRAPGGCAGGVAIALASLGGKVAFMGKLGADDYGQAMLYYLNVCKVQTRSVKIDGKRVTACSTMKISKRGRLKSTCIKPCAEDSLSKSEINVDVLKEAKMFYFSTHSLLDKKMMSTTIQAIKISKQLGNVIFYDLNLPLPLWHSSEETKSFIQEVWNLADVIEITKQELEFLCGIEPTEEFDTENNDISKFVHYPPETVEQLWHENLKVLFVTNGTSKIHYYTKEHNGAVSGMEDVPITPFTRDMSASGDGIVAGLIRMLTVQPDLMNNKGYLERTARYAIECGIIDQWLLAQTRGYPPKDDMEEEEDDEEEDEVESDPNGIRSITEKEYRTSKPYDEPDGPYVMKPVEEREYKKLELVGSMFEDGSL

SEQ ID NO: 11333 - protein, 372 aa, Escherichia coli O157:H7 EDL933
MKYDLIIIGSGSVGAAAGYYATRAGLNVLMTDAHMPPHQHGSHHGDTRLIRHAYGEGEKYVPLVLRAQTLWDDLSRHNEDDPIFVRSGVINLGPADSAFLANVAHSAEQWQLNVEKLDAQGIMARWPEIRVPDNYIGLFETDSGFLRSELAIKTWIQLAKEAGCAQLFNCPVTAIRHDDDGVTIETADGEYQAKKAIVCAGTWVKDLLPELPVQPVRKVFAWYQADGRYSVKNKFPAFTGELPNGDQYYGFPAENDALKIGKHNGGQVIHSADERVPFAEVVSDGSEAFPFLRNVLPGIGCCLYGAACTYDNSPDEDFIIDTLPGHDNTLLITGLSGHGFKFASVLGEIAADFAQDKKSDFDLTPFSLSRFQ

SEQ ID NO: 11334 - protein, 491 aa, Rubrobacter xylanophilus DSM 9941
MSEGSAATKTVESAVPARMDRLPWSGWHWLVIAALGITWILDGLEVTIVGNIAAVLTQPESGLDLTEGQVGLAGGIYIAGACTGALFFSYLTDRYGRKRLFLITLAIYLLFTVATAFSWNFWSFAVFRFLAGTGIGGEYSAIYSAIDELIPARVRGQVALAISGSYWGGAAVGSLLSVALLSEVFVSQFYGWRLAFGLGAVLGLCVLLIRRYIPESPRWLATHGRNEEAERVAAGIEERVKREKGLRELPPIDEDEKITIEQRESIGFGPILRAMFLMYPRRTVLGLVLMGTQAFLYNAVLFTYGLILSGYYGVPGGNVGYYLAAFAVGNLCGPLLLGRLFDRVGRVPMISGCYIASGAVLALSAFLFHQRVLDATTLTALWTLMFFFASSAASAAYLTVSEVFPMEIRAMAIALFYAIATGLGGVTGPIIFGQLIGTGDRSNLLVGFIIAGALMLVAAVFEMFLGVRAERRSLESVAAPLTAIEEQTGSA

SEQ ID NO: 11335 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQKVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 11336 - protein, 471 aa, Glycine max
  misc_feature (50)..(50): Xaa can be any naturally occurring amino acid
MKDLLEAVVPFDILLDRRKRANYLSSIGNNLETCTKPKVVQDAGLALASXYVPGMEITLSSRLKSLYSLYSKMKRKDISIDKVYDARALRVVVGDKNGTLHGPAVQCCYSLLDIVHRLWTPIDGEFDDYIINPKPSGYQSLHTAVQGPDNSPLEVQIRTQRMHECAEQGLAAHWLYKETGNPFLSIDSMDEPETEASSYFSKDLEEGNSSDILLSKYKSLKAGHPVLRVEGSHLLAAIIISVENDERELLVAVSFGLAASEAVADRRSFQIKRWEAYARLYKKVSDEWWFEPGHGDWFTCLEKYTLCRDGMYHKQDQFGRLLPTFIQVINFTEQEESEYWAVVSAVFEGRQVDWITSRSKFDLVASTSVEAGINNKVNLLRTMLSWEEQLRSEVSFMQAKHDAKLYDLHGSLGEVVIICWPHGEILRLKAGSTATDAAQRVGLEGKLVLINGQLVLPNTKLRDGDVVEVRI

SEQ ID NO: 11337 - protein, 457 aa, Zea mays
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRGFDPQWLSITFSKAIFLGNGLIAIVSGLFANLLAENLGFGPVAPFDAAACFLAIGMAVIMSSWSENYGDPSDSKDLMAQFKVAAKAIASDEKIALLGAIQSLFEGSMYTFVFLWTPALSPNEEDIPHGFIFATFMLSSMLGSSVASRLLARKLKVEGYMQIVFSISAVTLVLPVVTNILVPTSSVKGGSISIGGSLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMIGEDEPLNP

SEQ ID NO: 11338 - protein, 211 aa, Staphylococcus epidermidis RP62A
MNKLIDFSKGLVPVILQHAQTDSVLMLGYMNEEAYQKTLKEKKVTFFSRSKQRLWTKGETSGHFQHVESIHLDCDQDAILIKVMPQGPTCHTGSLSCFNSEIESRFKIQALAQTIHQSAKANQSNSYTQYLLKEGIEKISKKFGEEAFEVVIGAIKHNREEVINETADVMYHLFVLLHSLDIPFSEVEQVLAHRHQKRNNFKGERKEVREW

SEQ ID NO: 11339 - protein, 389 aa, Streptomyces albus
MTAGQAGRGAGADEVRAVLLAGGEGRRMGPLGTGRLKPLIPFGGTSRLIDFSLANARRSGLSEVLLLSQYEEQRLMDDLHQVWNSSRGFRVHFGPYDEAYRRLPADELPEKLPEPGGPRERGTADAFLHKAAHVFGGRPSEILILHADHVYRFDYRDMLREHRASGAALTLAYQRIERRYVHLFGMVEFDAGGNLTNFVEKPAEPSSDLVFAAFCVFDSACLQRYLERLDGTDWQHDISRDVIPAMLAGGERIRGHLVRGHWEDIGTVDRYLRAHLALLADPPTLPLDRMPLTIRPEVPRRFLSSAAGVRSSLVPSDVRNAGLVERCVLFPGVRIGEGATVRDSVLLPGAEVPAGARIDASIVLEDGSVQPVGPDRPEDASARTCPGIG

SEQ ID NO: 11340 - protein, 473 aa, Vibrio angustum S14
MATVITEERSNGTLSLEKSDLNKNVFIACIIAALAGLLFGLDIGVISGALPFIAKEFGLATHTQEWVVSSMMFGAAFGAIGSGPLSNKFGRKYSLVVASILFTVGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQIMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNAQTFWLYAVLNIIFLFVTLILIPETKGISLEKIEQNLMAGIPLSKLGKK

SEQ ID NO: 11341 - protein, 2211 aa, Debaryomyces hansenii CBS767
MAQISNPITPPMKSTGDRMMTLETQDGIAMQGYSFGAPVAAAGEVVFQTGMVGYPESITDPSYEGQILVITYPLVGNYGVPDRSLKDDDVPELPKYFESNKIHIAGLVVAHYTEEYSHFLAKSSLGQWLQEQGIPAIYGVDTRSLTKRLREKGSTLGRLALQKASSKSSEIIETSKWEQHFEIPEWDDPNVKNLVAKVSTKEPVLYTPKNDVKVGKNGKPLRILAVDVGMKYNQIRCFIRRGVELKVVPWDYDFSTEEYDGLFISNGPGDPSVMTSTVSTLQKVLEAGKTPVFGICLGHQLLARATGASTLKLKFGNRGHNIPCTSTISGRCYITSQNHGYAVDTNTLSSGWKELFVNANDSSNEGIYHDSKPYFSVQFHPESTPGPRDTEFLFDVFIQSVVDFNKSGVQKAVEFPGGLLEENRAAHPKVDAKKVLVLGSGGLSIGQAGEFDYSGSQAIKALKEEGIYTVLINPNIATIQTSKGLADKVYFLPVTADFVRKVIKHERPDGIYCTFGGQTALGVGIKLKDEFEGLGVKVLGTPIDTVITTEDRELFSQAMDEINEKCAKSAAANNVSEAIDAANSIGYPLIIRAAYALGGLGSGFADNEQELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYVVVKIPRWDLKKFTRVSALLSSSMKSVGEVMSIGRTFEEAIQKAIRSTDYQNLGFNKTSALMSIDIDNELQTPSDQRLFAIANALSDGYSVEKVWKLTNIDKWFLNKLDGLIKFGNLVTTYGVKENLPVTVLKQAKQLGFEDRQIAKFLNSNEVAIRRLRKEAGVIPFVKQIDTVAAEFPAFTNYLYITYNADSSDVSFDDHGVIVLGSGVYRIGSSVEFDWCAVRAIRTLRENGTKTIMINYNPETVSTDYDEADRLYFETINLERVLDIYDLEQSSGVVISMGGQTSNNIALPLYRQNVKILGTSPEMIDSAENRYKFSRMLDRIGVDQPAWKELTSIDEAEDFAEKVTYPVLVRPSYVLSGAAMNTVYSRDDLASYLSQAVDVSPDYPVVITKYIENAKEIEMDAVAKDGKMIMHVVSEHVENAGVHSGDATLVVPPQDLDPETVGRIVEATAKIGKALDITGPYNIQFIAKDNDIKVIECNVRASRSFPFISKVVGTDLIEMATKAIMDMPFTPYPGEKLPEDYCAVKVPQFSFSRLAGADPVLGVEMASTGEVATFGKNKYEAYLKSLISTGFKLPKKNILFSIGSYKEKQELLPSIRKLHELGYKIFATAGTADFIKEHSIPVHYLEVLGEKEDQKSEYSLTQHLANNLIDMYVNLPSSNRFRRPASYMSKGYESRRMAVDYSIPLVTNVKCAKLLVEALARNISLDVSEIDAQTSHKTAVIPGLVNINSFVSSFDEFEATTRASLASGFTFNTFLPQTSDCSTISNIETLADAIESATNSAYTDFSLSIAASETNSEEAAYAAEDAGALFIPFNDFNKSKVSAISAHFASWPENKPIITDAKTTDLASVLLLASLHSRSIHITGVSSREDLGLIIMAKEKELQVTCDVSVYALFLSQAEFPQLDFLPTKEDQNALWSGLKNIDCFSIGVLPYLVSKALNKKFCPGLGTKETLPLLFNAVKEGRLTTQDIVERFHDNPVRIFNIPKQESSVEFDIDRLAASTNDSEVLTIARANLQGAVNRVSFHNETVCLGGEILAVNALGHNGVEPRARFGSVTGIPSSPALSNKKARMSFNDGARRPSLLREQSSIPAEFEKLGAELVSQPPTSSVSGDNNALINYIRKNNTFLRNSVLSVKDFTRSDLHSLFTVAQEMRLAVERQGVLDILKGRLLATMFYEPSTRTSASFDAAMQRLGGRVVSVASASSSVKKGETLQDTIRTLTCYADAVVLRHPSEESVDIAAKYSPVPIINGGNGSKEHPTQALLDLFTIREELGTVNGITVTFMGDLKYGRPVHSLCHLLRHYQVRIQLVAPKELAMPENIKKMLQDNGMLVVESEVLTPEIIAKSDVLYCTRVQEERFEDKEQYSRLKDTYIVDNKILSYAKQHMCVMHPLPRTNEIREEVDFDQRAAYFRQMRYGLFVRMALLAMVIGVDF

SEQ ID NO: 11342 - protein, 372 aa, Mycoplasma mycoides subsp. mycoides SC str. PG1
MKKKDYYEVLGVSKTASEQEIRQAYRKLAKQYHPDLNKSPDAHDKMVEINEAADVLLDKDKRKQYDQFGHNAFDGSSGFSSNFADFEDLFSNMGSSGFSSFTNIFSDFFGSNKSDYQRSTKGQSVSVDIYLTFKELLFGVDKIIELDLLTNCSVCFGSGAESNSDISICNNCHGTGEVLIQKNMGFFQFQQSAKCNVCNGAGKIIKNKCKNCKGKGKYLERKKIEVNIPKGIRPNQQIKLSQKGHASINNGVNGDLIIDIYLKESKVFEIVNNNDILMTYNISYLDAILGNEIIIKTLDGDIKYKLPKSINSNEFIIINNKGLYKSINKDKRGDLIIKVNIVVPKNLNKKEKELIEQIYEQTSFNPENNIDQ

SEQ ID NO: 11343 - protein, 348 aa, Haemophilus influenzae
VEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGLMPDCTTRFSYQGKPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKPIKDVLLDINKWGIDHTFECIGNVNVMRQALESAHRGWGQSIIIGVAGVGQEISTRPFQLVTGRVWKGSAFGGVKGRSELPQMVEDSMKGDIQLEPFVTHTMPLDQINEAFELMHEGKSIRTVIHY

SEQ ID NO: 11344 - protein, 212 aa, Pseudomonas syringae pv. tomato str. DC3000
MNELQDLIDNNARWADAINQEDPEFFAKLARQQTPEFLWIGCSDARVPANEIVGMLPGDLFVHRNVANVVLHTDLNCLSVIQYAVDVLKVKHILVTGHYGCGGVRASMQDRQFGLIDGWLRTIRDLYYENRDVLAKLPTEEERVDRLCELNVIQQVANVGHTSIVQNAWHRGQSLSVHGCIYGIKDGRWKSLDVTISGFEQLPPQYRLRPQD

SEQ ID NO: 11345 - protein, 512 aa, Zea mays
  misc_feature (303)..(303): Xaa can be any naturally occurring amino acid
MVLGALASAVASTGLLIVYGVLGALLLWKAARLLDRLWWEPRRLERALRAPGFLTRRPPPVGPCRCGATTSPHVAPFIHGAVLEHGKTCFTWFGPGPRVTVVDPDLARDVMANKFGHFEKPKFPALTKLFSDGVANHEGEKWVKHRRILNPAFHLEKLKLMLPAFSACCEELVSRWAAQSLGPDGSCELDVDPELQTLTGDIISRTAFGSSYLEGRKIFQLQAEQAERLMSIIDKFAVPGYMSLPTENNRRMRQINSEVDWILRGLIGKRMQAMKEGESGKDDLLGLLLESNARDDRQSGRPXQGLTMEEVMEECKLFYFAGMETTSVLLTWTMVLLSMHPEWQDRAREEVLADFVEEDQPGYDGLSRLKTVTMVLYEVLRLYPPATAFSRKTYKEMVVGDVTYPAGVTLELPVLFIHHDPDIWGGDAHEFRPERFAEGVARASKDSGAFLPFGWSPRICIGQNFALLEAKMALSMILQRFQFGLAPTYTHAPHRLITVRPMHGAQIKLSAL

SEQ ID NO: 11346 - protein, 451 aa, Thermoplasma volcanium GSS1
MTTMIMENEERTEKYNEDALRYSEYYKGKIQTMSKVPVRSLDDFSIWYTPGVAAVSRKIATDHDLSFELTGRWNTIAILTDGTRVLGLGNIGPEAAMPVMEGKALIFNYLGGVNAIPVPIRVSSREEFVSVAKSLEPSFGGINLEDIESPKCFFLLETLQKEMNIPVWHDDQLGTASITLAGIINSIRIVGKKIEEVKVVFNGAGAANIAAAYLFKAAGFKKENIILVDSKGVLQPERQDMDSLMLNNPWKYQLAIETNGERVKGDLKEALKGADILISAAKSGPDTVDAKLVKEMNNDPIVFVLANPIPEMWPEEAKENGAKIVATGRSDFPNQINNSLVFPGVFRGVLDARAKGVNFDVMVAASYEIANFVEEPTAEKIVPTMEEWELYPRLASAVATKTVELGLARKIDSKEGFYKRARDIIENNRNIYRKMMDLGLIRMMPNGERKY

SEQ ID NO: 11347 - protein, 492 aa, Beta vulgaris
MSSSTASLTVTADAELVFVPAPGMGHLKSAVELAKLIIQRNHRISIVILIINIPTTTSLINDFVHSQSRNNPYPTHLTFMTLPPLSNPPERSSPDFMRILIELHEPLVKQAVEERIRAGSSKLAGFVLDMFCTNMIDIATNLNVPAYIFFTSGANMLSLMFHFQSMNDEGVFDLTKDHISPNAEFDVPGFVNRVPEKVLPAVLIDKESGVPMLLNLVRGLRRSKGILVNSFTELETSGVQALLDQATEGGSIPAIYPVGPILELDSGSQGEDHVSILQWLDKQPSSSVVFLCFGSMGSFDANEVKEIANGLEKSGHRFLWSLRKPPSAGTTQPSQDQTFVEALPEGFVDRTAKIGKIISWAPQVSILSHPSVGGFVSHCGWNSTLESMWFGVPVATWPLHAEQQLNAFELIKELGLAVEIRMDYRHDWKTRKANFVVTAEEVENGVQKLMSLDEETKKRVRQMRDEGRKALEDGGSSHMSLARFIQDVLTFE

SEQ ID NO: 11348 - protein, 352 aa, Aspergillus oryzae
MDIALEVWDTFIGDRLYAALLPVSLSSSVSFPGFNHAANNTLSFFGASQPFIYEPATHLIYLEPSKYAYMSAWPRNNIYRQFLSFFLIVWIFGLITYFISATLSYIFIWDKTTVKHPKFLKNQIPMEIAQTMGSMPIMSLLTAPFLVAEVRGYAKLYDGFSDEPFPYYSIIQFPLFIAFTDFCIYWIHRGLHHPLIYKSLHKPHHKWIMPSPFASHAFHPLDGWSQSVPYHVFPFIFPLQKVAYVFLFGFINLWTVLIHDGEYVANSPVINGAACHTMHHLYFNYNYGQFTTLWDRLGGSYRKPNEELFRRETKMDKEEWKKQTEEMESILKDVEGDDDRKYLVEDESKKDL

SEQ ID NO: 11349 - protein, 215 aa, Medicago truncatula
MPPNPPKSSLLLHRINHTTTTTITNHHDLHCENNTLFINPVTSTIPNTIAHYHTHSISSDQLCSAVVQETTASITAVWSVVRRFDKPQAYKNFIKSCNLVGGNGDVGTLREVNLISGLPAARSTERLEILDEERHVISFSVVGGDHKLANYRSVTTLHPSAEGDGSGTVIVESYVVDIPSENTKEDTHVFVDTIVRCNLQSLAQTAENINNKCCS

SEQ ID NO: 11350 - protein, 252 aa, Salmonella typhimurium LT2
MKTVTVRDLVVGEGAPKIIVSLMGKTITDVKSEALAYREADFDILEWRVDHFANVTTAESVLEAAGAIREIITDKPLLFTFRSAKEGGEQALTTGQYIDLNRAAVDSGLVDMIDLELFTGDDEVKATVGYAHQHNVAVIMSNHDFHKTPAAEEIVQRLRKMQELGADIPKIAVMPQTKADVLTLLTATVEMQERYADRPIITMSMSKTGVISRLAGEVFGSAATFGAVKKASAPGQISVADLRTVLTILHQA

SEQ ID NO: 11351 - protein, 394 aa, Aspergillus oryzae
MSQNRPGVFSSLRMGEVVREKVQDGLTGETKEISYSQCKIVGNGSFGVVFQTKMMPSGEDAAIKRVLQDKRFKNRELQIMRIVRHPNIVELKAFYYSNGERKDEVYLNLVLEYVPETVYRASRYFNKLKTTMPMLEVKLYIYQLFRSLAYIHSQGICHRDIKPQNLLLDPSTGILKLCDFGSAKILVENEPNVSYICSRYYRAPELIFGATNYTTKTDVWSTGCVMAELMLGQPLFPGESGIDQLVEIIKVLGTPTREQIRTMNPNYMEHKFPQIKPHPFNKVFRRAPHEAIDLISALLEYTPTQRLSAIEAMVHPFFDELRDPSTRLPDSRHQNGPSRELPNLFDFSRHELSIAPAMNSRLIPPHARPALEARGIDIDNFTPLTKDEMMARLD

SEQ ID NO: 11352 - protein, 277 aa, Brassica napus
  misc_feature (79)..(79): Xaa can be any naturally occurring amino acid
  misc_feature (113)..(113): Xaa can be any naturally occurring amino acid
  misc_feature (183)..(183): Xaa can be any naturally occurring amino acid
  misc_feature (226)..(226): Xaa can be any naturally occurring amino acid
MLLLLIIILFVCKPWRFLPRSRSSPFSTFMVGDLQRPLVSHDENLIQGQSSEVSREFDLEEACFQNEGLLRSSLTEGRXGFYKPRLPSSSYSPHLTQGKVFQHPSSLSSRHSXLIHRVLKIYEGESFDLQIISEPSDNVLVGETLKHPADKVSSQEVQTYGSQQTYGSQQPDLEQVCSFHQQXSWLSLEVIAGPSVGLQYAVNSTSTSKLPVKLGRVSSDMILKDXKFQGKHAQIAWNFTKLKWELVDMGSLNGTLLNSRSVSHPDLGSQKWGHPCR

SEQ ID NO: 11353 - protein, 320 aa, Populus tremula x Populus tremuloides
MSTASINSWCLTSVSASKKSLPALRPSVFASLNSSVSPPTLIRNQPVFAAPAPILYPRRGEEMGNDYNEAIESLKKLLSDKEELKTVAAAKVEQITAELQTVSSSDPKAFDPVEKIKSGFIHFKKEKYDKNPGLYSELAKGQSPKFMVFACSDSRVCPSHVLDFQPGEAFVVRNVANMVPPYDKTKYAGVGAAIEYAVLHLKVEYIVVIGHSACGGIKGLMSFPYDGTTSTDFIEDWVKVCYNAKTKILAEHANSPFPDMCTQCEKEAVNVSIGHLLTYPFVRDGLVNKTLGLKGGYYDFVKGSFELWGLEYSLSPSLSV

SEQ ID NO: 11354 - protein, 569 aa, Ustilago maydis 521
MSATNPYAAQAGSTFKEVASPSQPSSPDHQNVEKADSKSVSADGSNEPPAEELRRALGTRHMVMIAIGGIIGPGLLVGSGQALANAGPVGALIAFAITGAIVYFVLQALGEMATLFAIRGSFIEYAGRWVDPALGFVAGWIYWELWISVLANEYNAVAIVIRYWDGAQAVPTGAWIAIFWVLFMGLSMLGVLAYGEVEFVLATVKVIGIVVFFILSIVINVGGAGGDQGYIGFRYFKTPGPFNGSGLDALNGIAKILVVSATLYAGTEATAITAAEAKNPAKAVPIAIRSVFYRILVLYLGTIFFIGLNVPSDDPSLVSAKSKAAASPLTIALKRGGIGAAASLINALIILSVISAGNSSLYIASRTLQSLGATGRAPKIFGWTSATGKVPIPALVLSNLVALISLLSINAGASTVFTYIINISGVSTFVIFAIICLCHIRFRQAWLRQGKSLDELPFKAFLAPYGSWGAFILNIVLMFFQGYTTFLNPRKAADIVVAYIVIPVAVVLYFGWKLWHKTQVVALEDLDLDSGRRLIEDFEPLQDLPDDEVLEKNKPWYKNPKKIFGRILA

SEQ ID NO: 11355 - protein, 573 aa, Bacillus clausii KSM-K16
MADQKFAPTQDGPPSDVERIKEESNYLRGTLAESLNEPLSAGIPDDDNRLMKFHGSYLQDDRDLREERRRQKLEPAYQFMVRVRLPGGVATPKQWLAMDDLAHRYGNGTLRLTTRQTFQMHGILKWNMKKNIQGINAALMDTIAACGDVNRNVMSTPNPYQSEVHGEVYDWAKKLSEALLPKTRAYHEIWLDEEKVAGTPQQDEVEPMYGPLYLPRKFKIGVAVPPANDVDIFSQDIGFIAILEEGKLTGFNVACGGGMGMTHGDTKTYPQLGRIIGFCEPQQIMDVAEKLITIQRDYGNRSVRKYARFKYTIDRRGLDWLKNELHARLGWELGEARPFQFDHNGDRYGWTKGVKGRWHLTLFIQNGRIQDTDDYQLMTGLREIAKIHTGEFRLTGNQNVIISNITAAKKKAIQAIVETYRLTDGQHVSALRRNSMACVAFPTCGLAMAESERYLPSLIDKLEFILDEAGIREEDIVIRMAGCPNGCSRAALAEIGFIGKAPGKYNLYLGGGFAGERLSKMYKENIGEAEILETLEPILFAYAKEREEGEHFGDFVIRKGYVKAVESGTDFHQ

SEQ ID NO: 11356 - protein, 320 aa, Populus tremula x Populus tremuloides
MSTASINSWCLTSVSPSKKSLPALRPSVFASLNSSVSPPTLIRNQPVFAAPAPILYPRRGEEMGNDYNEAIESLKKLLSDKEELKTVAAAKVEQITAELQTVSSSDPKAFDPVEKIKSGFIHFKKEKYDKNPGLYSELAKGQSPKFMVFACSDSRVCPSHVLDFQPGEAFVVRNVANMVPPYDKTKYAGVGAAIEYAVLHLKVEYIVVIGHSACGGIKGLMSFPYDGTTSTDFIEDWVKVCYNAKTKILAEHANSPFPDMCTQCEKEAVNVSLGHLLTYPFVRDGLVNKTLGLKGGYYDFVKGSFELWGLEYSLSPSLSV

SEQ ID NO: 11357 - protein, 218 aa, Candida glabrata CBS 138
MSNEDYGYDYDYLFKIVLIGDSGVGKSNLLSRFTTNEFNIDSKSTIGVEFATRTIDVDGKKIKAQIWDTAGQERYRAITSAYYRGAVGALIVYDISKSSSYENCHHWLSELRENADDNVAVGLIGNKSDLAHLRAVPTEEAKQFASENQLLFTETSALNSDNVDLAFKELITAIHQKVSKHQVELSNANKPGAGPNGPTISLTPAPNEKKKSSSNNCC

SEQ ID NO: 11358 - protein, 203 aa, Triticum aestivum
MASKGLVVFAVLLAAAFLVATAEQTQAKKEETKAGVQGYHGGGGGGGGYHGGGGGGGYSGHGGGGGGGYPGHGGGGGGGYPGHGGGGGGGYPGHGGGGGGGYPGHGGGRRWRQPLPVPGLRARSWVAAGCCARPNQIPGTPLLSGGRSPQPKCPECLPLRVVAYFGPGPLLTYPAYLVGPVRKGNGALLCHTPPVLQLHGVIP

SEQ ID NO: 11359 - protein, 189 aa, Rubrobacter xylanophilus DSM 9941
MGIGESIGAWPLLRQLRDGDRLGLGKASRSGRSEALRPRTERARKVARSVCPYCAVGCGQRVYVEGGEVTQIEGDPDSPISRGRLCPKGAASRQLVQSPTREYRVKYRRPYSDRWEELDLDTAMDMIADRVIKTRNETWEEEDGEGRKLRRTLGFAHLGGATLDNEENYLIKKLFTALGAIQIENQARI

SEQ ID NO: 11360 - protein, 847 aa, Rubrobacter xylanophilus DSM 9941
MGSNMAENHPVGFQWVMEARLRGAKVMHVDPRFTRTSATAHLHVPIRAGTDIAFLGGLANYILQNERYFKEYLVHYTNAPVIVGEKFADTEDLDGLFSGWDPETNSYDVSTWQYEGLQVSAAAGKREMGGATGEQAHYAQAGELEAGEPPAIDETLRHPRCVFQLLKKHFRRYTPEMVERICGCPKEQFLEVAETLCQNSGREKTSAFVYSVGWTQHTVGVQNIRAASIVQLLLGNIGRPGGGILALRGHASIQGSTDIPTLYNILPGYIPMPHAHAHTSLDLFVERNSAGAGYWGNLRAYMVSLLKAYWGEAATGENDFCFDYLPRLTGDHSIYPAIMGMVDGRVKGFFVMGENPAVGAANGKLQRLALANLDWLVVRDMTEVETASFWYDAPEIETGELKTEEIKTEVFFLPAASHVEKEGSFTNTQRLLQWREKAVEPKGDCRSDLWFMYHLGRRIREKLAGSTDPKDRPVLDLAWDYPTEGEIEEPSAEAILREINGWDARGRALSGYTELKDDGSTACGCWIYCGVYADEVNQANRRKPGSEQSWVAPEWGWAWPMNRRIIYNRASADPQGRPWSERKKYVWWDGEHKRWVGHDVPDFQADKPPDYVPPEGARAEKAIRGDKPFIMQADGRGWLYVPAGLVDGPFPTHYEAHESPFENPLYRQRSNPARQQFPRPDNPYNPSGSEAFPCVLTTYRLTEHHTAGGMTRTVPHLSELQPEMFCEVSPELAEERGLQNGGWATIVTSRTAIEARVLVTDRLAPLKVQGRVVHQVGLPYHWGSKGLVTGDSANDLLGLALDPNVHIGEYKTATCDIRPGRRPRGAALLRLIEDYRRRASRNGGGAT

SEQ ID NO: 11361 - protein, 192 aa, Staphylococcus epidermidis RP62A
MNYQIKRNTEETQLNISLANNGTQSHINTGVGFLDHMLTLFTFHSGLTLSIEATGDTYVDDHHITEDIGIVIGQLLLELIKTQQSFTRYGCSYVPMDEALARTVVDISGRPYFSFNSKLSAQKVGTFDTELVEEFFRALIINARLTVHIDLLRGGNTHHEIEAIFKSFARALKISLAQNEDGRIPSSKGVIE

SEQ ID NO: 11362 - protein, 483 aa, Agrobacterium tumefaciens str. C58
MKVVPMHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 11363 - protein, 288 aa, Salmonella typhimurium LT2
MDVTAKYELIGLMAYPIRHSLSPEMQNKALEKAGLPYTYMAFEVDNTTFASAIEGLKALKMRGTGVSMPNKQLACEYVDELTPAAKLVGAINTIVNDDGYLRGYNTDGTGHIRAIKESGFDMRGKTMVLLGAGGAATAIGAQAAIEGIKEIKLFNRKDDFFEKAVAFAKRVNENTDCVVTVTDLADQHAFTEALASADILTNGTKVGMKPLENESLIGDVSLLRPELLVTECVYNPHMTKLLQQAQQAGCKTIDGYGMLLWQGAEQFELWTGKAFPLDYVKQVMGFTA

SEQ ID NO: 11364 - protein, 104 aa, Dehalococcoides ethenogenes 195
MELKLDDKGLIAAIVQDVKDGTVLMLGYMNPESFKLTQETGSVWFYSRSRQELWNKGATSGNKLIVKEMYIDCDKDAVLVKAEPMGPTCHTGNRSCFFTPVELK

SEQ ID NO: 11365 - protein, 499 aa, Ruegeria sp. PR1b
MNAASFTKSFWHDEAKKLEFRTKHLINGEWVDSEDGTTFDTINPATGETIAKVASGKAADIDKAVKNARETFKSGVWSMLAPRERLAVIERFSALIEENAVEFALLDCLDMGKPVMDMINIDIPESVKNLKFFAETADKVHGSLTATDPSVVHYILRQPLGVVGLITPWNYPLMMAAWKLGPALITGNSVVLKPAEQAPLSCALLGDLFLKAGGPAGVLNVVQGLGEEAGKAIGLHPDVDKIGFTGSTEVGKLLMTYAGQSNMKRVTTECGGKTPQIVFADYDNLDKAVTSAVYGIYGNMGEMCNAGSRILVQRPIYDEFIKRFSELTASNMVVGDPLDPDTTIGPLVTVEQQERVLEYIEIGKKEGATLALGGGRGLNSGCYVEPTLFTDVTNSMRVAQEEIFGPVGTVIPFDTAEEALEIANDSLYGLAAAVWTNDLKTAHRFGRDLESGFVWVNTFDIGDMTSIWGGYKQSGNGRDTCIEALSQYTQTKSVWMDMA

SEQ ID NO: 11366 - protein, 377 aa, Bacillus cereus G9241
MKAVTYQGPNKVQVKQVDDAKLEKKDDIIIKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEIFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 11367 - protein, 253 aa, Zea mays
  misc_feature (244)..(244): Xaa can be any naturally occurring amino acid
  misc_feature (247)..(247): Xaa can be any naturally occurring amino acid
MEEDYVEPNPFPFLFANHPRRDPDPDRSTIRLRHLNPPSVPRRPPLIPAAMGSVDLVLKPACEGCGSTSDLYGTGCKHTTLCSSCGKSMALSRARCLVCSAPITNLIREYNVRANASTDKAFSIGRFVTGLPPFSKKKNAENKWSLHKEGLQGRQLTDKMLEKYNRKPWILEDETGQYQFQGHMEGSQSATATYYLLMLHGKEFHAFPAGSWYNFSKVAQYKQLTLEEAEEKMNKRKTSATGLXNVXMMKAAT

SEQ ID NO: 11368 - protein, 204 aa, Triticum aestivum
  misc_feature (89)..(89): Xaa can be any naturally occurring amino acid
MACLHDHECGDHNCAADWSLYNHIDIPKVVALNESVAGSVKSVFKSWDQRLETSGGFLESNEGDPELLVFIPFTSDVKIKSIAVVGGAXGTSPSRMRAFINREGIDFSDAQNMQPVQEWELAENLQGVLEYQTRYSRFQGVANLTLHFPDNFGGDTTKIYYIGLRGEATQNKRDVVATIVYEVMPNPSDHKTKSETGGGFSHVE

SEQ ID NO: 11369 - protein, 138 aa, Microbacterium arborescens
MPTEETLVLVKPDGVARGLTGAILARIEAKGYALVDIRLVEADRELLERHYAEHAGKPFYEPLLEFMQSGPSVAIRLAGNRVIEGFRSLAGTTDPTTAAPGTIRGDFGRDWGLAVQQNLVHGSDSPESAARELQIWFG

SEQ ID NO: 11370 - protein, 349 aa, Oryza sativa (japonica cultivar-group)
MEDVRSTLLVQELAGMRSKSVPRQYIVQQEDQPTIAATASFPIVDLGRLSQPDGDANEAVKLRQAMESWGLFMVTNHGIEDALMDNVMNVSREFFQQHLGEKQKYTNLIDGKHFQLEGYGNDQVKSDTQILDWLDRLYLKVDPADERNLSVWPKHPESFRDVLDEFLIKCDGVKNSLLPSMAKLLKLNEDYFVRQFSDRPTTIARFNYYPQCPRPDLVYGMKPHSDATILTILMVDNDVGGLQVLKDGVWYDVPTKPHTLLINLGDHMEIMSNGIFKSSVHRVMTNPEKERISVVLFYFMNLEKEIEPALELIDERHPARYKRVKIMDYLAGLFEHFLQGTRVIDTVKI

SEQ ID NO: 11371 - protein, 313 aa, Zea mays
  misc_feature (211)..(211): Xaa can be any naturally occurring amino acid
MNGEVECSVCHAKVPVPPPVSKAYDSHRSTVSSRQRALNVLLVSGDCVLAGLQPILVYISKVDGKFKFSPISVNFLTEITKIMFTIVMLFIQARRLKVGDKPLFTVSIFMQAARNNVLLSVPAFLYAINNYLKFIMQLYFNPASVKMLSNLKVLVIAVLLKMIMRRRFSVIQWEALALLLIGISVNQLKSLPEGSSVLGLPVAAGAYLYTXVFFPALASVYNEKALKSQFDTSIYLQNLFLYGYGAIFNFIGLVVTAIIQGPSSFNILEGHSKATMFLICNNAAQGILSSFFFKYAGILSEKGKTLVLIQYAI

SEQ ID NO: 11372 - protein, 390 aa, Brassica napus
MAMAAAVIVPLGILFFISGLVVNLLQAVCYVLVRPMSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLQSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPEPEDEIAQWCRDQFVAKDALLDKHIAADTFPGQKEQNIGRPIKSLAVVVSWACLLTLGAMKFLHWSNLFSSWKGIALSAFGLGIITLCMQILIRSSQSERSTPAKVAPAKPKDNHQSGPSSQTEVEEKQK

SEQ ID NO: 11373 - protein, 227 aa, Cordyceps subsessilis
MKSTLLRPLLPRYKLCSPGSRSFPLPQLASASNTFRAARFFSATSAIMGNKVFFDIEWEGPVMQGGKPTSTVKEQSGRINFKLYDDVVPKTAENFRALCTGEKGFGYEGSSFHRIIPEFMLQGGDFTRGNGTGGKSIYGEKFADENGQLKHDRPGLLSMANAGPNTNGSQFFVTTVVTSWLNGRHVVFGEVADQESLDVVKALEATGSGSGAVKYNKRATIVKSGEL

SEQ ID NO: 11374 - protein, 865 aa, Aspergillus oryzae
MDPGSIFGVISGAVQLVQVITQTAAGLATLREKFSHADLTIRSLIGELVTIKSAITQLDEWARYNTRDTAEENEYDEGLFVALDGCRAVMDVLSDQVAALTRGNDTQFGIGTRVKILWNEDIMRAHQDRLMTGKFGLTHRSRSTSEQVELLRKAENRQIIQKVASDTATLRSSSSYAASRADSSSLSYRQSSSGDTIFDFDRRLLSSPPYRRVLHRSWSRTESQSTASNGNESRSTDEGYGSGSVNRPNMPRASSLVLPVLPYDTIRPGHGHSKSVSFRPSNVQPNSTQFQRWQSDSTSSSPISRSSSSKREKIRAAFRQLGRSKSVAQAPIRALTGGSTAARRINGRDMHTSIDLTTPEGAAAPLIVKTAQSGSRSDVERLIESCHDIEACHVNTRRNALLVASHCGNEEIVELLLQRNARLNVTDKSGSTALHLAASRGHCEVLKLLLLEGSDTEALNTRGRTALWLAAERGQLEAANILIAGLAKVNTRAENQMTPLHTAAKGGHEAVVEFLVLNGADLEARDGTMMTALHHACEEGHLGVVELLLNHKANIDAVGSDNRTPLICAAAMGRLQVTQALLKRKASTRQVDDASMTALHWASYNGHTEIVDLLSQKKDILAMTNIAGRSALHLAVLNSKFAVVELLLRKRAPMETQCHSGFAPLHYACITKTDYTGIVKLLLISGANIEVQTKDQQRPIHLAAARGSIALLNLLCDKGASLIARDAIGDRALCAACRYGHTAAVQCLLDRDSPLSLPYDDKLQEDSPLCLAAIGGHLPIVTLLLQRGASVLKRDEQGWQPYHHAAHYGHVDVLRLLLSCSPTGWVMEGAGEGFTTERIGLVERVTTAASGNDPEQSAQDPSIYG

SEQ ID NO: 11375 - protein, 183 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRNRDGDRDYRGGGDRYGGGRDFGGGRGGGRGGGGDCYKCGKPGHFARECPSGDGGDRYGSRDDRYSSRDDRYSSRDDRYSSRDDRYWWQGWCKG

SEQ ID NO: 11376 - protein, 182 aa, Brassica napus
  misc_feature (177)..(177): Xaa can be any naturally occurring amino acid
MLETVDSSGVVNGGFRQVKSFCGDSSSEEELTVLPRHTKVVVTGNNRTKSVLVGLQGVVKKAVGLGGWHWLVLTNGIEVKLQRNALSVLEAPTGNEVDDDLDFENTLRNGSDMTSEDTLKPHKSKLRRQRSSRSSHKTLSRSLSSDSQSKSSAFTPPQNMMKVDLSKLEMPALLKYXQHFNL

SEQ ID NO: 11377 - protein, 1165 aa, Streptococcus pyogenes MGAS8232
MKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKEVKTPTTDWPNGLDLSHKGPYGAYVDVPLKEGANEIGFLILDKSKTGDAIKVQPKDYLFKELDNHTQVFVKDTDLKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADTVKVVVYDKQDQTKVLGQADLTKSDKGVWRAHLTSDSIKGISDYTGYYYLYEITRGQEKVMVLDPYAKSLAAWNDATATDVIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYKSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSIAYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAKYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTANPSQQKSQIGNHQTKTPDGSKDLDKSLMTRPKRAKTNQKLPKTGEASSKGLLAAGVALLLLAISLLMKRQKD

SEQ ID NO: 11378 - protein, 579 aa, Hordeum vulgare subsp. vulgare
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 11379 - protein, 315 aa, Triticum aestivum
RNPGGYLPGRMAPLMRFYVFMSLAYLLSWLSARPSALRFWRDILPIQNWITLVIALGLFEMTLWYFEYLNFNSSGVRPVGITTWVVTVGAIRKTISRLLILSISMGYGVVRPTLGGLTSKVLLLGLTYFLASELLDISENVGTINDISGKAKLFLVLPDAFLDAFLILWIFTSLSRTLEKLQARRSSVKLDIYRKFTNALAVSVIGSVVWIGYEVYFKATDPFSERWQSAWIITAFWDVLAFVLLIVICYLWAPSQSSQRYAYSGEAVDDEEESQSLTKGSDGDVGMVKIDKDRNAGVSSAFSLEDDEAEEDKRE

SEQ ID NO: 11380 - protein, 274 aa, Oryza sativa
PSVSTRKTQTVKMSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 11381 - protein, 239 aa, Pseudomonas putida KT2440
MPVKDPSKVVPQVPAESADAALKHIVDGFLRFHHDVFPDQQELFKKLATAQTPRAMFITCADSRIVPELITQSSPGDLFVTRNVGNVVPPYGQMNGGVSSAIEYAVMALKVHHIIICGHSDCGAMRAVLNPQSLTKMPTVGAWLRHAEVARTVVENNCSCGSEHETMQVLTKENVIAQLHHLRTHPSVASRLAAGELFIHGWVYDIETSKIEAYDAASDSFLPLAAGEPVPCATPRGRY

SEQ ID NO: 11382 - protein, 130 aa, Pimpinella brachycarpa
GTRESKVFYLKMKGDYHRYMAEFKVGDERKNAAEDTMNSYKAAQDIALADLAPTHPIRLGLALNFSVFYYEILNSSDKACSMAKQAFEEAIAELDTLGEESYKDSTLIMQLLRDNLTLWTSDSQDQLDEP

SEQ ID NO: 11383 - protein, 424 aa, Glycine max
MGLESVGDLAIHVILSKLGAQDTARVACVSKRFCSSASDDTLWINLCFHELALTQPLDHLGNPLSSFKECYQAWRGAFVMYPWSLVKRVKRCWDKIKTWLTNNFPEAEATLCKGATEADIQELENVLKVKLPLPTRILYRFHNGQEIAKADPETTTYGSSLGLIGGYSFYSHLVNVYLLPIRQIILETQQTRRRLSFLRRSKYVLVAASSTYSRKLFFLNCTNGQLYVGTRSPLTERDIIPCVPHDLISLHQELNSSEQQDAMLLWLEEHGRRLEHGFIKLHDEGNGKSINLFPEEPHICSTAVTNGVKVRASALVIPELMDLQDDLGEYLFAYSIRLSLEPQGCIINGMSFSSCQLHWRHWIIRANDIVISDVSGKAVIGQFPLLRPGAQEFVYQSCTPLPTPSGSIEGSFTFIPGRYAFMLF

SEQ ID NO: 11384 - protein, 134 aa, Glycine max
KKKTVTALVLIALATISLQSSASASSVGKFVDETITSHKIVIFSKTYCPYCRRAKAVFKELNQVPHVVELDEREDGSKIQDIMVNIVGRRTVPQVFINGKHLGGSDDTVEAYESGHLHKLLGIEKKDHDDHDDL

SEQ ID NO: 11385 - protein, 430 aa, Xanthomonas axonopodis pv. citri str. 306 [sequence omitted]

SEQ ID NO: 11386 - protein, 416 aa, Claviceps purpurea
MTDIPGRRAFKCFNQEFVVDERYTVTKELGQGAYGIVCAAVNNQTKESVAVKKVTNVFSKKILAKRALREIKLLQHFRGHRNITCLYDMDIPRPDVFNETYLYEELMECDLAAIIRSGQPLTDAHFQSFIYQILSGLKYIHSANVLHRDLKPGNLLVNADCELKICDFGLARGFSADPEQNAGYMTEYVATRWYRAPEIMLSFQSYTKAIDVWSVGCILAELLGSRPFFKGRDYVDQLNQILHVLGTPNEETLSRIGSPRAQEYVRNLPVMPKKNFATLFPQANPHALDLLDKMLAFDPSSRISVEQALEHPYLQVWHDPADEPNCPTIFNFDFEVLDDVGEMRKVILDEVIRFRQMVRTASSAEPTTGQAQTAAAGQVPMPQAGGQWKAEDPRPQENTPQGNGLEQDLQAGLDAA

SEQ ID NO: 11387 - protein, 1060 aa, Vibrio angustum S14
MFKAVDVLHTSFIEKPLAQLWALISPLYAVDESEWLTQLLPLAEPTDEERAHSAVQASELIARVRADKNAVQMIDALLLEYSLETKEGILLMCLAEALMRIPDPATADALIRDKLSVADWKSHLKNSDSLFVNASTWGLMLTGKVVTLDAKQDGTPTNVINRLVNKMSEPMIRQAMHQAMKIMGHQFVLGRDISEAMKNGKPKREQGFTYSFDMLGEAALTAQDAQKYYNDYLTAIKAVGKVNSAISAQSASQSSDPTVSIKLSALHPRYEVANEARVLEEMYHSVLELLIFAREHNVGITIDAEEADRLELSLKLFEKLYRAKEVKGWGRFGLVVQAYSKRALPVLAWLAALSKQQGDVIPLRLVKGAYWDSELKLCQQAGFNGYPVFTRKEATDSSYLACARFLLSEPLKGLIYPQFATHNAHTISAIVAMAKHSCFEFQRLHGMGDALYNHVMDMHKTQVRIYAPVGSHKDLLPYLVRRLLENGANSSFVHRLVDANCPISDLTQHPVDVLKQRKTLHNSLIPLPKDIFGSERKNSSSINIDIESQWQPFHQAVHAFDKVKWKASPILNGKPTPIMAAERVCVTAPYDREEVVGELTYATSSQVDTAMASAHDAFADWSQCSASERANYLLLLADKLELHQAELVALCHREAGKTIHDAIDEIREAVDFCRYYAEQAQTNFDKPKRITSFDGVDQEMTYQGRGVFVCISPWNFPLAIFLGQVCAALVAGNTVVAKPAEQTSLIACRAIELLLLTGIPQGVIQVVTGLGREIGHQLMSDERVAGVAFTGSTPTAQLINRTLMARDCAPVPFIAETGGQNAMIVDSTALPEQVVRDVLRSAFASAGQRCSALRVLFIQQDIAERVITLIKGAMAELKVGDPQLHATDVGPVIDLAAKQKLLTHIESLKNQARLICQTSLPESCASGDFVPPTAIEIQHIDLLEQEHFGPILHIVRFKASEIDQVVNQINQTGFGLTMGIHSRNERTYSEIASRAKVGNCYINRDQVGAVVGVQPFGGRGLSGTGPKAGGPHYLYRFMQSTIAPINVTHQREMEGTNNEK

SEQ ID NO: 11388 - protein, 321 aa, Coprinopsis cinerea okayama7#130
MPAPTKAARHDMSVILVTGSYDHEIRFWEAWSGICSRTIARTGETGQVNRLAISPDKRLLAAAIHKKVNIYEIGSPLNEPLVTFESHTMNISAVAFHSEGKWLVTGSEDGTIKIWDLRTSSLHRTYDNGAPVNDVIIHPNQGELISCDQSGSIKQWDLAENVCSHELTPAGDVPIRSVTLASDGSCLVAGNNKGQCYVWKVNEENTNLPRFQAVTRFQAHGKYLTRCLLSPDARYLATCSADTTVKIWSISPTYEFKLERILVGHQRWVWDCAFSADSAYLVTASSDHTARLWEMASGETVRQYNGHHKAAVCCALHDGAG

SEQ ID NO: 11389 - protein, 417 aa, Streptococcus mutans UA159
MATEIVMPKLGLTMTEGLINQWLVKEGDTVAAGDPVLEISSEKLTSEVEAPEAGVILKIVKGEGETVPCKQIIAWIGQEGEAVPDAAGDAPEVDTEAESEVASAGQTVVPEESRTVSAAPVAEKHEDGRIFITPLARKIAKEKGLDITYIKGTGGNGRITRRDVEAFNPASIPTAEPVTALSAPTNVNYGVGLTGIRKVIAERMMSSIHSSAQLTLHRKADVTPLMAFRQDIKTKVNAPLENGEIGITTLLTKAVTKALKDYPEANAWYAGGQYEEKEDIHIGMATALSDGLVVPVIRHADKLTLSDLGRTIKEEAEQVRKGTLDPSLYSGSTFSITNLGAQGIEYFTPILNAPEVAILGVGAIQKALTLDENGQVAEKQFLPLSLTFDHQVLDGAPAAEFLGAVISYLEDAYSLVF

SEQ ID NO: 11390 - protein, 343 aa, Streptococcus mutans UA159
MARELLFMKAINEALDMAMAKDDKIILLGEDIAGGVKVKHLEEQNEEAWGGVMGVTSGLMAKYSRDRVIDTPLSEHGYMSASVGMALTGLHPVPELMFNDFIGFCFDALIGQGSKMRYMFGGKAKVPMTVRTMHGAGASAAAQHSGSYYGIFGSIPGIKVVVPATPYDAKGLLLSALEDDNIVIFSEDKTLYGFKGEVPEDYYTVPIGKAVVRREGNDLTIVTIGKMLYVAYEVADRLAKDGISVEVIDLRTVAPWDQETVLNSVKKTGRLIVIDESNPHNNTATDIASVVNDKAFDYLDGPIKCVCAPNVPVPFAINLEQLYIPNADRVIEAAAELIDDLKA

SEQ ID NO: 11391 - protein, 503 aa, Chlamydophila pneumoniae TW-183
MQLPLMVPIVHLQIWRFSMIYYGVSVMLCATVSGPSFCEAKQQILKSLHLVDIIELRLDLINELDDQELHTLITTAQNPILTFRQHKEMSTALWIQKLYSLAKLEPKWMDIDVSLPKTALQTIRKSHPKIKLILSYHTDKNEDLDAIYNEMLATPAEIYKIVLSPENSSEALNYIKKARLLPKPSTVLCMGTHGLPSRVLSPLISNAMNYAAGISAPQVAPGQPKLEELLSYNYSKLSEKSHIYGLIGDPVDRSISHLSHNFLLSKLSLNATYIKFPVTIGEVVTFFSAIRDLPFSGLSVTMPLKTAIFDHVDALDASAQLCESINTLVFRNQKILGYNTDGEGVAKLLKQKNISVNNKHIAIVGAGGAAKAIAATLAMQGANLHIFNRTLSSAAALATCCKGKAYPLGSLENFKTIDIIINCLPPEVTFPWRFPPIVMDINTKPHPSPYLERAQKHGSLIIHGYEMFIEQALLQFALWFPDFLTPESCDSFRNYVKNFMAKV

SEQ ID NO: 11392 - protein, 357 aa, Streptococcus mutans UA159
MPNYKDLPQELTRTRTNEAVSELVDLKVHTATDIEAQEVSKEQAKDMYKTMWDIRNFEENARRFFAAGQIPGFVHLYAGEEAVAAGVCANLTDKDYITSTHRGHGHCVAKGGDLKGMMAEIFGKETGLGKGKGGSMHIADLDKGILGANGMVGGGFGLATGAAMRNKYLKTDDVAVCFFGDGAANEGLFHECLNMASIWKLPVIFVNENNLFAESTPQWYSSASATIAERALAYDMPGVRVNGKDLFAVYQVAKEAVERARSGQGPTLIEAVTYRDHGHFEGDEQKYKAPDGEEKDWADVDPLEVFRNYTIEHELLTEEELDEILEESKKDVDDAIKYAQDSPIPKAESLLEDVFAE

SEQ ID NO: 11393 - protein, 337 aa, Agrobacterium tumefaciens str. C58
MARMTMIEAVRSAMDVSMERSDDVVVFGEDVGYFGGVFRATQGLQGKYGKTRCFDAPISESGIVGTAIGMAAYGLRPCVEIQFADYMYPAYDQITQEAARIRYRSNGDFTCPIVLRMPTGGGIFGGQTHSQSPEALFTHVCGLKVVVPSNPYDAKGLLIASIEDPDPVMFLEPKRLYNGPFDGHHDRPVTPWSKHEMGEVPEGHYTIPIGKAEIRRPGNDVTVIAYGTMVHVALAAAEETGVDAEIIDLRSLLPLDLDTIVKSVSKTGRCVMVHEATLTSGFGAEVVSLVQEHCFYHLEAPVVRVAGWDTPYPHAQEWDYFPGPARVGRALVDVMEA

SEQ ID NO: 11394 - protein, 505 aa, Agrobacterium tumefaciens str. C58
MRTPKPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVAPTLLQLMNVPLPPEMTGKSLIDL

SEQ ID NO: 11395 - protein, 150 aa, Oryza sativa (japonica cultivar-group)
MARTKQTARKSTGGKAPRKQLATKSDFDRWSYITISVQAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 11396 - protein, 347 aa, Solanum lycopersicum
MAGESISGNLKDLSLNRNGAVSKKSHLVVCFGEMLIDFIPTVAGVSLAEAPAFEKAPGGAPANVAVCISKLGGSSAFIGKVGDDEFGRMLADILKQNNVDNSGMRFDHDARTALAFITLTAEGEREFVFFRNPSADMLLRESELDVDLIKKATIFHYGSISLIDEPCRSTHLAAMDIAKRSGSILSYDPNLRLPLWPSEDAARSGIMSVWNLADIIKISEDEISFLTGADDPNDDEVVLKRLFHPNLKLLLVTEGSAGCRYYTKEFKGRVNSIKVKAVDTTGAGDAFTGGVLKCLASDASLYQDEKRLREAIFFANVCAALTVTGRGGIPSLPTQDAVRQTLAEVTA

SEQ ID NO: 11397 - protein, 593 aa, Pseudomonas aeruginosa PAO1
MTADSALYIPPYKADDQDIVVELNSRFGAETFTVQPTRTGMPVLWVPRERLIEVLTFLRQVPKPYVMLYDLHGVDERLRTHRRGLPSADFSVFYHLMSLERNSDVMIKVALSERDLNLPTATRIWPNANWYEREVWDMYGITFTGHPHLTRMLMPPTWQGHPLRKDYPARATEFDPYSLSAAKQDLEQEALRFKPEDWGMKRHGENEDYMFLNLGPNHPSAHGAFRIILQLDGEEIIDCVPEIGYHHRGAEKMAERQSWHSFIPYTDRIDYLGGVMNNLPYVLSVEKLAGIKVPQRVDVIRIMMAEFFRILNHLLYLGTYIQDVGAMTPVFFTFTDRQRAYKVVEAITGFRLHPAWYRIGGVAHDLPRGWDKLVREFLDWMPKRLDEYETAALKNSILRGRTIGVAQYNTKEALEWGTTGAGLRATGCDFDLRKARPYSGYENFEFEVPLAHNGDAYDRCMVKMGEMRQSLRIIEQCLKNMPEGPYKADHPLTTPPPKERTLQHIETLITHFLQVSWGPVMPANEAFQMIEATKGINSYYLTSDGSTMSYRTRIRTPSFAHLQQIPSVINGSMIADLIAYLGSIDFVMADVDR

SEQ ID NO: 11398 - protein, 772 aa, Oryza sativa (indica cultivar-group)
MLGRRVVMLQSAAAALGLRRGRARMRLGCVLEHVAPRLAVASAALLGAGEVIAAAAAAGKGGGAGHAAVASTLAQLTVTAVAIASGACLSTKVDFLWPRIEQLPDTLIFEGVEVTGYPIFEDPKVQKAIVFASTAHIGQFRKTGDPYVTHCIHTGKILAALVPSTGERAINTVVAGILHDVIDDTAENLKSIEEQFGDDVASLVSGVSKLSYINQLLRRHRQKNTGGSTLTSEEYFSYALPIRKAEAVAQETLAVWCSLASRLGVWALKAELEDLCFAVLQDLLQAVLPFDLLLDRKRRSYFLNNLHGSSETSVPKPKIVDDAAVALASLAACEEELEQELLISTSYIPGMEVTLSSRLKSLYSMYCKMKRKHVGIKQIYDARALRVIIGDKNGALHGPAVKNCYSVLDIVNRLWTPIDGEFDDYIINPKGSGYQSLHTAVQASDNSPLEVQIRTQRMHEYAEYGLAAHWLYKESKVDYRSGTSNKIGQSTSYPSSSSEDESYIQDVMPSKYSSMKMGHPVLRIEGSQLLAAVIVSIDKGGKELLVAVSFGLEASEAVAERRSCFQLKRWETYARVYKKVSEKWWCAPGHGDWSTNLEKYTLCQDGIFHKQDQFGRLLPTFIQLIDLTEEEEEEYWMVVSAIFEGKEASSLTPDSSNTERSTSEPPSSTPLSDPINNKVHLLRTMLQWEEQVRRGASLAEKSLSVGTCTEPILREVAIICWPYGKIMRMSLGSTAADAARRMGVEGKLLWVNGQLVLPQTELKDGDIVEVRM

SEQ ID NO: 11399 - protein, 710 aa, Arabidopsis thaliana
MAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISSE

SEQ ID NO: 11400 - protein, 614 aa, Glycine max
MSYDKNPSPVPTSTTGDEEKKVTGGGYDVGVYSAHGRVDHNARAVDGHDLNDSYDPSKESLLTRLGLNIESFKRAPGTTRGLVAHGDIPPEYLQHDNPLLQQKMKPRHLQMIAVGGSIGTGLFVGSGASLGNGGPAAVLMAWIIMGVMLIMVTQALGEMAIIYPVSGGFYTLASRMLDPSFAFAMGWNYVLQWAVVLPLEITVAGTTVQYWTDKVPLGVWITIFFLLIIFFATLGTLGYAEEEFWSSCLKLAVVIMFIFIGIVCICGGGPASGDYGSYVGGRYWQNPGAFANGFKGVCAMFVTAAFSFAGTELVGLAATETPNPRKTLPSAVKNTFWRITIIYITSLTIIGLLIPYDDPDLFGGSGANVSPFVIVLDRANIGGLNHLVNATICISVLSIGLSCVYAGSRTLTALAETGYAPKMFTYVDKSGRPLYSVLAILAFGPIAYVNLANVGTDVFNWLLALSGLSTLFTWLAICVTHIRFRQAWKIQGHSVEELPFTAIAGVWGSWLGAILIVIVLIAQFYIGLFPLGGVESGNARAESFFLSYLAFPILLAFWVVGYAWKRTLPRKTTEIDLDTGRKSWLTVEEMRQYKAERRLAPWWKRIYRMLFTSS

SEQ ID NO: 11401 - protein, 326 aa, Bacillus cereus G9241
MIKDYSVQIEGQEKVCLDQWVAHYRTYATKGRSASYIPALGEINVSQLGICIVKPDGTMIKSGDWEVPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLPFQDGCGIGIYGPAIDEYGNSLPGIMLLEHIAKEWDLSIF

SEQ ID NO: 11402 - protein, 241 aa, Brassica napus
  misc_feature (224)..(224): Xaa can be any naturally occurring amino acid
MDDTDQESSAVSSRHLCRDLDAPRGPPGRYDKVDAMVFEMKQKDIRLDIYSYNIWLSSCASVEQMEQVYQQMKSDVSINPNWTTFSTMATMYIKMGETEKAQDALRKVEARITGRNRIPYHYLLSLYGSVGNKKELFRVWNVYKSVVPSIPNLGYHALVSSLVRMGDIEAAEKVYEEWLPVKSSYDPRIPNLLMNVYVKNGQLDKAQGLFDHMIEMGGKPSPGXWEILAEGHTRKRSITEA

SEQ ID NO: 11403 - protein, 236 aa, Haemophilus influenzae 86-028NP
MTEKNKPICVVLTGAGISAESGIPTFRSEDGLWAGHKVEEVCTPEALQKNRAKVLDFYNQRRKNAAAAKPNAAHLALVELEKAYDVRIITQNVDDLHERAGSSKVLHLHGELNKARSSFDESYIVDCFGDQKLEDKDPNGHPMRPYIVFFGEMVPMLERAVDIVEQADVVLVIGTSLQVYPANGLVNEAPRKAPIYLIDPNPNTGFVRKQVIAIKEKAGEGVPKVVAELLENTKNS

SEQ ID NO: 11404 - protein, 131 aa, Dehalococcoides sp. CBDB1
MEETMNNQEAPETSEEETVAVENTKAEKVLPNFGPGDTIKVHARIKEGDKERIQMFQGVVLKVKQAADGGNFTVRRISYGVGVERTFPFLSPNVTKVEIMKKGRVRRARLFYLRKLSGKAARIKEVKQTPS

SEQ ID NO: 11405 - protein, 820 aa, Oryza sativa (japonica cultivar-group)
MATSLSSAPTQLRPSPSPSHHRLLHRSSLLPFPRRHHHRRRRCGALSIARASASAKDGVTVRRFPAAPTEGGRLAGIPRFAFEKFPGSEPVLTTQMKSVGEAMALGRTFQESFQKAVRSLETGFAGWGCAPIKELDWDWEKLKYSLRVPNPDRIHAIYAAFKKGMRIQDIHEISFIDKWFLTELKELVDVEQFLISRGLDQLSKDDFYQVKRRGFSDTQIAFATSSSETDVRLRRLALEVAPTYKRVDTCAAEFEANTPYMYSSYEYECESVPTNKKKVLILGGGPNRIGQGIEFDYCCCHASFALREAGYETIMMNSNPETVSTDYDTSDRLYFEPLTVEDVTNVIDLERPDGIIVQFGGQTPLKLALPIQQYLEDKKLVSASGTGLVKIWGTSPDSIDAAEDRKRFNAILEELGIEQPKGGIARSESDALSIASEVGYPVVVRPSYVLGGRAMEIVYNDEKLIKYLATAVQVDPERPVLVDKYLIDAIEIDVDALADSVGNVVIGGIMEHIEQAGIHSGDSACSLPTRTVSAKCLDIIRSWTTKLAKRLNVCGLMNCQYAITTSGEVFLLEANPRASRTVPFVSKAIGHPLAKYASLVMSGVTLPELGYTQEVVPKHVSVKEAVLPFEKFQGCDILLGPEMRSTGEVMGIDYEFSGAFAKAQIAAGQKLPLNGTVFLSLNDLTKRHLAEIGRGFRELGFNIIATSGTAKVLQLEGIPVEPVLKIHEGRPNARDMLKNGQIQVMVITSSGDALDSKDGLQLRRLALAYKVPIITTVDGARATIDAIKSLKNKSIETLALQDYFQTTDASQNLQAAQSAS

SEQ ID NO: 11406 - protein, 568 aa, Oryza sativa (indica cultivar-group)
MVSWPKPWLWKMDGVDKDKGNGKVHFRDSSPQEAFRTYKRRRQPRPEPQQQPQPQPQSEPEPQQQPQPQPQPQPQPEAEAEAEAEAKAADVLARQRLLQEEALRVSVSVYSELEGGSLPIDVFILARERHRQREEEEEEAPLLLMASSAASSLLVAVVVLVLVAAAEAAAANETSSSATAALRAGRELRRYRRVQALLRRVNKPAVRTIESPDGDLIDCVAAHLQPAFDHPRLRGQRPLRGPPERPRGWRPRPGPNDTAAGDAGVQLWASSAGGASCPEGSVPIRRTTEADVLRASSVRRFGRAPTARVRRDSVSGGHEHAVGYVAGEEYYGAKASINVWAPKVSTPEEFSLSQIWVIAGSFGNDLNTIEAGWQVSPQLYGDNSPRFFTYWTTDAYQTTGCYNLLCSGFVQTNSRIAMGAAISPTSGYKGGQFDISLLVWKDPNHGNWWLEFGNGELVGYWPSFLFSHLASHASMVQFGGEVVNTRADGGAHTATQMGSGHFAGEGFGGASYFRNLEVVDWDNSLVPLAAGFHVTADHPDCYDIQGGVNAVWGNYFYYGGPGKNVKCT

SEQ ID NO: 11407 - protein, 539 aa, Triticum aestivum
  misc_feature (429)..(429): Xaa can be any naturally occurring amino acid
  misc_feature (451)..(451): Xaa can be any naturally occurring amino acid
MAGYRSASSSSAAGAGGAAVFAMRVLLLLTLLPLALAAFAFALQWRGGMRDPTGTVWPADTQRFPGMENSPLGSSSSSTGGRGSYFAVSSASASSAAADCAEILGRSASSHGISLYRGWSFDSDTAITPKICITGSTSASLHQILPWLYYHKVIGVSHFILFVEGEAAKPAVTSVLESIRGVKIIYRTKELKEQQDRSRIWNETWLSGFFYKPCNYELFVKQSLNMEMAIVMAREAGMDWIIHLDTDELIHPAGAREYSLRRLLLDVPDNVDMVIFPNYESSVERDDIKDPFTEVSMFKKNYDHLPKDTYFGLYKEATRGNPNYFLTYGNGKSAARVQEHMRPNGAHRWHNYMKSPNEIKLEEAAILHYTYTKFSDLTSRRDRCGCKPTKEDVKRCFILEFDRLAFIIASTATEQEMKELVPGTCCMDXQRYKFEAFEEGSFNTHICTNGXIRGLKESGIFIDAVTSAKAHPKANIGLENNESIHTNVTAAQSTTLKEGGNDNSQATARKILEMIDVQEEAVPPMSPPGFLELMESALS

SEQ ID NO: 11408 - protein, 298 aa, Hyphomonas neptunium ATCC 15444
MIVTSLHYSGHKDGAAMMKTTVSEEWLTYTWVRLRSGVEPHEVKRQLIQNGFDDQAIRSLMRDAYNGRRPISDVDHAALARAPLTLRAKSHPQLRRIPAPKAQLYVWPNFLAPETCDALIALTDERLRASTTTDAFADPKIRTSRSSDIGTMGHNLVMQLDELIAEALGIHWSYSDATQTQRYDVNQEYKAHYDYFTPGTRDYQVHCQFTGQRTWTFMIYLNDVEEGGGTRFRRLEKTIMPEKGKAVIWNNLNPDGSVNPYTIHHGMKVRSGAKYVITKWFRERGWGEMFPEDYSRIS

SEQ ID NO: 11409 - protein, 182 aa, Pseudomonas aeruginosa PAO1
MIKEIINVVHGTFTQLRSLVMIFGHAFRKRDTLQYPEEPVYLPPRYRGRIVLTRDPDGEERCVACNLCAVACPVGCISLQKAETEDGRWYPEFFRINFSRCIFCGLCEEACPTTAIQLTPDFEMGEFKRQDLVYEKHDLLISGPGKNPDYNYYRVAGMAIAGKPKGAAQNEAEPINVKSLLP

SEQ ID NO: 11410 - protein, 99 aa, Erwinia amylovora
ARRVRELGVYCELWAWDVTEEQIRGFNPNGIILSGGPGKHHPSTNRSAGAPDLRYFNRRRSPVLGGFPTGIQKQFALAGWAGNVEGFQPNAKLRVSRRL

SEQ ID NO: 11411 - protein, 586 aa, Arabidopsis thaliana
MTSFSLTFTSPLLPSSSTKPKRSVLVAAAQTTAPAESTASVDADRLEPRVELKDGFFILKEKFRKGINPQEKVKIEREPMKLFMENGIEELAKKSMEELDSEKSSKDDIDVRLKWLGLFHRRKHQYGKFMMRLKLPNGVTTSAQTRYLASVIRKYGEDGCADVTTRQNWQIRGVVLPDVPEILKGLASVGLTSLQSGMDNVRNPVGNPIAGIDQEEIVDTRPYTNLLSQFITANSQGNPDFTNLPRKWNVCVVGTHDLYEHPHINDLAYMPANKDGRFGFNLLVGGFFSPKRCEEAIPLDAWVPADDVLPLCKAVLEAYRDLGTRGNRQKTRMMWLIDELGVEGFRTEVEKRMPNGKLERGSSEDLVNKQWERRDYFGVNPQKQEGLSFVGLHVPVGRLQADDMDELARLADTYGSGELRLTVEQNIIIPNVETSKTEALLQEPFLKNRFSPEPSILMKGLVACTGSQFCGQAIIETKLRALKVTEEVERLVSVPRPIRMHWTGCPNTCGQVQVADIGFMGCLTRGEEGKPVEGADVYVGGRIGSDSHIGEIYKKGVRVTELVPLVAEILIKEFGAVPREREENED

SEQ ID NO: 11412 - protein, 244 aa, Aspergillus oryzae
MSLPQRTASLTRITNETKIQISLSLDGGVLPPYEPTDHFPAPEDPKEAEAATHGIVPPKDAHHATQFTATQQITVSTGIGFLDHMLHALAKHSGMSLAIRAKGDLYIDDHHTTEDTFLALGAAFTKALGARQSIARFGRGDAPLDEALSWAVIDISSRPWAVINLGFRREKIGDLSTEMITHGLQSFAQEAGVTLHVCCTYGDNDHHRAESAFKALAVAIRTACTRRVAGEVGAGDIVSTKGVL

SEQ ID NO: 11413 - protein, 586 aa, Arabidopsis thaliana
MTSFSLTFTSPLLPSSSTKPKRSVLVAAAQTTAPAESTASVDADRLEPRVELKDGFFILKEKFRKGINPQEKVKIEGEPMKLFMENGIEELAKKSMEELDSEKSSKDDIDVRLKWLGLFHRRKHQYGKFMMRLKLPNGVTTSAQTRYLASVIRKYGEDGCADVTTRQNWQIRGVVLPDVPEILKGLASVGLTSLQSGMDNVRNPVGNPIAGIDPEEIVDTRPYTNLLSQFITANSQGNPDFTNLPRKWNVCVVGTHDLYEHPHINDLAYMPANKDGRFGFNLLVGGFFSPKRCEEAIPLDAWVPADDVLPLCKAVLEAYRDLGTRGNRQKTRMMWLIDELGVEGFRTEVEKRMPNGKLERGSSEDLVNKQWERRDYFGVNPQKQEGLSFVGLHVPVGRLQADDMDELARLADTYGSGELRLTVEQNIIIPNVETSKTEALLQEPFLKNRFSPEPSILMKGLVACTGSQFCGQAIIETKLRALKVTEEVERLVSVPRPIRMHWTGCPNTCGQVQVADIGFMGCLTRGEEGKPVEGADVYVGGRIGSDSHIGEIYKKGVRVTELVPLVAEILIKEFGAVPREREENED

SEQ ID NO: 11414 - protein, 423 aa, Oryza sativa (indica cultivar-group)
MDRFKMIKEVGDGTFGSVWRAINKQNGEVVAVKKMKRKYYSFEECMSLREVKSLRRMNHPNIVKLKEVIRENDILYFIMEYMECNLYQLMKDRVKPFSEAEVRNWCFQIFQALAYMHQRGYFHRDLKPENLLVSKDVIKLADFGLAREVTSVPPYTEYVSTRWYRAPEVLLQSSIYDSAVDMWAMGAIMAELLTLHPLFPGTSEADEILKICNVIGSPDEQSWPQGLSLAETMKFQFPQVSGNQLAEVMTSVSSEAVDLISSLCSWDPFKRPKAAEVLQHTFFQGCTFVPPTVRSKAGVLPKTPPCVGVKGVSEHGMPRRYSTGTLSTTKPHSNASLKSSGLSKTGHPVLRHSRSLPETGRATMHKVSTLTERLSHMSVTSRTRTTPKPAAPLLKAGLGKSDLLGKTDEIPPAKRLTRKLVFV

SEQ ID NO: 11415 - protein, 308 aa, Oryza sativa (indica cultivar-group)
MRTTTASAGARAAPSTWDLPPKVNHRSFQPRVIRSPSASGVPSIGEEDYDDDDDDDEEETVVLEEDRVPREWTAQVEPGVQITFVSIPGGAGNDLKRIRFSREMFNKWEAQRWWGENYDRVVELYNVQTFSRQQGFSTPTSSVDEAMQRDSFYSRVGSTRESPAMMMPPPPPLPSSGAGREHPISRTASSKAQLSSSSSVAAARPPFYPSTAVPDPSDHVWAHHFNLLNSAAAGPAAPYDPSRGTTSSRDEASVSISNASDLEATEWVEQDEPGVSITIREFGDGTRELRRVRFRQATPQSTHTSRKR

SEQ ID NO: 11416 - protein, 565 aa, Glycine max
ARAARGLSGAIPPEISNMASLQVLQLGDNQLVGNIPTQMGSLKQLSTLALQYNKLTGQIPLSLGNLEKLSRLNLSFNNFSGTVPATLAYIEHLEVLDIQNNSLSGIVPSALKRLGEGFQGANNPGLCGVGFSTLRACNKDQDLNVNHIDTSDGDQPKNSNSSKALPEPAYVQLHCGQTHCSKSRRFPQTVITAGVVIVTLTFICAGFLTFFRYRRQKQRISNTLSSSSEGKVSLDQPKEFYTKSPSALVNIDYYSGWDQLSNGQNADAGGLSNEYLNQFRFNVDEVESATHYFSEANLLNRSKFAAGYKGVLRDGSLVAIRSISVTCCKTEEAEFVKGLNLLTSLRHENLVRLRGFCCSRSRGECFLIYDFATMGNLSQYLDIEDGSSHVLEWSKRVSIIKGIANGIGYLHSNEESKPTIVHQNISVENVLLDYQFNPLIRDAGLPMLLADDVVFSALKVSAAMGYLAPEYITTGRFTEKSDIYAFGVIILQVLSGKTTIGSSIRTAVESFRFDDSVDTNLKGIYSKSEAATLSKLAIQCTNELPDERPTMVDVIQELSVLSAHL

SEQ ID NO: 11417 - protein, 1273 aa, Bordetella bronchiseptica RB50
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIAGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 11418 - protein, 674 aa, Medicago truncatula
MNGLSNKVYARIKKDLVNHGPPKKQKNTLKLLYLLVDGSMMNGLRNKVSAQHKTDLVNHKPAKKQKITPKLDDPLMNGLSNKVYAQIKKELVDQGPSKKQKNTPKLDDSMMNGLSNKVCAQIKKELVDHGPSKKQKNTPKLDQSMFNGLSNNFSAQVQKDLGDDGPSKKQKSTPKIPSMSLDEYFKRSREQLEAEESENEELYREQEVEGEINYENGDGDNSMEVDRQEITLNEEGEAIVPSQKIVSKFSNFLGSVARMSDLCPLTYTNWKAIPKKKKTIWAYVNKRYIVLEKGQKDVYAIINDAWRWYKWLIKKNHFTKYRNLCERLKNRPDSIPEAHFKKLMTYWSYEAIREISHQNAKNIDKQKWRHQAGPISFAVIRERLRATKDDREPPTQAEVFIETRQSKRGKQLDQVTSDAITNLQDLITNSDHSSVEAFQTVFGKEKPGRLRCYGRVTTSSLLKRNKVADMEKKHAAEVKSLTDKVQEMETIHRKDMAAMEEKLQVLLRVMLNQSNTGIDMGDLGAFLSTRNDDNNVRHSSTSNHESVMKLTVKTLKGSHFEIRVHPSDSIMAVKTTIEDIQGKDNYPCRQQLLIHNGKVLKDETTLADNEVSEDGFLVVMLSKIWISNVNNRSMGGECFVDNYEEEDEEHFFDESDEEDEEKFFDDLDGDEDEE

SEQ ID NO: 11419 - protein, 210 aa, Pseudomonas putida KT2440
MQVKNPILGLCQKAKFALSAAKVEQCPDDQGYEVAFAGRSNAGKSSALNTLTHASLARTSKTPGRTQLLNFFSLDDERRLVDLPGYGYAKVPIPLKQHWQKHLEAYLGSRECLRGVILMMDVRHPMTDFDKMMLDWAKASSMPMHILLTKADKLTHGAGKNTLLKVQSEIRKGWGDGVTIQLFSAPKRLGVEDAYRVLADWMELEDKPVV

SEQ ID NO: 11420 - protein, 451 aa, Staphylococcus epidermidis RP62A
MANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAERYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIRGRGLMYGVELVENKSTQTPLDIPTVELIIRRCKENGLMIRNLENVITFVPILSMSNKEIKKMVKIFNKALHQTLGKK

SEQ ID NO: 11421 - protein, 200 aa, Vicia faba
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRAKKWVQELQKQGNPNMVMALTGNKSDLEDKRKVTAEEARVYAEENGLFFMETSAKSAANVNDVFYEIAKRLPRAQPAQNPAGMVLVDRPTEGSRAASCCS

SEQ ID NO: 11422 - protein, 608 aa, Streptomyces hygroscopicus
MCGITGWVSFHQDPRTQAPVIEAMTATLAPRGPDAAGVWLGPRAAIGHRRLAVIDLAGGVQPMTDRPDAPTTVLTYSGEIYNHHELRSQLSGLGHEFRTRSDTEVVLRGYAEWGEKVADHLDGMFAFAVWDERAQRLLLVRDRLGVKPLFWAEVDGGLAFASEPKALFAHPEIRPRVDADGLREAYSLLFNTGPTVWSGVREVEPGGLLLLDRDGIRERRYWQLEADAHPDDRDATIARVHDLVSTAARAQLEADVPLCSLLSGGIDSTVLTALLADELRLREGPGARIRSYAVDYSDQAESFTGDVLRTGHDTPYATEAGAFLGTDHSTVVLDPRALLDPEHRRAVVVARDSPIGVGDMDTSLHLLFGEIRKHSTVALSGEAADEVFGGYPWFHNPKALATATFPWLLVTGDEAAMPLNPELDLRIGEFRDDTYRTALAAVPHLDGETPTEHRQREMQHLSLTRWLRQLLHRKDRLSMAQGLEVRVPYCDHRLVEYAFTTPWALKNFDGREKSLLRAAGTGLAPDSVLHRPKNHYPATHHPDYNRGLQNMARDALADDTVRSLADETRLKPCLDTPPGQLEWGHRLRLERVVDLALWLDHYQPELAL

SEQ ID NO: 11423 - protein, 502 aa, Aspergillus nidulans FGSC A4
MKPPYYMETGCKRNPGSDSTLKVRWTLYTRLLQSANQGLGIDPGSGQVFASCPTNTVADVDAYVSSAHRSFLSYRETNPRARAKMLLNWHNLIAQSKNDIAKLVVYETGKPMAEAVGEVDYALGFAWWFAGEAERVRGSIAQPSISERRTFVIKQPIGVCIALVPWNFPVAMIIRKAAAALAAGCTVVIKPSPETPLSVLALADLALQAGFGPGVINVLTTDNLNTPDVSEALCKHPLVRKVTFTGSTAVGQLIARHCSEGLKKVTLELGGNCPFIIFDDGDLEQALAALMILKWRTAGQACTHANRVYVQSGVYDTFLRMIVNATKQLKVGHGASPGTTMGPLTTSRGIEKLERHVADALAKGARLELGGHRLQLEGNYFQPTIISGMSAYMLTTQEEIFGPLLGLYRFETEEEAVRMANDTSMGLASYFFTRDVSRTWRLLENLEAGMIGMNTGNSSAAESPFGGIKASGYGKEAGKDVAIEEYLIAKTGTLTVGAVSKL

SEQ ID NO: 11424 - protein, 317 aa, Staphylococcus epidermidis RP62A
MKMEKEQAHWIYKTMNEIRFFEEKVHKIFSDGRIPGFVHLYVGEEAVATGVMSQLNDDDYITSTHRGHGHAIAKGCDLNGMMAEIMGKRDGLGHGKGGSMHVAEIDKGMLGANGIVSGGFGLAIGASISIINQGKDNVAVCFFGDGAANEGNFHEGLNFASILDLPVLFICENNQFAEGTTHDYASASETIAERAAAYNMPGVRVDGMDVMEVYKATQEAVERAKKGEGPTLIECDTYRKYGHFEGDEQKVKSPDDRNADKNATVEFRKRAIEENWLTEKEADEIEKAAEQAVEDAVKFAEESELPDEDSLYKDVFA

SEQ ID NO: 11425 - protein, 127 aa, Coprinopsis cinerea okayama7#130
MADSMDVDTPAPAAGGSAVPKKKEGKEGGKPRFEVKKWNAVALWAWDIVVDNCAICRNHIMDLCIDCQANQVSATSEECNAAWGICNHAFHFHCISRWLKTRNVCPLDNREWELQKYDPLISSSILY

SEQ ID NO: 11426 - protein, 410 aa, Triticum aestivum
MELRLRAPASPASASPRGTSVSPSPRPHPRLPSQPIQKRLSGSAVSVSRRGTAARSSLCSALMAASYNTGTPDLVDFDWETLGFQLVPTDFMYIMKCSSDGVFTKGELVPYGPIELNPAAAVLNYGQGLLEGLRAHRKEDGSVIVFRPEENALRMRIGAHRLCMPAPSVEQFLSGVKQTILANKRWVPPTGKGSLYIRPLLIGSGAMLGVAPAPEYTFVVYVCPVGHYFKDGLSPISLLTEEEYHRAAPGGTGDIKTIGNYASVVSAQRRAKEKGHSDVLYLDPVHKKFVEEVSSCNIFMVKDNVISTPLLTGTILPGITRRSIIEIASNLGIQVEERLIAIDELLDADEVFCTGTAVVLSPVGSIVYHGRRVEYGGGKVGAVSQQLYSALTAIQKGLVEDSMGWSVQLN

SEQ ID NO: 11427 - protein, 196 aa, Lactobacillus acidophilus NCFM
MIIKSSEYAVSAVKEEQYPKDNLPEIALAGRSNVGKSSLINTLLKRKNLARTSSQPGKTQTLNFYLVNDDFYLVDVPGYGYAKVSQKRRQEFGEMIQDYLETRPNLKGLIILIDSRHEPTKDDISMYEYAQYLNIPILVVCTKMDKIKKNQTNKVMTGLRKKLDLNYDHVTVLTFSSVTKFHVTELGNWIEDKISQ

SEQ ID NO: 11428 - protein, 282 aa, Zea mays
MAAAAVAGSRSREERWSLAGKTALVTGGSKGIGRAIVEELAGFGVRVHTCARTAADLDERLRAWAADARLPGRVTASVCDVSARGDREALVAAARAELGPRLDILVNNAGQSMFRAATETAAGDYARLMATNLESCFHLAQLAHPLLLAAGAGAGAGAAVVNVSSIAGLVAYPALAAYSATKGGLNQLTRSLAAEWAGDGVRVNCVAPGGVQTDMFSSVALEMDPDPETSLRMMEAELARVPLRRFGETEEIASLVAFLCMPASSYITGQVICADGGRTIAA

SEQ ID NO: 11429 - protein, 435 aa, Lactobacillus acidophilus NCFM
MNPQIMEKQVNEKGHLTIGGVDTLELAKKYGTPLVVYDVNRIRNQIRAFKKVFEEEGVSYAVSYASKAFACIAMYQVANEEGAYTDVVSAGELYTALKAGFPAEKISFHGNNKSLAEIEMAVKNHVGKIIIDNFHEIELLDQVLHQYDTQINVMLRITPGISAHTHEYDQTGQIDSKFGFDLESGQADLALERVLANSRMNMLGIHAHIGSQIFELNGFELAAKKLMEVAENWRSQYGYTAKIINVGGGFGIKYTADDNPLKPEEFVRTIIETIKKGSADAAFPTPEIDIEPGRSIVGPAGYNLYTVGSCKTIPSYSPYVAVDGGMGDNIRPALYQAKYDVVLANNPKAPVVNRVRIAGKYCESGDILATESLPEVKSGDVLAMLDTGAYGYSMASNYNRNPRPAVVFAENRKAHLVVKRESLEDLVHLDRFCKE

SEQ ID NO: 11430 - protein, 261 aa, Candidatus Protochlamydia amoebophila UWE25
MKLQLFLFATILNILPLVYVSATEEKKPANSEIPQTQDLVNQVLTFARNHQDFKNLYFKEHEHEFIRLAEQGQNPHTLFIGCSDSRMVPDLILGTKPGELFVIRTAGNFVPPYDQNGWDGVSATIQYALEALDVKHIIICGHSHCGAIKGLFQTINSTQLGILKRWLQFGNEAKETTMKIVKPETSEKDLYTVAEQISVVYQLAHLMTFPAIKKKVDEKTLDLHGWYYKIETGEVSYYDPETFVFKPLKKLKAQALQSILN

SEQ ID NO: 11431 - protein, 135 aa, Kluyveromyces lactis NRRL Y-1140
MGVWLFIFAVIANCVNLFAQVHFTILYADLEADYINPIELCSKVNKLILPEAALHGFISLLFLLNGYWFVFLLNLGILAYNGNKFYKKQQLLDATEIFRTLGKHKRESFIKLAFYLFLFFFYLYRMIMSLIAASE

SEQ ID NO: 11432 - protein, 371 aa, Pyrococcus horikoshii OT3
MARLKPLHEPLYLTAVFRQVGEAYLTPRNTELKYSREENPTVLNLENKLAKLEGADNALAFNSGIAAIATLYFSFLEAGDEAVLSMEGYGTTIELARLIGRRFGVKIRLAYPRAEDIVEEINERTKLVLIETMTNPTLKVIDVREVAKRCREVETILVVDNTFVTPLLYKPLKDGANFVVHSLTKYIAGHNDVLGGAILWNGEFIHDLWNWRRRLGGIIQPFDAWMIERGMRTLEVRFERQSKNAQAIAEFLSEHPKVKEVHYPGLEDDPYHEIAKKLFERDLYGGVVSFDVGNESNAIVFLRSIKKIFPSPSLGGVESIVTYPVKSAARYINEEQREALGITEGLIRLSVGLEPLDELLEDLDKALEVVK

SEQ ID NO: 11433 - protein, 477 aa, Kluyveromyces lactis NRRL Y-1140
MEQVDLVNANVLAAGANKKSVRVVNGLGSLMGSKQMADVDFENDSNMDYLLEQDKKEKEKYKNKRHISELPWTLNNWHLHLNWLNLILVVAIPLYGVYMALSGRVPLRHEILIFSMIYYCIGGISITGGYHRLWAHRAYSAHWPLRLFFAVFGAASVEGSIKWWSHSHRIHHRYTDTVRDPYDARRGLWYSHMGWMLLQPNPKHRARADIADLTDDWIVRWQHRNYIPLMLFSAFILPALFCHYMWNDFWGGLIYGGVLRVCAIQQATFCINSLAHYLGDQPFDDRRTPRDNWITALVTFGEGYHNFHHEFPTDYRNAIKWYQYDPTKVLIYLTSLFGLSYDLKKFSQNAIQQGLVQQQQKKLDRTRSKLNWGSPLSKLPVWDKDEFMEKLKSNNGLVVISGIVHDVSGYITEHPGGETLIQASLGKDATKAFNGGVYLHSNAAHNILATMRIAVVKDNVDQAAKFAARRGEVYEKK

SEQ ID NO: 11434 - protein, 376 aa, Oryza sativa (indica cultivar-group)
MATAGKVIKCKAAVAWEAGKPLSIEEVEVAKEMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFIGTSTFSEYTVMHVGCVAKINPAAPLDKVCVLSCGISTGLGATINVAKPKGSTVAIFGLGAVGLAAAEGARIRGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEAIRCIIRMEN

SEQ ID NO: 11435 - protein, 774 aa, Arabidopsis thaliana
MKFFGWMQNKLHGKQEITHRPSISSASSHHPREEFNDWPHGLLAIGTFGNKKQTPQTLDQEVIQEETVSNLHVEGRQAQDTDQELSSSDDLEEDFTPEEVGKLQKELTKLLTRRSKKRKSDVNRELANLPLDRFLNCPSSLEVDRRISNALCDEKEEDIERTISVILGRCKAISTESKNKTKKNKRDLSKTSVSHLLKKMFVCTEGFSPVPRPILRDTFQETRMEKLLRMMLHKKVNTQASSKQTSTKKYLQDKQQLSLKNEEEEGRSSNDGGKWVKTDSDFQASVHEYRSERFVSKGNAFVFHGGSEGIYSSSPSDNFTSDSDSVSFIRFEKIKFQRPEEVSNRSSLSIHAVVFEVEDRENIGGSAYGGQRAVCCTSDLAKLGVCSHGDVIYRPSAKDSGWPQVFGVSLAENEFSVILPTRSIQVTRTGMYNLYFIHCDSDLKDLVVEGKTIWKNPTGYLPGRMAPLMYFYGFMSLAFVLLGIFWFSQCARFWREVLPLQNCLTLVITLGMCEMALWYFDYAEFNETGIRPTVITIWAVTFGSIKRTSARIIILMVSMGYGVVRPTLGGFTSKVIMLGVTFFIASEILELMENVGAVSDLSGKARLFFVLPVAILDAFFIIWIFKSLSATFKKLQTRRLLVKLDIYRKFTNALAVDILVSLGWICYELYFKSKDVYNEHWQNAWIIPAFWQLLSFSLLIVICSLWAPSQNSTRYAFSGSSGDTSAEFEKDDYTLTLIKPSPIPSHEVKNLSETRLLPADEGEPEKDLEEDKRE

SEQ ID NO: 11436 - protein, 223 aa, Cryptococcus neoformans var. neoformans B-3501A
MFANSLRQGLRTASRSSARAFSTIPARAPRTNVVGALALGTAVAGYALYETTRSPVMLEGARTIAGEKGTVTERSFVMIKPDGVSRQLVGKIVSRFEERGYKLVAIKSLTPSDALAKEHYADLSARPFYPSLVKYITSGTPVVAMVWEGKDVIRQGRRIVGATNPLDADAGSVRGQYAVSVGRNLIHASDAFESATKEIGLWFAPEELSEYEPIAWPWVMADN

SEQ ID NO: 11437 - protein, 394 aa, Zea mays
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIVRSAGNKAASAATQPLLLPSSTPTDNV

SEQ ID NO: 11438 - protein, 295 aa, Chlamydomonas reinhardtii
MATYALPLHHHGKSKVRLGRVWRDGTVHHMVEWNVNTMIDSDMEHAFLNGDNTGMTATDTQKNTVYVVAQRMSQKCTIEQYAIALAQHFVRTYPLVSKAKIYVEQKPWTRVQQSGLPHDHGFALQGTEVRTVYVTYDKAGTLDVTAGLKDLSLLKTTQSGYEGFLRDQYTLLPETNDRIMASTVTCTWKYAAAPACYDAAYAAAKQGLLDAFLGPGARRRVQPSVQYTLYDMAKNILDRVPTSESIFLNMPNLHFIPCNPVGSSFNNDVYVATSEPHGNIEAVITRKGIAPHCKL

SEQ ID NO: 11439 - protein, 311 aa, Lactobacillus acidophilus NCFM
MATLIDADLLTAIVTPFDENNKIDFSSLEKLVNYLIGQGCNGFVVGGTTGETPTLTHDEKIDLYKHFSQFVNKRVPIIAGTGSNNTAETIAFTNEVAQIEGIDYALIVVPPYNKPNQRSMVAHFSAINDATKIPFLIYNIPGRTGVKMEKETIVQLSRLDNIKGIKQCASLEEMEYIIENKDPDFQVFTGEDTQALTARLLGANGVISVASHIYANQMRRMYDSLYEGNYPLAAKIQRWLTPRMQALFMYPSPAPVKAVLNAQGLNVGGCRLPLVELNDEEKITLAQRLGLDDNALMQKLPLDLGKELEDD

SEQ ID NO: 11440 - protein, 391 aa, Lactobacillus acidophilus NCFM
MPELASDLGLSKKIQDVRASGIRIFDNKVSTIPGIIKLTLGEPDMNTPEHVKKAAIKSIEENDSHYAPQKGKLELRKAISNYLNKVTGIDYNPETEIIVTVGATEAINATLFALTNPGDKVAIPTPVFSLYWPVATLADADYVLINTAEDDFKLTPQKLEKAVEENPAIKTVILNYPTNPTGVEYTEDEIRALAKVIEEKHLYVITDEIYSSLTYGVKHFSIASLIPERAIYISGLSKSHAMTGYRLGYVAGPAKIMEQIGKVHGLMVTTTTDSSQAAAIEALENGLDDPDEYRRVYQKRRDFVLKALEEMGMHAVKPDGAFYIFAKIPAKYGKDDMQFALDLAFKEKVGITPGSAFGPGGEGYVRLSYASSDENLHEAMKRIKQFLQEDK

SEQ ID NO: 11441 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAAAGIEARGFIFGPAIALAIGAKFIPLRKPKKLPGEVFSESYVLEYGMDCLEMHVGAIEPGERVVVVDDLVATGGTLSAAIRLLERAGANVAECACLIGLPKFKDFYKLNGKPVYILVESRK

SEQ ID NO: 11442 - protein, 364 aa, Prochlorococcus marinus str. NATL2A
MNMNEVMSHNQDKTGQNPIQHREHADRLSNLGNTKPAQINREIGLNLFKDMTLGRRFEDKCAEMYYRGKMFGFVHLYNGQEAISTGVIGAMKRKHDWFCSTYRDHVHALSAGVPAKEVMSELFGKETGCSKGRGGSMHLFSKEHHLLGGYAFIGEGIPVALGAAFSSKYKREALKENSDSVTAAFFGDGTCNIGQFYECLNMAQLWKLPIIFVVENNKWAIGMAHDRATSETEIWRKASAFGMPGEEIDGMDVLAVRGAAERALERARAGEGPTLIECLTYRFRGHSLADPDELRSEREKEFWAKRDPIKKLKNDLTSSGLVFDEELKNIEKEIDLEVNDAVEFALNAPEPDPSELTKYIWAEN

SEQ ID NO: 11443 - protein, 517 aa, Prochlorococcus marinus str. NATL2A
MILNWPQSDSEHLMVSSEQMQNIEKEMFSMGMPVEALMEKVGIGISSWILDRHGLIENGAIVLVGPGHNGGDGLVVARELYMAGVDISIWCPFPLKKQLTQKHFHYAMQIGIENLERKPDSNSDLLWIEALFGLGQSRIISDEIIRLLNSKKTFSPEKLISIDVPAGLDSDNGNIVSNTSCKASSSLTLGLFKSGLIQDSAIDYVGNLERVDIGIPDKILAGFPETQPLRISFSDLSTFVWPMLSKSKSKYQRGRVLVIAGSEKYRGAASLALNGALASGVGSVSAFLPNSVSSALWITHPEVLLLGDLTAFQDGSSDFSKVLNEVDLNRFDSILLGPGLGIADEKDCFGSDLQDFKGLLVLDADAINRLSITSKGWEWLNDREGPTWLTPHLEEFKRLFPLIDCSNPLKAGIEAAKTCSSSVLLKCAHSVISDPEGKTWQIGQVNSSVARTGLGDVLAGFVSGMGASGLASDKKLDTSLLAASALMHAYAGAFSIKGSTASTICTFLGELIKKEST

SEQ ID NO: 11444 - protein, 480 aa, Pyrococcus horikoshii OT3
MCLIAGGFKLYTDEIIRIIELGKHRGPDSFGVWSEREVIKSSDFSALEEVKGGDKVLIQCRLAMTGSKEYTQPFYNEIALVHNGEIYNHEKLRAYLVERGISFESDVDSEVILRLLEYLLFDRNLSPWNAIKKLMWMLRGDYAVAFHYNGKFYLFRDPLGIRPLYYSSQGHFGSEKKVLWGLGEEATPVMPGEAVEISKFGINRVRLYDVTAIKSFGSEYFDGLRNLLIDSVKIRSSKKIGILFSGGLDSTLIAFIASRYSNVTLYVSGTEDSKDVEWARKVSQELGLKLKEYIFSKEEVEKELKRIMFAIEEPNPMNLSIAIPLYFSTKLAREDGVKILLSGQGADELFGGYAKYLENPNLMISDVANLGERNLARDDKVSMINGVEVRYPYLDLPFAVLALNTPLQHKIKDGKRKIILREIAKSLGLPEWIAEREKKAAQYGSNAQKILEKIAKSRGIRLKELASLLFSEVFRGIHNR

SEQ ID NO: 11445 - protein, 604 aa, Zea mays
MARKMLIDGEVAAVADGGHYDWVRIRRGTFCVKCGGKVRCTCKQRCALLTEFELSRGGEAEPQSRPRPAGDIHTVRAPEAGSTGDEAFRVITHQDLRVLFRFAGVGNPSMARKMLIDGEVAAVADGGHYDYDLFVIGAGSGGVRGSRTAASFGAKVAICELPFHPISSEWLGGHGGTCVIRGCVPKKILVYGASFRGEFEDSKNFGWEINGDINFNWKTLLENKTKEIVRLNGVYQRILTSAGVTMIEGAGSLVDAHTVEVSQPDGSKQRYTAKHILIATGSRAQRVNIPGKDLAITSDEALSLEELPKRAVILGGGYIAVEFASIWRGMGAEVDLFYRRDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 11446 - protein, 543 aa, Zea mays
MEEAHLTPATPSPFFPLAGPHKYIALLLVVLSWILVQRWSLRKQKGPRSWPVIGATVEQLRNYHRMHDWLVGYLSRHRTVTVDMPFTSYTYIADPVNVEHVLKTNFTNYPKGIVYRSYMDVLLGDGIFNADGELWRKQRKTASFEFASKNLRDFSAIVFREYSLKLSGILSQASKAGKVVDMQELYMRMTLDSICKVGFGVEIGTLSPDLPENSFAQAFDAANIIVTLRFIDPLWRIKRFFHVGSEALLAQSIKLVDEFTYSVIRRRKAEIVEVRASGKQEKMKHDILSRFIELGEAGDDGGGFGDDKSLRDVVLNFVIAGRDTTATTLSWFTHMAMSHPDVAEKLRRELCAFEAERAREEGVTLVLCGGADADDKAFAARVAQFAGLLTYDSLGKLVYLHACVTETLRLYPAVPQDPKGILEDDVLPDGTKVRAGGMVTYVPYSMGRMEYNWGPDAASFRPERWINEDGAFRNASPFKFTAFQAGPRICLGKDSAYLQMKMALAILFRFYSFRLLEGHPVQYRMMTILSMAHGLKVRVSRAV

SEQ ID NO: 11447 - protein, 441 aa, Zymomonas mobilis subsp. mobilis ZM4
MSKNGRPDRIVVVGGGAGGLQLVRALGERFGKEADVILVDRSPTHVWKPLFHEVATGALDADLDEVSYRYHGKHWGYHYVRGTLEDIDRKNHEIILEPLVDEEGHKISDQERLRYDYLVLALGSVANDFNTPGVRENCLFLDSRAQADRFREHLFDACASASRTMIAQPGMEKPVRVTVIGAGATGVELSAELYNTAIELGNFGLEKFGANCMQVTLVEAAPRILAPLPEFMAEDAHTVLQRLGVDIKTNTMVVEAGEGFIKTKDGQTIESDIQLWAAGVKAPDFLSKVEGLEVARSNQIIVKPTLQSTTDDRIFAMGDCCSCKLPEAERPVPPRAQAAHQMADTVFENIVRLRKGEPLKDFAYRDYGTLLSLSRFAAIGDLSLSGKKNVGKRVVKGRIARFFYNSLYRLHLLAIHGWVKGSAVLAAAMAHSMLRPKVKLY

SEQ ID NO: 11448 - protein, 164 aa, Kluyveromyces lactis NRRL Y-1140
MSTPARRRLMRDFKRMKEDSPPGVSASPLPDNVMIWNAMIIGPADTPYEDGTFRLLLEFDEEYPNKPPHVKFLSEMFHPNVYANGEICLDILQNRWTPTYDVASILTSIQSLFNDPNPASPANVEAATLFQDHKSQYVKRVKETVEKSWEDDMEDMADEDEDEE

SEQ ID NO: 11449 - protein, 425 aa, Oryza sativa (japonica cultivar-group)
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 11450 - protein, 375 aa, Oceanospirillum sp. MED92
MVDKKLSGAGLRGQSAGETALCTVGKTGAGLTYRGYDIKELADKAQFEEVAYLLLYGKLPNQAELDAYKAKLKSLRGLPEALKTVLEQIPAEAHPMDVMRTGCSMLGNLEEEKDFSEQHDHIDRMLAIFPGMINYWYNFSHNGVRVNVETDADSIAEQFLWTLHNEKPEPLHVEVMHASLILYAEHEFNASTFTARVCASTLSDIHSCVTGAIGSLRGPLHGGANEAAMDMIEQWKSADEAEAAIMGMLERKDKIMGFGHAIYRESDPRNAIIKEWSKKLSAQVGDTHLYAVSERVEAVMWREKKLFCNADFFHASAYNFMGIPTKLFTPIFVCSRAAGWTAHVMEQRANNRIIRPSADYTGPESAEWVAIEDRP

SEQ ID NO: 11451 - protein, 705 aa, Aspergillus nidulans FGSC A4
MDTFTSLTPPWNAGGGFMRSYFDSAASAGKAARDFLRSHERFSRACLCICIGYALSVWMLPVRIPITIEGFTTSLTIPQTQRLDQGDTILQVHADPSAKIRIHNDSHTESPIQHSEAWLEAVRQACGSSAEAETQMLAMHRGLAKRDIASVSVSSADGSGQAQAYQQVYLFKCGDVAGAFDKSDDARLNRAFVHNITIGAYLNSRATGALSISALAYWVPQLVLAAALALAVLGSWNPKQKASSPSGPATRSARSRTVVTQPPVPKAVAARPIVGSGHSKRPSDVEIRAMPESQIIELGTLGQIPLYSLERALQDPLRAVKLRRQIVSQHQATGNIDFTTDGSALPYEGYDYKAVLGACCENVIGYMPIPVGVAGPIKINGKMVFLPMSTTEGALVASTNRGCMAINAGGGVTALVLGDGMTRAPIVRFPSLEEAGAAKQWLGSDAGFLIIEDAFNASSRFARLQNIKATAVGSDLYIRFTASTGDAMGMNMISKGVEQALEAMQKHGFESMDVVSLSGNFCADKKPAAVNWIEGRGKTVTAQATIPEHAVRETLKTSVEALVELNVSKNLVGSAVAGALGGFNAHAANVVTAIYLATGQDPAQNVQSSNTLTVMKNVNGDLQISVFMPSIEVGTVGGGTVLGPQKAMLHMMGVQGADPEQPGRNAQELALLVAAGVLAGELSLCSALSAGSLVKSHLTHNRKKG

SEQ ID NO: 11452 - protein, 172 aa, Streptococcus mutans UA159
MDLKNYIATIEDYPQEGVTFRDISPLMANGNAYSYAIREIVQYATDKKIDMIVGPEARGFIVGCPVAYELGVGFAPVRKPGKLPREVIEAHYEKEYGIDTLTMHADAIKPGQRVLIVDDLLATGGTVKATIEMIERLGGIVAGCAFLIELDGLDGRQAIEGYDTKVLMNFPG

SEQ ID NO: 11453 - protein, 99 aa, Chlorogloeopsis sp.
MSVYVGNLSYEVTEDSLNAVFAEYGSVKRVQLPTDRETGRVRGFGFVEMGTDAEEAAAIEALDGAEWMGRDLKVNKAKPKEDRGSFGGGRGSYGGRNRY

SEQ ID NO: 11454 - protein, 295 aa, Oryza sativa (indica cultivar-group)
MALLSPRVPRLPLASASASAAGAGLRCCVGVGGGGGRAGSAAWCHATAAGSVAASSSELEAIRDELYKECAAALDGGAVLSTKNLDAITDSIQRAFATVDANLSTWLEQMDKEDESGATATAMFLRNDVLVVSHIGDSCLVVSRGGRPQAVTNFHRPYGNKKASLEEVKRIRAAGDLIVSSPDVSLVELGPDVEFVLLATDGLWDYIKSSEAVALVRDQLRQHGDVQVACEALGQIALDRRSQDNISIVIADLGRTNWKELPVQRPNLFLELTQAVATVGAVSLGIYISSLLALQ

SEQ ID NO: 11455 - protein, 250 aa, Pseudomonas aeruginosa PAO1
MTAPFKDHFSTGSANYAAHRPTYPAQLVDELAALCPGTRLALDCGCGTGQLTVLLAERFERVVGTDASAAQIDKAQARERVEYRVALAEDSGLAAASADLVTVAQAAHWLDLPRFYEEVRRVARADAILALVTYGVLHVDGPMEPLVQHFYHQVVGPYWPAERRHVEEGYRNLPFPFEERRLPDLAIEVAWTLDELLGYVGTWSAVKEAGKALGQDPGAAFVDELREAWGDPQTRYRVSWPLTVRAGVIR

SEQ ID NO: 11456 - protein, 487 aa, Medicago truncatula
MVLKDLCDRIVAAKCSSKSSTEIVDNTQVPASSKAGSSDSKFPKASLWSTFFTSGFSVDETYSESSSSEKKTVHSRNSGWAAAVRKVVSGGSMRRFQERVLGSCRTDVSSSDGDIWLLGVCHKISQHESTGDVDIRNVFAAFEQDFFSRILITYRKGFDAIEDSKYTSDVNWGCMLRSSQMLVAQALLFHKLGRSWRKTVDKPVDKEYIDILQLFGDSEAAAFSIHNLLQAGKGYGLAVGSWVGPYAMCRTWEVLARNQREKNEQGEQLLPMAIYVVSGDEDGERGGAPVVCIEDACKRCLEFSRGLVPWTPLLLLVPLVLGLDKVNLRYIPLLQSTFKFPQSLGILGGKPGASTYIIGVQNDKAFYLDPHEVKPVVNITGDTQEPNTSSYHCNISRHMPLDSIDPSLAIGFYCRDKDDFDDFCSRATKLAEESNGAPLFTVAQSRSLPMQVTSNSVSGDDTRFEEDDSLSMNLVNDAGNEDDWQFL

SEQ ID NO: 11457 - protein, 210 aa, Zea mays
MADSGALVVTEAQQQHPLSQIAASETHRLLLKQWVKEEDLLARRVALWEACLNGARKEIAFLYCAFFAFHAASVLLLFLSSSSSSAASAAATTACRRSWIPYLVSLLSSLTMLWALWYKSDTEAVLERVLAREREDALYLARCVTELKRKGLRFDLLKEVDALRRAKNLRAEAKGAADRPRRWQARDLAVFALFAAACGVLVLTRFLLCN

SEQ ID NO: 11458 - protein, 297 aa, Escherichia coli
MNSNLRGVMAALLTPFDQQQALDKASLRRLVQFNIQQGIDGLYVGGSTGEAFVQSLSEREQVLEIVAEEGKGKIKLIAHVGCVTTAESQQLAASAKRYGFDAVSAVTPFYYPFSFEEHCDHYRAIIDSADGLPMVVYNIPALSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYQPELKALAQQLMQERG

SEQ ID NO: 11459 - protein, 317 aa, Vigna radiata
MANFPVVDMGKLNTEERGAAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDKVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 11460 - protein, 317 aa, Vigna radiata
MASFPVVDMGKLNTEERGAAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDEVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 11461 - protein, 271 aa, Brassica napus
MTMFLQGDSIQIREVWSDNLEAEMDLIREVVDDFPYVSMDTEFPGIVFRPLENIKTITEYHYKTLRTNVNLMKMIQLGLTFSNESGNLPTCGSDKYCIWQFNFCDFDPVCSISNPESIKLLRDSGIDFKKNYEKGVHSKRFAELLLTSGVVLNENVHWVTFHGVYDLAYLLKVLIIQDLPEKPKGFDELIRLYFPRFCDIKHLMKFCIGLSGGLNKLAELLGVERLGISHQAGSDSLLTSRIFMILQDSFFNGSVEKYSGVLFGFSVENDH

SEQ ID NO: 11462 - protein, 323 aa, Brassica napus
  misc_feature (312)..(312): Xaa can be any naturally occurring amino acid
MTSPTALICETQAWKDLKGHVEDINKTHLRDLMSDAHRCESMMLEFEGLLLDYSRQRATVETMDKLLNLAKAAQLSEKISRMFNGEHINSTENRSVLHVALRAPKYAVIKADGKNVVPEVWNVLDKIEDFSEKIRSGSWVGATGKPLKDVIAIGIGGSFLGPLFVHTALQTDPEAAECAKGRQLRFLANIDPVDVARNISGLNPETTLVVVVSKTFTTAETMLNARTLRNWITTALGAPAVAKHMVAVSTNLALVEKFGIDPNNAFAFWDWVGGRYSVCSAVGVLPLSLQYGFSVVEKFLKGASSIDKHFQXTPFEKNIPVLL

SEQ ID NO: 11463 - protein, 317 aa, Vigna radiata
MANFPVVDMGKLNTEERGAAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKRYLKKVFYGSKGPNFGTKVSNYPPCPTPDLIKGLRAHTDAGGIILLFQDDKVSGLQLFKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 11464 - protein, 227 aa, Oryza sativa (japonica cultivar-group)
TFTACTSDFPLQDMVDYQRTLAREIEARLEAKCDALADLFAMDERDSSSISQISSARLPERVKLIIEEIEKEEALLLDDLASMDRKFAEHYNVLEQILAVLIQFVKDKKLEHQHQYDDLKKTWLIKRCRTMNAKLSYLEHHLLRDTYTKETVPALHRIRKYLVEATKEASNSYTEAVSRLREYQGVDPHFDVIARQYHEIVKKLEGMQWTIHQVEMDLKPHHDHADV

SEQ ID NO: 11465 - protein, 526 aa, Methylobacillus flagellatus KT
MQQKILILDFGSQYTQLIARRIREANVYCELHSWDVSDAFIREFNPAGVILSGGPNSVYEDETPRAPQSVFELGVPVLGICYGMQTMAAQLGGSVENAAKREFGYAEIRAQGHSALLKGIQDKSNAEGHGLLDVWMSHGDKVTALPEGFKIIASNSATPIAGMADENRRFYAVQFHPEVTHTKQGKALLNRFVHDICGCDQSWNMPDYVETAVQRIREEVGCDEVILGLSGGVDSSVAAALIHRAIGDQLTCVFVDNGLLRLNEAEQVMETFGKNLGVKVIHVDASAKFLGDLSGVNDPEAKRKIIGREFVEVFQQEAAKLPQAKWLAQGTIYPDVIESAGAKTKKAHTIKSHHNVGGLPDTLKLKLLEPLRELFKDEVRELGIALGLPHDMVYRHPFPGPGLGVRILGEVKREYADLLRQADHIFIEELRSTKDADGKSWYDKTSQAFAVFLPVKSVGVMGDGRTYDYVVALRAVVTTDFMTAHWAELPYDLLGKVSNRIINEVRGINRVVYDISGKPPATIEWE

SEQ ID NO: 11466 - protein, 402 aa, Triticum aestivum
MSLIRYLPSPYLPLPSAAARRRGFLHSAAPPGARAAAVHVLAANRVVLGCGLVTLDYLATVDAYPRPDDKIRSGELQISGGGNAGNALTGAARLGLNTRLISKVANDEIGGTVILELKEAGIDVSHVIISDGGNTTFVYVIIDKKTKTRTCIITSGYPPMVPGDISMSNLSAALQDVNLLYLDGYSHEMALSVGKQADLMKIPILVDAEPERTKTELEHLLGLSSYIVCSGKFPEKWTSISCIPSALLEILVQYPRARFVIATLGENGCMMLERIEDDSGIDAVDIGNVAESLRLKVHKDDNLPTCVSSKFMRLSGRGHGTIHGRLLIGTAEKIPAPELVDTTGCGDAFIGAVLYGEAYQLLPSLFMILSFAYRKKIAMNKPVGVLISRWHKLRPVIFAFNR

SEQ ID NO: 11467 - protein, 488 aa, Bacillus halodurans
MAHTVSEQRIHEVGSMKRDHYRMVINGERVDSDETFETFNPAKGEILATVAKASREHAEKAVQAARHAFDHGKWRKYPVGKRARVLNQIAAIMRERFQELVEIEVLNSGKAISAAQPQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYIGR

SEQ ID NO: 11468 - protein, 206 aa, Zea mays
  misc_feature (19)..(19): Xaa can be any naturally occurring amino acid
FPADPASASNFYPMNAWTXRAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRPVPLHDRKGVRYKSVRLLMRFDFV

SEQ ID NO: 11469 - protein, 354 aa, Zea mays
MAIEEDEDYEPPLMATYKHLLDSHPHRPLGAGAAQDDEDCFLLPVIDLSSLLPPVHHRKQSSSAAAAEQCRASIVRAASEWGFFQVTNHGVPQVLLDELHQAQAGVFRRPFQLKAHQPLLDFSPESYRWGTPTATCLEQLSWSEAYHIPTTTTTTGNDDKTRLVVEEVSTAMSKLAQRLAGILVAELGEDSAAAVVSRCTRSTCFLRLNRYPPCAAAASGVVYGLCPHSDSDFLTILHQDGVGGLQLVKDGQWVAVKPSPGALIVNVGDLLQAWSNDRYRSVEHRVMASATRERFSAAFFLCPSYDTLIRPRCGAGGPPPRYESFTFGEYRNQIREDVRLTGRKLGLQRFRKAE

SEQ ID NO: 11470 - protein, 1050 aa, Glycine max
MRPPRGGGRGGGFRGGRDGGGRGRGGFGRGGGGFGRGGGGYRDEGPPSEVVEVSSFMHACEGDAVTKLTNEKVPFFNAPIYLKNMTQIGKVDEIFGPINEAYFSIKMMEGIVATSYSSGDKFYIDPRKLLPLARFLPQPKGQSAGRGGGGGGRGGCRGGRGGGGFRGRGAPRGGRGGPPRGGAGFFFFFFFFFFIFSFCQTKIVVLVALAKMFSAGHKIKGTVVLMPKNELEVNPDGSAVDNLNAFLGRSVSLQLISATKADAHGKGKVGKDTFLEGINTSLPTLGAGESAFNIHFEWDGSMGIPGAFYIKNYMQVEFFLKSLTLEAISNQGTIRFVCNSWVYNTKLYKSVRIFFANHTYVPSETPAPLVSYREEELKSLRGNGTGERKEYDRIYDYDVYNDLGNPDKSEKLARPVLGGSSTFPYPRRGRTGRGPTVTDPNTEKQGEVFYVPRDENLGHLKSKDALEIGTKSLSQIVQPAFESAFDLKSTPIEFHSFQDVHDLYEGGIKLPRDVISTIIPLPVIKELYRTDGQHILKFPQPHVVQVSQSAWMTDEEFAREMIAGVNPCVIRGLEEFPPKSNLDPAIYGDQSSKITADSLDLDGYTMDEALGSRRLFMLDYHDIFMPYVRQINQLNSAKTYATRTILFLREDGTLKPVAIELSLPHSAGDLSAAVSQVVLPAKEGVESTIWLLAKAYVIVNDSCYHQLMSHWLNTHAAMEPFVIATHRHLSVLHPIYKLLTPHYRNNMNINALARQSLINANGIIETTFLPSKYSVEMSSAVYKNWVFTDQALPADLIKRGVAIKDPSTPHGVRLLIEDYPYAADGLEIWAAIKTWVQEYVPLYYARDDDVKNDSELQHWWKEAVEKGHGDLKDKPWWPKLQTLEDLVEVCLIIIWIASALHAAVNFGQYPYGGLIMNRPTASRRLLPEKGTPEYEEMINNHEKAYLRTITSKLPTLISLSVIEILSTHASDEVYLGQRDNPHWTSDSKALQAFQKFGNKLKEIEEKLVRRNNDPSLQGNRLGPVQLPYTLLYPSSEEGLTFRGIPNSISI

SEQ ID NO: 11471 - protein, 228 aa, Oryza sativa (japonica cultivar-group)
MSVFDSSRGSWEGPVALSRRPDAAALLPDDAPSQGGADDTVYFLSKSGDVVATNMQRSASKQYSSVVVAASSDGGDAVAYFLSHSGTVVACDTARRTFAELPRILPVYFEYSIDVVACDGAAYAVVLAEYLDTASLRVWGFAGGAWRQVAAMPPAMSHAFHGKKADINCVGHGGRLMVCVSSGEANGCFMCDVGSNQWEELPKCVNGDGEVNDFLAAFSFEPRLEISV

SEQ ID NO: 11472 - protein, 207 aa, Neurospora crassa
ARMLRTSNAMMPSVMGAAQRRALSDSAEPARVPSVESARVPEKLAKEDSPLATPKRNSPDYNVPIDKATSTWTPVPKHIQNGSEEGILPAAVVSGAPMELQARTVRIYLPSKPATQSSNSRVLWRMDWDVLEKGHRWENELMGWQSSGDFVQGTHLTFRTKEEAIQFAEKQGYEYFVQEPNQRHFTPKAYANNFLYSPKKLKIVRTK

SEQ ID NO: 11473 - protein, 519 aa, Triticum aestivum
  misc_feature (37)..(37): Xaa can be any naturally occurring amino acid
  misc_feature (92)..(92): Xaa can be any naturally occurring amino acid
  misc_feature (96)..(97): Xaa can be any naturally occurring amino acid
  misc_feature (117)..(117): Xaa can be any naturally occurring amino acid
  misc_feature (199)..(199): Xaa can be any naturally occurring amino acid
  misc_feature (206)..(206): Xaa can be any naturally occurring amino acid
  misc_feature (247)..(247): Xaa can be any naturally occurring amino acid
  misc_feature (458)..(458): Xaa can be any naturally occurring amino acid
MAGGAVVNTSGGKDYPGRLTLFVFFTCVVAATGGLIXGYDIGISGGVTSMNPFLKKFFPEVYNKKQMKGSANQYCKYDNQLLQTFTSSLYLXGLVXXFFAATVTRVVGRKWSMFTGXLTFLIGAALNGAAENIAMLIVGRILLGVGVGFANQSVPVYLSEMAPARLRGMLNIGFQLMITIGILAAALINYGTNKIKAGXGWRISLXALAAVPAGIITLGSLFLPDTPNSLIERGHPEAARRMLNRIXRGSDVDISEEYADLVVASEESKLVQHPWRNILQRKYRPQLTMAIMIPFFQQLTGINVIMFYAPVLFETLGFKGDASLMSAVITGLVNVFATLVSVFTVDRLGRRKLFLQGGSQMLVSQLVVGTLIAVKFGTSGVGEMPKGYAAAVVLFICLYVAGFAWSWGPLGWLVPSEIFPLEIRPAGQSINVSVNMLFTFVIAQAFLTMLCHMKFGLXYFFAGWVVIMTVFIALFLPETKNVPIEEMVLVWKGHWFWRRYIGDADVHVGANNGKGAAIA

SEQ ID NO: 11474 - protein, 209 aa, Zymomonas mobilis subsp. mobilis ZM4
MIDFQKLIMGYQRFRSGDWTDQHDRWEHLSKGQNPKVLVIACSDSRVDPAQIFDTNPGEIFVIRVVGALVPPYERELGHHGVSAALEYAVTKLEVSDILVMGHGACGGIKASLEGTGSEDEDDDFFIKSWISLLDDARDRVVAEHGHESDVACRLEHEGVRTSIANLRSFPFVRDREAAGKLDLHGAWFAIENGSLHLLEPKSSEFIRL

SEQ ID NO: 11475 - protein, 255 aa, Glycine max
  misc_feature (223)..(223): Xaa can be any naturally occurring amino acid
  misc_feature (244)..(244): Xaa can be any naturally occurring amino acid
MGDGSGSRWSRAEWVQQYDLLGKIGEGTYGLVFLARTKSPVGTPSKSIAIKKFKQSKDGDGVSPTAIREIMLLREITHENVVKLVNVHINHADMSLYLAFDYAEHDLYEIIRHHRDKLNHSINQYTVKSLLWQLLNGLSYLHSNWMIHRDLKPSNILVMGEGEEHGVVKIADFGLARIYQAPLKPLSDNGVVVTIWYRAPELLLGAKHYTSAVDMWAMGCIFXAELLTLKPLFQGAEVKATSNXFQLDQLDKIFK

SEQ ID NO: 11476 - protein, 191 aa, Medicago truncatula
MDVYNWFWNFKDNKSLNPYEQAISIIGKTLAPFAEDNLIPCFGFGDSSTHDQEVFGLYPDERLCNGFEEVLSRYREIVPNIRLAGPRSFAHIVKTATAIVERSGGQYHHVLMILANGQKDPSSDVGGRTNLKKLAQVTRTRHGRLSPQERKTMDAIVEASKFPLSIILVGVGDGPWDKMKEFCDNIPTKGL

SEQ ID NO: 11477 - protein, 478 aa, Vibrio parahaemolyticus RIMD 2210633
MHPNVYIPDAFLEKIQTILPANLNMEDFISACQRPLRKSIRVNTLKMSVEDFVKRAEDKGWTLSPVPWCDNGFWIEADESVVPLGNTAEHMSGLFYIQEASSMMPVSALFMNDESYDAVLDTAAAPGSKTTQIAALMKNEGVLVANEYAASRVKVLHANIERCGVRNAALSNFDGRVFGGWLPEQFDAVLLDAPCSGEGTVRKDEDAMKNWTQASVLEIADTQKDLIESAFHALKPGGVLVYSTCTLSTEENQQVCHHLKETFGDAVEFESLDGLFENANAALTEEGFLHIFPQVYDCEGFFVARIRKHHSVEAPQVKKRMGKFPFVKASKKESEEISKQLHNALDIELPSESTVWLRDKDVWLFPDALEPMIGELRFSRMGIKIAEAHKNGYRWQHQVATALATGAESNAIELTIEEAREWYMGRDVRPQIIPEGLKTGKGEVLVKYQGAIIGLGKWVSNRIKNGLPRELVRDKNLF

SEQ ID NO: 11478 - protein, 406 aa, Medicago truncatula
MAVGGGGSVKNPAICGCSAQPTGVGGGALVIRRNDAQHGSLSSQKLHTVDAIVEARKFPLSIILVGVGDGPWDMVKEFQDNIKMQTRTFHNFKFVNFTEIMSKSNNISPSLKEAEILLAIREILFQYKAAKELGLLGVALPTPSASRGTSKPYYRSASFPSASSRPYQSASFEGRAPFYPNDNNLASPSSTYYNKAKRESGLPLSLKKLGNTREKKSLTWKAFISHACDSVLDIPPKYHWALLLICVSFLSYQAKNTTAPFEYFQLEKTIKAPPQTLVLAFGEAFEVFFPEITHITKFMLCYFLTLMLVCSLQLGLQIFCILLIISAPLFYFPELVRRASKVGVDCGLFELPLIWFATLGAVGLSLICGILTLLLAYLSWRFLSKGKQNVEDVDVSLEELSEILQV

SEQ ID NO: 11479 - protein, 140 aa, Medicago truncatula
MVIESPKLIFGIDFSQSNQLTGKYSLIRQSLHDIRNVPNSCEKAISIIGKKFSPFLDDNLIPCFGFGDASTSDHDVFSFYRDERFCNGHEEILSRYREIRPNIQPAGTTSFAPIIEMATKIVDQSGGKHHVLVIISDGQV

SEQ ID NO: 11480 - protein, 243 aa, Medicago truncatula
KLADMKRDEEPEAKKNLDEKMKNVEVKETALANTEAHVTRHIPPYNSSATTPQEAYVLDKIILAEEWNYLQDIYYSLQKEVAADFSLYPSFIRNRINRLKKIEDDSEKKKLSCILSFINYLVKFKDQHSMDGISSSKFEKLPYTLYHRFTTMFDVTESRRLPPEKMNLLISYVLVLTLFSDDFRTDYRDIVKDLRMSTLTLRPIFEHLGCKFISSQKVSYATLPIPLTFSQIKKRKRKNKNKL

SEQ ID NO: 11481 - protein, 266 aa, Solanum melongena
DDGSVDRTWTGPPEVKFMAEPVSPHDDFVDGVAVKDVVADEKSGNRVRIYLPERNDSSVDKLPVVLHFHGGGFCISRADWFMYYAVYTRLARVANVIIVSVFLPLAPEHRLPAACDAALAALLWLRELSRKQSQEPWLNDYADFNRVFLIGDSSGGTIVHQVAARAGEEDLSPMKLAGAIPIRPGITRSQRSKSELEQEQTPFLTLDMVDKFIALALPIGSTKDHPITCPMGEAAPALEELKLPPYLYCVAEKDLIKDHEMEFYEA

SEQ ID NO: 11482 - protein, 1050 aa, Legionella pneumophila str. Paris
MLEKQSIHLPEGLRAAINKAYRMDELSLITELSEQAALDPQQMMAIKTSATKLVQSVRSERKKSTGIDSFLTEYALSSDEGIALMCLAEALLRVPDNATIDNLIKDKLAGGDWGAHRGQSESFFVNATTWALMLTGKVLTPEKAENTLTKALLKLVNRSSEAVVRKAVDKAMRIMSKQFVMGRTINEALARAKKKEDRGYRYSYDMLGEAALTSADAARYFEAYKEAIISIGEKADKHSDVYRRPGISIKLSALHPRYSEFQYERVMAELPPKLLALSRLAKDYGIALTIDAEESERLDLSLDVIEKVFTDESLQGWNGFGLAVQSYQKRAFYVLDWVAALARSKQRRIMVRLIKGAYWDSEIKKTQMQGFSEYPVFTRKVFTDVSFQACAKKILTMTDAIYPQFATHNAYSVAMILNLVGGYRDFEFQCLHGMGNELYEQIVPANCYGIPCRIYAPVGSHEDLLPYLVRRLLENGANSSFVNRIVDDKAPISELVEDPVAKSRSLLDKINKNIPLPEDIFLPVRKNSKGFDFTNRLERALLQQELAKIESKEWQASPMIAGRKLSSDLLQTVMSPQQPAYAIGSVQQATLDDVEVALNQAKLAFESWSKKAVEERASCLNRFADLLQANMSELMVLTCREAGKTWSDGIAEVREAIDFCRYYAKKAQELMSSPQRFNGYTGELNELSLHPRGTILCISPWNFPLAIFTGQVVAGLVTGNCVIAKPAEQTPLIAAYAVKLMHQAGIPEGVIQLIPGAGETIGAALVADKRIKAVLFTGSTDTANLINRTLATRGGEIIPLIAETGGQNAMIVDSSALLEQVVVDAVTSAFGSAGQRCSALRVLYVQEEVYPRTVELLKGAMAELVVGDPQWLSTDVGPVIDKEALSILKNHVENMRKHHEILYQCTVDDEALSGYFMPPTAIAIDSISALEKEVFGPILHVIQFKRKDLDKVINQINQTGYGLTLGIHSRINETVDYIRQRVHAGNCYVNRNMIGAVVGLQPFGGEGLSGTGPKAGGPNYLIRLCHERTYTVDTTAAGGNASLMSIPEEG

SEQ ID NO: 11483 - protein, 468 aa, Streptococcus mutans UA159
MSKTLPKDFIFGGATAAYQAEGATHADGKGPVAWDKYLEDNYWYTAEPASDFYHQYPVDLKLAEEFGVNGIRISIAWSRIFPKGYGAVNPKGLAFYHNLFAECHKRHVEPFVTLHHFDTPEALHSNGDFLNRENIEHFVNYAEFCFKEFPEVNYWTTFNEIGPIGDGQYLVGKFPPGIQYDLAKVFQSHHNMMVAHSKAVKLFKDGGYSGEIGVVHALPTKYPYDPNNPADIRAAELEDIIHNKFILDATYLGKYSEKTMEGVNHILAVNGGQLDLREEDFAALEAAKDLNDFLGINYYMSDWMRAFDGETEITHNAKGEKGSSKYQIKGVGRREAPVNVPKTDWDWIIYPQGLYDQIMRVKQDYPNYKKIYITENGLGYKDEFVNHTVYDDARIDYVKKHLEVLSDAIADGANVKGYFIWSLMDVFSWSNGYEKRYGLFYVDFDTQERYPKKSAYWYKKLAETQIID

SEQ ID NO: 11484 - protein, 335 aa, Bdellovibrio bacteriovorus HD100
MSKLRVGINGFGRIGRVLFRAGFEKFDIVGINSLDSIEGDAHLLKYDSAHGVFNADVSTEGHNLIVNGKKIAVSKTRNPAEVPWKDLGVDLVLECTGAFKKREDFMQHISAGAKRVLVSGPAEKGADITMVYGINHESYDPSKHVVVSNASCTTNCLAPLAKVLNDTFGIEHGTMMTVHSYTNDQKILDAPHSDLRRARAAAVSMIPTTTGAAKNVGLVLPELKGLIDGISVRVPTPNVSLVDFTFTAKKDVTRESVNEALIKASEGAMKGVLAVEHNELVSVDFNGNKHSSIVDLATTMVVGPRMVKVLSWYDNETGFSNRMVDVALHMQKKGL

SEQ ID NO: 11485 - protein, 401 aa, Bdellovibrio bacteriovorus HD100
MANGLKGIKTVRDFELAGKVVFLRLDLNVPMENGKITDENRITASLPTIKYCMEQGAKLVMASHLGRPKTKDDTEFSLEPVAKRLQDLLNAEVILVEEPDSDAPKHLLPSLKPHQLILLENVRFEEGETKDSVEFAQKIANYSDIYINDAFGASHRAHATIHALPSVMKDKGIGFLIEKEITMLDSLLQNPKRPYIAVMGGAKVSDKIAVIERLMDVVDGFIVGGAMAYTFLKAQGLPVGKSLVENDKLKYAKEMIERIEARNKTILLPVDHVATKGITDTAHAHVTNDVAIAEDELGVDIGPKSIKNFSAALREAGTIFWNGPMGIFENPAFAKGTFGVAQAIADSEAIKIVGGGDSAAAAEASGFAGKMTHISTGGGASLEYLQGDKLPGLEILRTRIR

SEQ ID NO: 11486 - protein, 428 aa, Lactobacillus acidophilus NCFM
MLKSVIENVHALEIFDSRGNPTVEVHVTLSNGVVGKAEVPSGASTGENEAVELRDGGSRLGGKGVSKAVNNVNTEINDALKGMDPFDQPKIDQTMIDLDGTPNKGRLGANAILGVSMATAVAAANANRQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIIKAGYKPGEDIGIACDCAASYFYNKEDGKYHLEGKVLTDDELAAYYDKLLDEFPELMSMEDPYDENDVEGMVKFTATHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 11487 - protein, 241 aa, Bdellovibrio bacteriovorus HD100
MKKIFAANWKLFKSPKETREFFGQFKELAGKATGEVVFFPSAISLEAASESLKGTSIKFGAQNCYFQAQGAFTGENSAQVVKDLGGSYVLIGHSERRAIFGEGDALVADKVAFVQGLGLTPMLCIGETLQERESAKTFRVLETQLNLGLAKADKTKPVVVAYEPVWAIGTGKVATPEQVAETHTDVFNILKALGFETAPILYGGSVKPDNAAGLIKQPHVNGFLVGGASLEAKSFSEIASV

SEQ ID NO: 11488 - protein, 478 aa, Candida glabrata CBS 138
MQSMNVQHQVMPGHEQMMPQRDPQNMNMMQNYSPHMGRARMNVQQPNFPMQSMMQDVGNPYLNAQEQDMNKRQMQQNMPMNIQPQLQMQHQNQNFNISTPVNASMPPGLNLYQQQQQQQQQQQQQQQQQQQQQQQQQRQGQGQGQQNQQNQQQQQQQQLGQQQIPQQSQNQGSIGVNPALTNVPKQMGAAANALPGAASALPPMILPPPNHLFVRDVWKGNLYREFASIRRLVQQYNHISISTEFVGTTARPIGNFRSKADYHYQTMRANVDFLNPIQLGLSLSDENGNKPDNGPSTWQFNFEFNPEKEMVSKDSLELLTKSGINFEQHQTMGIDQLEFGQLLMDSGLVLDPEVTWVTYHAAYDLGFLINILMNNSMPNNKDDFEWWVHKYLPNFYDLNLVYKAIQDFKQPNQQQQYTLTSLADDLGIPRFSIFTTTGGQSLLMLLSFCQLAKVSLNKLPNGADLISYRNIIYGIDGE

SEQ ID NO: 11489 - protein, 306 aa, Bacillus halodurans
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIQDM

SEQ ID NO: 11490 - protein, 231 aa, Chlamydomonas reinhardtii
MPLLRRAAQSLLTSWAPVATNCGAMSELVRCMGTERRPGESGAWKQIERQRYASDWENDPTFKRTPKNLAEVLDDSASMLLLTDVWRGMAYTLGAFFDKKVTIMYPFEKGQLSPRFRGEHALRRYPTGEERCIACKLCEAICPAQAITIEAEEREDGSRRTTRYDIDMTKCIYCGFCQEACPVDAIVEGPNFEFSTETREELLYDKQKLLENGDKWETEIATNLRTESLYR

SEQ ID NO: 11491 - protein, 446 aa, Candida glabrata CBS 138
MTKRVLLLGSGFVAQPVIDTLAATEGIEVTVACRTLANAKQLASASGSDAISLDVTDDSALDAALGQHDLVISLIPYTFHPNVVRSAIRLKKDVVTSSYISPALRELEPEINKAGITVMNEIGLDPGIDHLYAVKTIDEVHRAGGKIKSFLSYCGGLPAPEDSDNPLGYKFSWSSRGVLLALRNSAKYWKDGKIETISSEDLMASAKPYFIYPGYAFVCYPNRDSTLFKELYHIPEADTVIRGTLRYQGFPEFVKALVDMGMLKDDENAIFSSAIPWNDALKQYLGAKSTSREDLVASIDSKTNWKSQEDRDRILSGFAWLGLFSDTKITPRGNALDTLCARLEELMQYEDGERDMVALQHKFGIEWADGTTEVRTSTMIDYGKVGGYSSMAATVGYPVAIATKFVLNGTIKGPGLLAPYSPEINDPIMKELKDKYGLYLKEKTIA

SEQ ID NO: 11492 - protein, 272 aa, Oryza sativa
MSTAAAAAAAQSWCFATVTPRSRATVVASLASPSPSSSSSSSNSSNLPAPFRPRLIRNTPVFAAPVAPAAMDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 11493 - protein, 65 aa, Solanum melongena
TAFCGPAGPRGQDSCGRCLRVTNTGTGTQTTVRIVDQCSNGGLDLDVNVFNQLDTNGVGYQQGHL

SEQ ID NO: 11494 - protein, 197 aa, Triticum monococcum
NQRSKSAFVPSVSILNMKKFASCSLRPLYLTRLDDPHTSELKPRRQLLDFRCAASAADDKESKAEVVPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 11495 - protein, 314 aa, Triticum aestivum
MASDGVVALYGNNKAVVEPSAKPAAATFSVKVGLAQMLRGGVIMDVVTAEQARLAEEAGACAVMALERVPADIRAQGGVARMSDPALIRDIKRAVTIPVMAKARIGHFVEAQILEAIGVDYVDESEVLTLADDAHHINKHNFRVPFVCGCRDLGEALRRIREGAAMIHTKGEAGTGNVVEAVRHVRSVMGAVRALRNMDEDEVFSYAKQIAAPYDLVMQTKQLGRLPVVQFAAGGVATPADAALMMQLGCDGVFVGSGIFKSGDPARRARAIVQAVTHYSDPEILANVSAGLGEAMVGINLSDPNVERFAARSQ

SEQ ID NO: 11496 - protein, 164 aa, Oryza sativa (indica cultivar-group)
MEIKMKGIFKGLKIISQIFALQKQQEMEIGCPTDVRHVSHIGVGTSDSCPSWMSEFRGLEELSAGSMGSFAQSRKTSWASQGKGPNVDFDKPPRATLPTEVCTDKSGQEAASCCHDIPRGPKNPRRKKAARASSASSFLSRSRSSSFVTACGDFSELRGGLRVA

SEQ ID NO: 11497 - protein, 343 aa, Thermus thermophilus
MKVAVLPGDGIGPEVTEAALKVLRALDEAEGLGLAYEVFPFGGAAIDAFGEPFPEPTRKGVEEAEAVLLGSVGGPKWGTGSVRPEQGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 11498 - protein, 319 aa, Geobacillus stearothermophilus
MKRIGVLTSGGDSPGMNAAIRSVVRKAIYHGVEVYGVYHGYAGLIAGNIKKLEVGDVGDIIHRGGTILYTARCPEFKTEEGQKKGIEQLKKHGIQGLVVIGGDGSYQGAKKLTEHGFPCVGVPGTIDNDIPGTDFTIGFDTALNTVIDAIDKIRDTATSHERTYVIEVMGRHAGDIALWSGLAGGAETILIPEADYDMNDVIARLKRGHERGKKHSIIIVAEGVGSGVDFGRQIQEATGFETRVTVLGHVQRGGSPTAFDRVLASRLGARAVELLLEGKGGRCVGIQNNQLVDHDIAEALANKHTIDQRMYALSKELSI

SEQ ID NO: 11499 - protein, 416 aa, Saccharomyces cerevisiae
  misc_feature (1)..(1): Xaa can be any naturally occurring amino acid
XSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAVGPEIAKLMEKAKAKGVEVVLPVDFIIADAFSASANTKTVTDKEGIPAGWQGLDNGPESRKLFAATVAKATVILWNGPPGVFEFEKFAAGTKALLDEVVKSSAAGNTVIIGGGDTATVAKKYGVTDKISHVSTGGGASLELLEGKELPGVAFLSEKK

SEQ ID NO: 11500 - protein, 528 aa, Zea mays
MVVLEVSFAAAASSVVRWILMLGGLMAAAALLWQAGRLLRLLWWQPRRLERALRAQGVRGTSYRFPAGDLKEYGRLAKEAWSKPLPLRCHDTAPRVAPFLHRLVLEHGRTSMSWFGPSPKVTIVDPELAKDVLSNKFGHFEKLKVPALSKMLGSGVASHEGEKWVKHRRILNPAFHLEKLKRMLPAFSACCEELVNRWAAESLGSDGSCELDVWPELQNLTGDVISRTAFSSTYREGRRIFQLQAEQRSLVMTNIRKIMMIPGYMYLPTANNRKMRRNNREVESILREIIGKRIQAMERGEGTKDDMLGLLLETNMRDDMGMTIEDVIEECKVFYFAGMETTSVLLTWTMVVLSMHPEWQDRAREEVTALFGRDDKPEYDGLSRLKVVTMVLYEVLRLYPPATSVVRQTYKEMEVGGVTYPAGVILELPVLLIHHDPDIWGGDAREFRPDRFSDGVSRASKDPGAFLPFGWGPRICIGQNFALLEAKMALCMILQRFEFRLAPSYTHAPHTVITLHPMHGAQLKLRAI

SEQ ID NO: 11501 - protein, 453 aa, Bacillus halodurans
MPCMTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRLWVGVCQFRQEWGTDN

SEQ ID NO: 11502 - protein, 467 aa, Chlamydomonas reinhardtii
MRRQAVTCLRGLWRAGSASQEVANQAGASSFALQGLLAQTERGLRTSVDAKDAKIAPLSAMPWSLQAARSATAEALTPAKVNNFTLNFGPQHPAAHGVLRLVLEMQGEIIMRADPHIGLLHRGTEKLLEYKTYLQGLPYFDRLDYVSMMCMEHSYVLAIEQLLNVSVPLRGQYIRVLFSEITRVLNHLLAITCHSMDVGALTPFLWAFEEREKLFEFYERVSGARMHAAYFRVGGVSQDLPIGLLRDVYDWARQFASRLDEMEELLTGNRIWKERTVDVGTITAQMAWDWGCSGPILRASGIDWDLRKTQPYDAYGKMQFNVPIAGHGDCYDRYLVRLQEMRESLRIIYQCLNEMPDGLYKSPDGKVCPPSRSTMKQSMEALIHHFKLYTEGFHVPAGETYRAVEAPKGEFGVYLVSRGGNRPYRCKIRSPGYAHLQMTDVISRGAMLADVVTIIGTLDVVFGEIDR

SEQ ID NO: 11503 - protein, 521 aa, Magnaporthe grisea 70-15
MIPSRGLSRCLPRQRLDVKSLSKSPTSTRQFGTAIRTTNGGSKTLRASQAIGLLGGRRTVGVSAAAAGLMAQNYLRAPPQARSLSLWPWSSGLSGGDKFPETAEAATSSAASSSTPAAAAEAAPIPEAAAASQPTTDLSGAADPASSIDPSGATASVGDVLDGSHYLNLASDHIGYLRELGLNFGWGPSSMAQWGIEHLHVWGSMPWWAAILGYAIVTRLMLLKPSIDAFVQQRKLQALKKDPRGKAAFDKMSQMMSGGSSSTTELLAARADVQRLQRAVGISTWKIALPMIQMPIGIGVFRVTSACADLPVPSFETGGFMWLMDLTSPDPFYILPLASAGMMYVMLQHSMKMSPDASQTAMFKAVQYVLTPISFLVSLKLNAALQLYFIASAGLQAAQTLILSRPAVGKALGVDQLNMPEKVVNTDKIVWEAPREIQTTATVPKPAADELDVNTSNPITNMKNTMSSVRGKLNSFAERGNAKKTVQDAAAYEDRRALEEKERYYARREQAVRRTRERSNR

SEQ ID NO: 11504 - protein, 335 aa, Cytophaga hutchinsonii ATCC 33406
MSKIKVGINGFGRIGRLVFRAAVNNPNIQIVGINDLIDVDYMAYMLKYDSTHGRFSGTVDVTDGKLVVNGNAIRVTAERDPANLKWNEVGAEYVVESTGLFLTMDTADKHIAAGAKRVVLSAPAKDDTPTFVMGVNNKSYTKDMTIVSNASCTTNCLAPVAKVLNDNFGILEGLMTTVHAATATQKTVDGPSAKDWRGGRGAYQNIIPSSTGAAKAVGLVIPQLKGKLTGMSFRVPTPDVSVVDLTCRLEKAASYETIKAAMKAASEGDMKGILGYTEDEVVSTDFLGDARTSIFDAKAGISLNDNFVKVVSWYDNEWGYSNKLVDLIVHMDTVK

SEQ ID NO: 11505 - protein, 431 aa, Bacillus thuringiensis serovar konkukian str. 97-27
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFHFEFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAVLVIILNIFLLYQTFVG

SEQ ID NO: 11506 - protein, 431 aa, Desulfovibrio desulfuricans G20
MSTIVSVWAREILDSRGNPTVEVEVSLESGHSGRAAVPSGASTGSREALELRDGDKGRYLGKGVEKAVDNVMGEIAENIVGMDALRQVAVDNALIDLDGTDNKDRLGANAMLGVSLATARAAANFIGMPLYQYLGGINSKVLPVPMMNIINGGEHAPNNLDIQEFMIMPVGAPTFSEALRMGAEIFHNLKALLAADGHVTSVGDEGGFAPNLKSHDEAFRYIMRAIETAGYIPGSEVALAIDAAASEFYKDGKYHLKGENKVLSSSEMIDWLMDFTQRYPLISIEDGMAEGDWEGWQEMTVKMGDSVQIVGDDVFVTNPDILAQGIDEGVANSILIKLNQIGTLTETLDTVEMAKGAGYTTVISHRSGETEDHFIADLAVALNAGQIKTGSLCRSDRLAKYNQLLRIEEDLDDEGIYFGPYMASHFGLGEE

SEQ ID NO: 11507 - protein, 340 aa, Ascophyllum nodosum
MPINVGINGFGRIGRMVFRACFENPDATVVAINDPFMDPEYMKYLLTHDSVHGRFPASVEVKDGHLVVDGFTVYVFTSKDPAQIPWDSKSADYVCESTGVFTTTEKAKPHIAGGAKKVFISAPPKDDTPMYVMGVNHDKYEKGGADVMSNASCTTNCLAPITKVLNDKFGIVEGLMTTVHAMTINQLAVDGPSKGGKDWRAGRCASANIIPASTGAAKAVGKVIPEVSGKLTGMAFRVPVPDVSVVDLTAKLAKETTYEEICEAMKEASEGCMKGVLGYETEDTVSQDYVHDPRSSIFDSKAGIMLNPTFVKVVSWYDNEWGYSNRMVDLMIHVHKVESS

SEQ ID NO: 11508 - protein, 197 aa, Triticum urartu
NQRSKSAFVPSVSILNMKKFASCSLRPLYLTRLDDPHTSELKPRRQLLDFRCAASAADDKESKAEVVPASSEAAQKLKISIYFATWWALNVIFNIYNKKVLNAFPYPWLTSTLSLVCGSAMMLFSWVTCLVEAPKTDLDFWKALFPVAVAHTIGHVAATVSMSKVAVSFTHIIKSAEPAFSVLVSRFILGESFPMPV

SEQ ID NO: 11509 - protein, 197 aa, Triticum turgidum subsp. dicoccoides
NQRSKSAFVPSVSILNMKKFASCSLRPLYLTWLDDPHTSELKPRRQLLDFRCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 11510 - protein, 576 aa, Allochromatium vinosum
MARIPHPRDESRVSHAPERRHEPLRLLEHITRFRDQTQAYLNGDLSEEAFRPLRLLHGLYRLRETTMLRVAVPQGRLSSEPLRRLARIAREYALGEVHLTTRQTIQFTGPAIGAVPQILAELAEVGLSSFLTSGNGIRGIVVDPLAGLAADELEDPRPWHAILDQWRLTHPLMGQLPRKFKIGIHGARTDRVTLAAQDLGLELVRDARGELGFRVLVGGGLGRGPRLAQELTPFVHWPHLLTWIEAILRVYARDGRQPDPYKSRLKNLVQRLGLVEFRAQVESEWAHLRDGPATLTKAQVERAARPFVEAPTDDTVFAATTVPAPAPNEPPEYLLWRHQNVQPHKRAGHAIVTLSTKRLGTAPGNLSPEQLERIADWAATESRDAVRLTPNQNLVLTQVREDRLFALWEDVRAFGLDGPNRGLLTDLVACPGARECDLAHGDSLGLAAAIQARFADADDVRDIGPLDLRISGCVNACAHHNLAAIGIRGLRKQGESRYQILIGGRSGREARLAEPLGPSFAADEVPEAVAGLIALYRRHRQTGETFDAAVQRLGAEPFRTIVTRAADAAPQETPHD

SEQ ID NO: 11511 - protein, 335 aa, Solibacter usitatus Ellin6076
MAIKVGINGFGRIGRNVVRAGLHNSDVEFVAVNDLTDTATLAHLLKYDSVLGTLPETVTHDATSITVGGKTIKVFATKDPAELDWASVGAQIVIESTGRFTDGKDAAKHMRGTVKKVIISAPAKNEDVTLVLGVNDAAYDAKKHNIISNASCTTNCLAPVVKVLNEKFGVEKGSMTTIHSYTNDQNVLDFPHKDLRRARAAALNMIPTTTGAAKAIGLVLPELKGKLDGYSMRVPTPDVSVVDFVCILKKPSTTEAVNAALKAASEGELKGILGYTEDPVVSTDMLRNPNSSIVDAQLTKVLDGNLLKVVAWYDNEWGYSSRVVDLVGFLAAKGL

SEQ ID NO: 11512 - protein, 525 aa, Legionella pneumophila str. Paris
MNDLKKSPLLILDFGSQYTQLIARRVREMGVYCEIYPYNINHEQFKKLNPCGVILSGGPSTVTHDANPRAPQWLFESDLPLLGICYGMQTMAVQLGGQVHSSTLREFGYAELRLHGHSQLLSNIEDRTAMDGSALLDVWMSHGDKVTELPPGFKVICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTDIKWLAQGTIYPDVIESAATSTNDAAVVIKSHHNVGGLPDTLNLKLLEPIRELFKDEVRHVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 11513 - protein, 143 aa, Oryza sativa
TRATLAAVQPTTAVNGLAGSSIVGTKLHVKSSRLNLKSTKSRAGSVVAKYGDKSVYFDLEDLGNTTGQWDLYGSDAPSPYNPLQSKFFETFAAPFTKRGLLLKFLILGGGSTLAYFSSTASGDILPIKKGPQLPPKLGPRGKI

SEQ ID NO: 11514 - protein, 544 aa, Triticum aestivum
MAHFQGQQHGHPATRVDEYGNPVTAGHGVTGTEGLGHFQGHGQQHGHPTTRLDEYGNPVTAGHGVGLGSTGTGVHGAGHGGYGSTGTGAHDTGGHGRQVGYGATGTGTHDAGGYRGSGIAPRHGATDAGFHDAGGLDTRHAATGTHGTGHTAGLGGTGTGMTGTHGTGHTAGLGGTGTGMTGTHGTGHTGTGMTGTHGTGHTAGLGGTGTGITGTHGAGHTGIGMTGTHGTGHTAGLGGTGTGITGTHGTGHTAGYDATGTGITGTHGTGHTPGYGATGTGITGTHGAAGTHPHGGLPEHKTRGILHRSGSSSSSSSSSEDDGMGGRRKKGMKQKIKEKLPGGNKEQTTATGGYGPGYTGTTGTGGPGYTGTTGTGGTYGTTEGTHEKKGVMEKIKEKLPGGHKDTQPHTTATGGYGHGTTGTGGGYGTGTHPHGGLPEHKTRGILHRSGSSSSSSSSSEDDGMGGRRKKGMKQKIKEKLPGGNKEQTTATGGYGPGYTGTTGTGGPGYTGTTGTGGTYGATEGTHEKKGMMEKIKEKLPGGHH

SEQ ID NO: 11515 - protein, 319 aa, Hyphomonas neptunium ATCC 15444
MSVSPLSCADELDPGVRRFIERTGADYTALSTVAPPTTLARRREIAEQVRQPWSRGGPDMAQTHMVAIGPQGVRARVHIPASGPGTGTLLYLHGGGWTLFSIDTHDRLMREYAERIGCAVVGLDYSLSPEHRFPRALEDVDACIEWLRREGAALGLAVDRLAIGGDSAGGNLSLSAALRLRDRGEPLPAALLLNYAALDTEPRPSYRRYDGDPYMLNVDEMRDFWVNYLGKPSTDDPYARPLLADLTGLPPVHLCIAQCDILADQNTELAARLEAVGNDVSTRIYEGATHSFLEAVSISDCADRAIQDASDWLARHLTP

SEQ ID NO: 11516 - protein, 878 aa, Candida albicans SC5314
MDERFLNPPPTADQDDTNQPLDAIFGDRVRRFQEFLDRIDSNTGIDYRSIIKDMLIKSKFRLSVSIDEIREFDREFWLGLLNQPADYLPACERALRDTVLAIYDPQDPSFPHDSYDPNQQYYLSFKGAFGGHSLTPRSIDSSYLSKMVSIEGIVTRASLVRPKVIRSVHYAEKTGRFYAREYRDQTTSFDAIATPAIYPTEDMEGNKLTTEYGYSTYRDYQKISVQEMPETAPPGQLPRSVDVILDDDLVDLTKPGDRVQIVGVYRALGGAANNSSSFKTVILSNSVYLLHARSTGVASQEKLTDQDIRNINKLAKDRKIFDILSRSLAPSIYGFDYIKKAVLLMMMGGVEKNLDNGTHLRGDINILMVGDPSTAKSQVLRFVLNTASLAIATTGRGSSGVGLTAAVTTDKETGERRLEAGAMVLADRGIVCIDEFDKMSDIDRVAIHEVMEQQTVTIAKAGIHTSLNARCSVIAAANPVFGQYDVHKDPHKNIALPDSLLSRFDLLFVVTDDVNPTRDRVISEHVLRMHRFVPPGLMEGEPIREKSAVTLAVGDDETNEQELLEQPMFEKFNTLLHAGIQNKKSNNILSIPFLKKYVQYAKQRVQPVLTKGASDYIVTTYSSLRNDLIGNNQRNTAPITARTLETLIRLATAHAKVRLSKTVDVKDAKVAEELLRYALFKEVAKKTKKRQKTTSIVDSEEEEEDESDAEMENSDNEIMPRESTRRTRATAQTQPPQQQQASPSLTPEPPLGHRDDGDDDGVGEELEQFHLSSSQQQQQQQYLQPLTERSSSNIVSSTATNAISVERLNIFKRILAQVSRSALFANDQAAANYHDVTRAINEQMEQEDIFSEQELSAGFEVMSSENKFYLESDKIWKI

SEQ ID NO: 11517 - protein, 285 aa, Saccharomyces cerevisiae
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 11518 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 11519 - protein, 144 aa, Triticum aestivum
  misc_feature (95)..(95): Xaa can be any naturally occurring amino acid
MTTPAPNPTIRRLDVASPVPADIDIANAVEPLHIADIAAELGVPPEHYDLYGKYKAKVLLSVLDKLQGQQDGYYVVVGGITPTPLGEGKSTTTVXGLCQALGAFLDKKVVTCVRQPSQGPTFGIKGGAAGGGYSQVIPMDEFNL

SEQ ID NO: 11520 - protein, 667 aa, Arabidopsis thaliana
MAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 11521 - protein, 142 aa, Glycine max
  misc_feature (57)..(57): Xaa can be any naturally occurring amino acid
GKDSRLIQDNRGSSTSGPKDFYEILMNDNRWKGFTQSNARVSTGVCGQFSLFYGSIXGVNEELQEGKLIVQKWRFGSWADGVHSTVRLVFDEPESGVTTIKLKQTDVPEEDRYGNSTVVENTERGWKELIFQRIRAVFGFGV

SEQ ID NO: 11522 - protein, 325 aa, Arabidopsis thaliana
MEEERDHNASESSLPSLSKQLESSTLGGSAVDVPVVDLSVSDEDFLVREVVKASEEWGVFQVVNHGIPTELMRQLQMVGTQFFELPDAEKETVAKEEDFEGYKKNYLGGINNWDEHLFHRLSPPSIINYKYWPKNPPQYREVTEEYTKHMKRLTEKILGWLSEGLGLQRETFTQSIGGDTAEYVLRVNFYPPTQDTELVIGAAAHSDMGAIALLIPNEVPGLQAFKDEQWLDLDYIDSAVVVIIGDQLMRMTNGRLKNVLHRAKSDKDKLRISWPVFVAPRADMSVGPLPEFTGDENPPKFETLIYNDYIDQKIRGWALEDLPVY

SEQ ID NO: 11523 - protein, 390 aa, Clostridium thermocellum ATCC 27405
MPKLSSKIEGFTDSVIRRMTRIANSYGAINLSQGFPDFDPPVELKNALSRVASGSIHQYAVTWGAKNFRESLAKKQSRFMGIPIDPETQIVVTCGSTEAMMAAMMTVCNPGDKVVVFSPFYENYAADAILSGAEPIYVHLRPPGFNFDVDELEEAFKQRPKALILCNPSNPSGKVFTLEELKTIAYFAEKYDTFVITDEVYEHIVYPPHHHIYFASLPGMFERTISCSSLSKTYSITGWRLGYLIAPSYIVDGARKVHDFLTVGAAAPLQEAAVVALNFGDDYYENLKRIYTEKRDFFLDGLDRLGLAYTVPQGAYYVMVDISEFGAKSDLEFCEWMAREVGVAAVPGSSFFRDNVNHLIRFHFAKKKETLAEAVKRLEKLKDKARERWR

SEQ ID NO: 11524 - protein, 586 aa, Bacillus thuringiensis serovar konkukian str. 97-27
MKQSVSAEQIELKSSLPGSKKVYVDGPREGMKVPMREIEQSDTNGVPNPPIRVYDTSGPYTDPAYKVELEKGIPTPRHSWILERGDVEAYEGREVKPEDDGVKVASKHTPVFPQMDRKPLRAKQGANVTQMHYARNGIITSEMEYVAIREGVDPEFVRKEIAEGRAILPANINHPEAEPMIIGRNFHVKVNANIGNSAVSSSIAEEVEKMTWATRWGADTIMDLSTGKNIHTTREWIIRNAPVPVGTVPIYQALEKVNGIAEDLTWEVYRDTLIEQAEQGVDYFTIHAGVLLRYIPITAKRTTGIVSRGGSIMAQWCLFHHKENFLYTHFEEICEIMKQYDVSFSLGDGLRPGSIADANDEAQFSELETLGELTKIAWKHDVQVMIEGPGHVPMHLIKENMEKELDICQGAPFYTLGPLTTDIAPGYDHITSAIGAAMIGWFGTAMLCYVTPKEHLGLPNKDDVREGVITYKIAAHAADLAKGHKTAHQRDDALSKARFEFRWRDQFNLSLDPERAMEYHDETLPAEGAKTAHFCSMCGPKFCSMRISHDIREYAKENDLETTEAIEKGMKEKAKEFKETGSHLYQ

SEQ ID NO: 11525 - protein, 979 aa, Bacillus thuringiensis serovar konkukian str. 97-27
MNNNMVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVSINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQQFIDENVNFFEDFKESLTEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINNAPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQAIANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRVLVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 11526 - protein, 514 aa, Arabidopsis thaliana
MNKGNTLDSIPTDLILEIFSRLSAKSVGRLRCLSKLWRKGEWFFFSSLQPQNLYEKPFLVVAADFHMKFSEDMSHDIYSYASGLIYFPKMLIENEKSGAIRVICNPITGQYAILPKLITLQAARSFLGFDPIDNQFKVLLVNNDIVNNDMDILTLGIGELMSEKLKFIEAKCFFALDDVQLINYKGKLGGISWNNHEVAPVELSMWVLEDVEKQEWSKNVYILPKNVVPNNWLHAAGVTVEGDIVFSEAVVSNPFDVFYFNPEKNTLQHVETHCNHEVFDDENLVNIFVDHVEDLKFDVMKPTYAATSIRPTEQKHKPTSTETSMSRKDHQVRTIDQPQQDRFQIQRSYIFQRRDPHQVKFIYFRKVVPPNVPRTQHLHLGDLPLGQQYVGQPYPFFTSLVQTLLPLIPASFLNPVSSSWMVYWYISSSPPNEAAKNKDINSSLFLGSRGCACSETKNGRNMSIFRGRKQWWISTYNFRSCSDCYRENLKKKQRYIDIVPVSYVLLNQLFVSNS

SEQ ID NO: 11527 - protein, 302 aa, Aspergillus flavus
MSAVKAARYGKDNVRVYKVHKDEKTGVQTVYEMTVCVLLEGEIETSYTKADNSVIVATDSIKNTIYITAKQNPVTPPELFGSILGTHFIEKYNHIHAAHVNIVCHRWTRMDIDGKPHPHSFIRDSEEKRNVQVDVVEGKGIDIKSSLSGLTVLKSTNSQFWGFLRDEYTTLKETWDRILSTDVDATWQWKNFSGLQEVRSHVPKFDATWATAREVTLKTFAEDNSASVQATMYKMAEQILARQQLIETVEYSLPNKHYFEIDLSWHKGLQNTGKNAEVFAPQSDPNGLIKCTVGRSSLKSKL

SEQ ID NO: 11528 - protein, 125 aa, Glycine max
  misc_feature (99)..(99): Xaa can be any naturally occurring amino acid
ASSLISSPAVISVNPAGAGMVAPLTGLKCMAGFPTRKTNNDLPFIATNGGRVECMRVWPPVGKKKFETLSYLPYLDDARLAKEIKFLLRKGWIPCLEFXMEHCFSYREHSQSPGYYDGTYWTMRN

SEQ ID NO: 11529 - protein, 225 aa, Cenarchaeum symbiosum
MTALEDAFRAISADALNMVKDGQVIGLGSGRAAAVLVRELASRARSERMNITGVPTSLQIRLVAEECGISLRDPGDTDKIDIVFDGADQVDRQGNLIKGGGGALLTESILIGMADKVVIIADESKFAEHLDAPVPVEVHPAARRSAAESVMRLGGKPVLRLLDRGFPLFTENRNLVLDCSFGTITDPSTLRDKLTDIPGVAEAGIITRRPDTTYRAKTDGGFDAI

SEQ ID NO: 11530 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKISPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAAAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 11531 - protein, 197 aa, Triticum aestivum
  misc_feature (16)..(16): Xaa can be any naturally occurring amino acid
TRPGQRYLEDVLQPGXNMIAAGYCMFGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPYEIHQRSPIFLGSYDDVEEIKSLYASESSTA

SEQ ID NO: 11532 - protein, 237 aa, Cichorium intybus x Cichorium endivia
GVCYGRVEGLSSQQDVVNLYKNNSITRMRIYQPNQAILQGLKGTNIELVIGIPNDALESLSNQNTANTWVRDNIQNYPDVRFRYVAVGNEVDPDNGNSQYVNFVLPAMQNVQNAINAASLGNQIKVSTATYSGLLGVSYPPGNGAFRDTVREFIEPIVEFLSENNSPMLVNIYPYFASIGNPNSNLPYALFTAPGTILSDNGRRYSNLFDAIIDAHYAAQASLGGENVEIVVSESGC

SEQ ID NO: 11533 - protein, 237 aa, Cichorium intybus x Cichorium endivia
GVCYGRVEGLSSQQDVVNLYKNNSITRMRIYQPNQAILQGLKGTNIELVIGIPNDALESLNSQNTANTWVRDNIQNYPDVRFRYVAVGNEVDPDNGNSQYVNFVLPAMQNVQNAINAASLGNQIEVSTATYSGLLGASYPPSNGAFRDTASEFIEPIVKFLSENNSPMLVNIYPYFASIGNPNSNLPYALFTAPGTILSDNGRRYSNLFDAIIDAHYAAQASLGGENVEIVVSESGC

SEQ ID NO: 11534 - protein, 215 aa, Oryza sativa (japonica cultivar-group)
MEKAACNEHVIGIPVSNRAFGIEEPDFPSEGAAAYHAEAKSSATARTSSRFGRTGDRLAQGIKEHVTLGPKLYETMKGKLTLGARILQAGGVEKVFRRWFAVGKGEKLLRASQCYLSTTAGPIAGMLFISTERIAFRSDRSLALTTPSGDTVRVPYKVAIPLRRVKTAKPSENKHRPEQKYVQVVTDDGFEFWFMGFVSFQVTLKNLELAVAQAQ

SEQ ID NO: 11535 - protein, 126 aa, Clostridium thermocellum ATCC 27405
MYIEVVKTNKAPEAIGPYSQAIVTGSFVYTSGQIPINPQTGEVVDGGIEEQAKQVLENLKNVLEAAGSSLNKVVKTTVFIKDMDSFAKVNEVYAKYFSEPYPARSCVEVSKLPKGVLIEIEAVAIK

SEQ ID NO: 11536 - protein, 321 aa, Vitis vinifera
  misc_feature (26)..(26): Xaa can be any naturally occurring amino acid
  misc_feature (209)..(209): Xaa can be any naturally occurring amino acid
MVVAEVPKLASAAEYFFKMGVEGKRXRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDXLDFTGTSASLGKGSLSDIRHGIITAPILFAIEEFPQLDAVVKRGLDNPADIDLALDYLGRSRGIQRTRELAMKHANLAAEAIDSLPESGDEDVLRSRRALIDLTHRVITRTK

SEQ ID NO: 11537 - protein, 448 aa, Bacteroides thetaiotaomicron VPI-5482
MLKHLINFYKVSSPGPCNGDVMSSSGKRRLKYLQWSTFLSATFGYGMYYVCRLSLNVVKKPIVDEGIFSETELGIIGSVLFFTYAVGKFTNGFLADRSNINRFMTTGLLVTALINLCLGFSHSFILFAVLWGVSGWFQSMGAASCVVGLSRWFTDKERGSYYGFWSASHNIGEALTFIIVASIVSVCGWRYGFFGAGMVGLLGALIVWRFFHDSPESKGFPPVNVPKEKKTMSASETTDFNKAQRQVLTMPAIWILALSSAFMYISRYAVNSWGVFYLEAQKGYSTLDASFIISISSVCGIIGTMFSGVISDKLFGGRRNVPALIFGLTNVLALCLFLLVPGVHFWLDAVAMILFGLGIGVLICFLGGLMAVDIAPRNASGAALGVVGIASYIGAGLQDVMSGVLIEGHKTIRSGVEVYDFTYINWFWIGSAILSVFFALWVWNAKQK

SEQ ID NO: 11538 - protein, 124 aa, Zymomonas mobilis subsp. mobilis ZM4
MQNDQDYGNKLNPAWDEKGLITAVLTDAKTGLLLMVAHMNKESFELSMATKEATFWSRSRKKIWRKGEESGHVMKIQEIRIDCDQDTLWLKVIPMGPACHTGAQSCFYRLVEDGHLVTIPKDKI

SEQ ID NO: 11539 - protein, 369 aa, Magnaporthe grisea 70-15
MGDQQVYPQPPYPLHDSIKDKLDPEYVEFYNKYLLNAPQVHYQPVAASRVGGKIIPVKAPLAAFPSQNPRTDKLSTQNQGGTDPVPVGKTIDKAIPRQETTGPDVRVRAFVPAGQPPSPSGWPVFLWYHGGGWVLGNIDSENSLCSSICARARCVVVTTDYRLAPEHPFPAAVHDAWEAALWVATGAAAPALGEPLDLAKVAVGGSSAGGNLAAVVTQRALRHEAFARAGLFRFQLLVVPVTDNTASVETSTTYAEYEHTAALPVDKMLWYRRHYLPDRADWASVEASPLFADADTFAKLPPALVVVAGLDVLRWEGEEYARKLRDAGVEAEVKVIEGVPHPFIVMDAVLQKGKEGVDFVCERLAAVLA

SEQ ID NO: 11540 - protein, 377 aa, Bacillus thuringiensis serovar konkukian str. 97-27
MKAVTYQGPNKVQVKQVDDAKLEKKDDIIVKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKRGDTVIVLGCGPVGLMTQKFAWMQGAKRVIAVDYLDYRIHYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFKKITNKEFDPKEIITHKIPLEEASYGYQIFNNREDDCIKVILKP

SEQ ID NO: 11541 - protein, 484 aa, Zymomonas mobilis subsp. mobilis ZM4
MTISKLETLPQHDRSIRSSALNPRPILRLQAMRAAEMAAMKCGSSVDDLMEKAGKVAASITRSFAGNMPALILCGPGNNGGDGYVVARYLAEWGIPVSVAAYSEPKTDAAKKARSLFSGKVTSLDEAEAAPLLIDALFGVGMSRSLDNALLSKLTALSKAASLRIAIDVPSGVDTDKGSLLSDIPAFDLTIAIGALKPAHRLEPSATICGRVAVGDIDLTISNPDLIEIPKPRLAAPTPADYKYSRGYVAITAGAMAGASLLSAVAAQRAGAGYVALLGGETISGPMALVHRSWSREALADERINALVIGPGLGRDELGVQRLSMALDTSHPLVLDADALFLLSREGLDCLRNIQQPTIITPHEGEFKRLFEGISGDKLTRVTKAAALSGLVVVLKGADTVIATPDGRAAISQPAVSWLANAGTGDVLSGICGAMLARGMDPFDAACTAVWLHGEAARLAGPGMIADDLIHHLRSAFVEVTVAS

SEQ ID NO: 11542 - protein, 449 aa, Bacillus thuringiensis serovar konkukian str. 97-27
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYTQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVIGTLKTAMERI

SEQ ID NO: 11543 - protein, 298 aa, Arabidopsis thaliana
MIPYATVEEASIALGRNLTRLETLWFDYSATKSDYYLYCHNILFLFLVFSLVPLPLVFVELARSASGLFNRYKIQPKVNYSLSDMFKCYKDVMTMFILVVGPLQLVSYPSIQMIEIRSGLPLPTITEMLSQLVVYFLIEEYTNYWVHRFFHSKWGYDKIHRVHHEYTAPIGYAAPYAHWAEVLLLGIPTFMGPAIAPGHMITFWLWIALRQMEAIETHSGYDFPWSPTKYIPFYGGAEYHDYHHYVGGQSQSNFASVFTYCDYIYGTDKGYRFQKKLLEQIKESSKKSNKHNGGIKSD

SEQ ID NO: 11544 - protein, 298 aa, Arabidopsis thaliana
MAEFMEPNLVSNFDDEKSNSVDTRSIFQMGFPLESEEIVREMIEKERQHSPRDDYLKRLRNGDLDFNVRIQALGWIWKACEELQFGPLCICLAMNYLDRFLSVHDLPSGKAWTVQLLAVACLSLAAKIEETNVPELMQLQVGAPMFVFEAKSVQRMELLVLNVLRWRLRAVTPCSYVRYFLSKINGYDQEPHSRLVTRSLQVIASTTKGIDFLEFRASEIAAAVALSVSGEHFDKFSFSSSFSSLEKERVKKIGEMIERDGSSSSSQTPNNTVLQFKSRRYSHSLSTASVSSSLTSLS

SEQ ID NO: 11545 - protein, 181 aa, Zea mays
MAAAHVDPLVVGRVIGDVVDLFVPTVAVSARFGAKDLTNGCEIKPSVAAAAPAVLIAGRANDLFTLVMTDPDAPSPSEPTMRELLHWLVVNIPGGADASQGGETVVPYVGPRPPVGIHRYVLVVYQQKARVTAPPSLAPATEATRARFSNRAFADRHDLGLPVAAMFFNAQKETASRRRHY

SEQ ID NO: 11546 - protein, 197 aa, Triticum turgidum subsp. dicoccoides
NQRSKSAFVPSVSILNMKIFASCSLRPLYLTWLDDPHTSELKPRRQLLDFRCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 11547 - protein, 315 aa, Oceanospirillum sp. MED92
MNQLEKLKQITTVVADTGDIEAIARFKPVDATTNPSLLLKAAQLPQYAELLTKAKNWADEQGGSQQEVLDNMTDKLAVEIGKEILKIIPGRISTEVDARLSFDTQATLQRARKLIALYEDSNVSRDRILIKIASTWEGIQAARELEQEGINCNLTLLFSFAQAAACADAGVYLISPFVGRILDWFKANEEGDFTGANDPGVQSVSGIYNYYKANDYNTIVMGASFRNISEIQELAGCDRLTIAPALMQELEDSADELPTKLSADSAASDQGRLVLNEAEFRWMMNEDAMATEKLAEGIRNFAADQIKLEKLLSEV

SEQ ID NO: 11548 - protein, 452 aa, Magnaporthe grisea 70-15
MATAQAAYAAEKAVGHQEGGITRQDVSDYTETGDPSRTMKALVWMGKNKVEIADMPRPKIIEPKDVILKVTGSTVCGSDLHLLHGSVIQMNKNDILGHEFCGIVDEVGPEVTKCKPGKRYVASFQIACGECFFCKQKLSSQCERTNDNTIAKAMYGNQTAGMFGYSHFTGGFAGGQAEYVRVPFGDVNLLEIPDDVPDEKALYLSDVLPTSYNAVKDTAVYPGDTVAVFGAGPIGQMAGYWALLEGAEKVIFVDTEPRLSYIQERFNAEQKAKTTCIDYKKLSSGITNKETVVSKLKEMCGGRGPDCAIECAAGEYAKGWAHWLEMTLGAETDTSEILNEMIEGVRNYGRVGVTGVYVGYTNHFNIGSLMQRGVRLIGNGQAPVHKYWEELLARIQSNDFDPLQMLSHRVRLEDLDKVYYKFEKREDSMQKIFVETKFSLPRATGTPELTTY

SEQ ID NO: 11549 - protein, 395 aa, Bdellovibrio bacteriovorus HD100
MKIHKHLVSEIVTALDEIFEQGFYADKVIQRHLKANSRWGSRDRRFFAESVYEIVRWERLLSHLADDNDLWKVWGAYWVRGGNELPDWEELDGLDPKEVIAREKNVSSFAIAQSIPDWMHERGTLELGEEWKDAMRALNKPAEVFLRTNTLKTTPDELIKTLEKDGINATKVSPDLPNALRLVERKNVFITESFKQGLFEVQDAASQMVAPLLGIEPGHRVIDACAGAGGKSLHMASMMKNKGKIISLDIHDWKLKELKVRARRDGVDVIETRLIDSNKVIKRLYDTADRVLLDVPCSGMGVLRRNPDTKWKLSNEEIDRLHGLQYEILSTYCNMTKKGGQMVYATCSLLPSENEKQIEKFMAEHGKDWTLLKQIHVRPDKEGYDGFYAALLKRN

SEQ ID NO: 11550 - protein, 147 aa, Oryza sativa (japonica cultivar-group)
MNHHQQIRSTTAAEQQEASAGGGGGEEYEDLMPVMAGRLGAEGLLSELRAGFRLLADPARGAITAESLRRSAASVLGLGGGGGEMTVEEAAAMVREGDQDGDGALSEAEFCVLMVRLSPGIMGDAEGWLEEAIADELLRSLPPPPPA

SEQ ID NO: 11551 - protein, 406 aa, Arabidopsis thaliana
MMTSCRNIDLGTMMMACGCGRRQFPSLAKTVCKFTSSNRSYGGLVGSCKAVPTKSKEISLLNGIGQSQTVSFDLKQESKQPISLVTLFELVAVDLQTLNDNLLSIVGAENPVLISAAEQIFGAGGKRMRPGLVFLVSHATAELAGLKELTTEHRRLAEIIEMIHTASLIHDDVLDESDMRRGKETVHELFGTRVAVLAGDFMFAQASWYLANLENLEVIKLISQVIKDFASGEIKQASSLFDCDTKLDEYLLKSFYKTASLVAASTKGAAIFSRVEPDVTEQMYEFGKNLGLSFQIVDDILDFTQSTEQLGKPAGSDLAKGNLTAPVIFALEREPRLREIIESEFCEAGSLEEAIEAVTKGGGIKRAQELAREKADDAIKNLQCLPRSGFRSALEDMVLYNLERID

SEQ ID NO: 11552 - protein, 374 aa, Bacteroides thetaiotaomicron VPI-5482
MKKKILFIDRDGTLVIEPPIDYQLDSLEKLEFYPRVFRNLGFIRSKLDFEFVMVTNQDGLGTSSFPEDTFWPAHNLMLKTLAGEGITFDDILIDRSFPEDNAPTRKPRTGMLTKYIDNPEYDLAESFVIGDRPTDVELAKNLGCRAIYLQEATDDLKEKGLEEVCALATTDWDQVAEFLFAGERKAEVRRTTKETDIYVSLNLDGNGGCDISTGLGFFDHMLEQIGKHSGMDLTIRVKGDLEVDEHHTIEDTAIALGECIYQALGSKRGIERYGYALPMDDCLCQVCLDFGGRPWLVWDAEFNREKIGEMPTEMFLHFFKSLSDAAKMNLNIKAEGQNEHHKIEGIFKALARALKMALKRDIYHFELPSSKGVL

SEQ ID NO: 11553 - protein, 641 aa, Bacteroides thetaiotaomicron VPI-5482
MNYGFVKVAAAVPHVKVADCKFNVERIESQIAIAEGKGVQIIVFPEMSITGYTCGDLFGQQILLEEAEMGLMQILNNTRQLDIISIVGMPVVVNSTVINAAVVIQKGKVLGVAAKTYLPNYKEFYEQRWFTSALQLTEDTVRLCGQIVPIGANLLFETSDTTFGIEICEDLWATIPPSSSLALQGAEIIFNMSADNEGIGKHHYLCSLISQQSARCIAGYVFSSCGFGESTTDVVFAGNGLIYENGSLLARSKRFCMEEQLIISEIDVERIRAERRINTTFAASQGNPGDKKAISVATEFVNSKELTLTRDFNSHPFVPQGAELDEHCEEVFSIQIAGLAQRLVHTKAKTAVVGISGGLDSTLALLVCVKTFDKLGLPRKDILGVTMPGFGTTDRTYNNAIDLMKSLGISIREISIQDACIQHFKDIDHDINVHDVTYENSQARERTQILMDIANQTWGMVVGTGDLSELALGWATYNGDHMSMYGVNGSIPKTLVKYLVQWVAENDMDEDAKATLLDIVDTPISPELIPADENGEIKQKTEDLVGPYELHDFFLYYFLRFGFRPSKIYYLANIAFKDVYDKETIKKWLSTFFRRFFNQQFKRSCLPDGPKVGSISISPRGDWRMPSDASSTIWLKEIEDL

SEQ ID NO: 11554 - protein, 479 aa, Campylobacter coli RM2228
MTTYLNYIDGKFIPHNGEFIEVLNPATKEVISRVASASLEDTKRAIEAAKKAQKVWEAKPAIERANHLKEIASLIRKNANFLTEVLMQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSIYDEFVDKFVKAMSKVSVGNTLKGDFDMGPLVNQAGVDNALAMLQRATAKGAIVECGGKITDTSGYYFPASVLTNVKHEDEIMQKEIFAPILPIAKFDTLDEAIDMANDCEYGLTSSIYTQNLDIAMRASREIKFGETYINRENFEAMQGFHAGFRKSGIGGADGKHGLEEYLATHVVYLQYNTNKQ

SEQ ID NO: 11555 - protein, 141 aa, Geobacter metallireducens GS-15
MTQQGAIKTRLILIEDEPGHTRLITKNLMKSADVEILPFDTGRRALEYFEGKTAEDLRQHLVVLDINMPGIDGFEVLKRLKGNEATAAVPVIVFTTTDHPDEIRRCYHEGANLYLVKPMDYTAFQVTIDFLAATLTMMRLP

SEQ ID NO: 11556 - protein, 374 aa, Oryza sativa
  misc_feature (222)..(222): Xaa can be any naturally occurring amino acid
  misc_feature (243)..(243): Xaa can be any naturally occurring amino acid
MAPRPSMAGSEFSYAFAIVADPICTLMREGDSVGTLAAAKERRSQRESRTQLGEAGKASWEKERRRSEQWRQQQQLCPPLPLFPTSPPINPLLPFLRLPYLLAPPPPPPSHWAANGLMEQYEKEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIXDFGLARAFGIPVRTFTHEYFXVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMVQ

SEQ ID NO: 11557 - protein, 512 aa, Zymomonas mobilis subsp. mobilis ZM4
MTLAVVHFWRLFRWSRILSKHGVLKTVEKSTIVPLSLRLIIRLLRIGYRVPNPPDYTGAFVALGPAAIKFGQTLATRPDLIGEETAAQLACLQDSVPPLPFKDIRIVIENALGCPIEKSFRFFNEIPIGSASIAQVYQAETLDGVTVAVKVLRPGIKLAFRKATETYEWAATKIESLNDEFIRLRPKLVVKTFRQWTIRELDLRREAASASELAENMEAVPGFKVPVIDWNRTSQSMMVMQWIDGIKLSDHQKLQEAGYDLKSLATRLVRSFLRQAIADGFFHADLHHGNLFALKDGSLAVVDFGIMGRIDKKARRWLAEILYGLITGNYSRIAEIHFEAGYVPSHHDIAEFTTALRTIGEPIRGLSVRDISISHMLDGLFSITREFEMQTQPHLLLLQKTMVVVEGVATSLYPDINLWDTAEPFVREWLRSELGPEAKIAEEFYKTLQSIKRLPELIDRIDQYYPPLTIEEQLYPVANKNSIKSAATKHYLPVFILSAFIIGIVLGHYHFF

SEQ ID NO: 11558 - protein, 215 aa, Glycine max
  misc_feature (155)..(155): Xaa can be any naturally occurring amino acid
FTPIYIKYNIHRSRCLNTKDSVLCLCKSNQSESQAPQPGDIRKQELLAQIAMLQTQKVRLMDYFDERSEYLTQFGEEAKAEFDKIGEDALQGLDEASARITANIESQMVEFEESAELNRQEIQEREKELDKFEVQMEDGRNEGLFFKNLRKKAPXFIGLLTFAIVDSVASSSTDWRKIAVLGAILVALVSQFIYEQTMSIETGKIRKIDTEEENN

SEQ ID NO: 11559 - protein, 1087 aa, Desulfovibrio desulfuricans G20
MPKRTDLKRIMVIGSGPIVIGQACEFDYSGTQAVKALKEEGYEVVLVNSNPATIMTDPGLADRTYIEPIEPETVAAIIRKERPCALLPTLGGQTGLNTALAVAETGVLEECGVELIGATRDVINKAESRDLFRQAMANIGLKVPASGIARTMDDVRRLGAEMPFPLIVRPAFTLGGSGGGIAYNMEDLEEIASQGLAASMQSEILVEQSVLGWKEYEMEVMRDRNDNCVIVCSIENIDPMGVHTGDSITVAPAQTLTDVEYQMMRDASIAIMREIGVETGGSNVQFGINPENGDMVVIEMNPRVSRSSALASKATGFPIAKIAAKLAVGYTLDEIPNDITRETMASFEPSIDYCVIKLPRFTFEKFPGSRDELNTAMKSVGEAMAIGRTFKEALQKGLRSLEVGAAGFGGNYREELPAREDIMPRLRTPNSRRIFWLRLAMLAGFTLEELYEITAIDPWFLRQFKDVLDMEAALKGFALANSMVAENPDLVSLMKRAKEYGFSDRQLAEMWKLPESAVRDLRKSMGIRPTYYLVDTCAAEFEAYTPYYYSTYETGRELVAEDRKKVIIFGGGPNRIGQGIEFDYCCCHASFALRDMNVQSIMVNSNPETVSTDYDTSDRLYFEPLTFEDVMNIVEAEKPDGVIVQFGGQTPLNLAVPLMRAGVPILGTHPDSIDRAEDRERFQALIQKLDLLQPANDTVMSLEEALKASETIGYPVVVRPSYVLGGRAMEVVYDAEQLRTYFANSVGKAPEHPILIDKFLENATEVDVDALSDGCDTYVAGIMEHIEEAGIHSGDSACVIPPHTLPADIVEEIRRQTVALATELKVVGLMNIQFAIKDGRVFILEVNPRASRTAPFVSKATGVPLPRLATQVMMGTPLRELDPWSMRRRGYFSVKESVFPFKRFPGVDILLGPEMRSTGEVMGMGRTFEEAFMKGQIAGGQKLPQEGKVFISVNDKDKPYVVEVARVFAGLGFEVLATKGTCKLLEENNVSCTPVYKVYEGRPNIVDFIKNGEVSLVVNTASGKRTVQDSKDIRQATLLYGVPYSTTVSGAHAIARAIAEQRRCGLTVKSLQEYYAGSTEAPVCGEK

SEQ ID NO: 11560 - protein, 1588 aa, Saccharomyces cerevisiae
MVQLAKVPILGNDIIHVGYNIHDHLVETIIKHCPSSTYVICNDTNLSKVPYYQQLVLEFKASLPEGSRLLTYVVKPGETSKSRETKAQLEDYLLVEGCTRDTVMVAIGGGVIGDMIGFVASTFMRGVRVVQVPTSLLAMVDSSIGGKTAIDTPLGKNFIGAFWQPKFVLVDIKWLETLAKREFINGMAEVIKTACIWNADEFTRLESNASLFLNVVNGAKNVKVTNQLTNEIDEISNTDIEAMLDHTYKLVLESIKVKAEVVSSDERESSLRNLLNFGHSIGHAYEAILTPQALHGECVSIGMVKEAELSRYFGILSPTQVARLSKILVAYGLPVSPDEKWFKELTLHKKTPLDILLKKMSIDKKNEGSKKKVVILESIGKCYGDSAQFVSDEDLRFILTDETLVYPFKDIPADQQKVVIPPGSKSISNRALILAALGEGQCKIKNLLHSDDTKHMLTAVHELKGATISWEDNGETVVVEGHGGSTLSACADPLYLGNAGTASRFLTSLAALVNSTSSQKYIVLTGNARMQQRPIAPLVDSLRANGTKIEYLNNEGSLPIKVYTDSVFKGGRIELAATVSSQYVSSILMCAPYAEEPVTLALVGGKPISKLYVDMTIKMMEKFGINVETSTTEPYTYYIPKGHYINPSEYVIESDASSATYPLAFAAMTGTTVTVPNIGFESLQGDARFARDVLKPMGCKITQTATSTTVSGPPVGTLKPLKHVDMEPMTDAFLTACVVAAISHDSDPNSANTTTIEGIANQRVKECNRILAMATELAKFGVKTTELPDGIQVHGLNSIKDLKVPSDSSGPVGVCTYDDHRVAMSFSLLAGMVNSQNERDEVANPVRILERHCTGKTWPGWWDVLHSELGAKLDGAEPLECTSKKNSKKSVVIIGMRAAGKTTISKWCASALGYKLVDLDELFEQQHNNQSVKQFVVENGWEKFREEETRIFKEVIQNYGDDGYVFSTGGGIVESAESRKALKDFASSGGYVLHLHRDIEETIVFLQSDPSRPAYVEEIREVWNRREGWYKECSNFSFFAPHCSAEAEFQALRRSFSKYIATITGVREIEIPSGRSAFVCLTFDDLTEQTENLTPICYGCEAVEVRVDHLANYSADFVSKQLSILRKATDSIPIIFTVRTMKQGGNFPDEEFKTLRELYDIALKNGVEFLDLELTLPTDIQYEVINKRGNTKIIGSHHDFQGLYSWDDAEWENRFNQALTLDVDVVKFVGTAVNFEDNLRLEHFRDTHKNKPLIAVNMTSKGSISRVLNNVLTPVTSDLLPNSAAPGQLTVAQINKMYTSMGGIEPKELFVVGKPIGHSRSPILHNTGYEILGLPHKFDKFETESAQLVKEKLLDGNKNFGGAAVTIPLKLDIMQYMDELTDAAKVIGAVNTVIPLGNKKFKGDNTDWLGIRNALINNGVPEYVGHTAGLVIGAGGTSRAALYALHSLGCKKIFIINRTTSKLKPLIESLPSEFNIIGIESTKSIEEIKEHVGVAVSCVPADKPLDDELLSKLERFLVKGAHAAFVPTLLEAAYKPSVTPVMTISQDKYQWHVVPGSQMLVHQGVAQFEKWTGFKGPFKAIFDAVTKE

SEQ ID NO: 11561 - protein, 334 aa, Desulfovibrio desulfuricans G20
MTQDAQCTRRTDWIPLAREVLDIEIEGIAAMRDRLNGGFVDALTLMARCTGRVVITGLGKSGLVGRKLAATLSSTGTPAFFLHPVEGAHGDMGMLRSDDVIIAISNSGETDELNAILPALRSLGASLIAMTGGLESTLAKSADVVLDTGVRREACPLNLAPTASTTAVLAMGDALAVCLIHWKSFTENDFLRFHPGGSLGHRLSMRVESLMHTENLPVVRETVRTGEALRVLDEGRLGTVLVTDGQGRLSGILTDGDVRRMVCREAGVETASPVANVMVRSPLTARKEFSVAQLIDMMEERAITVLPITGDDGLLLGVVHLHDLLGKGGVKFSR

SEQ ID NO: 11562 - protein, 450 aa, Oryza sativa
MAAPPPSSPSPPPAAAAAATQQTQPHPQTPFYELVKGNSGIEKVLLRGTRGFSAEVSDPFSPANPNPTLASVPLSLLPFVVYLYGAQVTSWKNDHAEELLFVSSKAIFKPPKAIRGGIPICFPQFGTHGNLEQHGFARNRLWTIDDNPPPLPVNPAIKSFVDLILRPSDEDLKIWPHSFEFRLRVALGPNGDLSLTSRIRNTNTDGRSFSYTFAYHTYFSVSDISEVRVEGLETMDYLDNLKGKERFTEQGDAIVFESEIDKVYLAAPSKIAIIDHEKKRTFVLTKEGLPDAVVWNPWDKKAKAMQDFGDGEYKHMLCVEPAAVEKPITLKPGEEWKGRLALSAVPSSYCSGQLDPLKEIFAMLHKGRPGRPEAAAAPVEELAKSLQGVEVFDLRGKAVPVVDLWKDMNFLSCFGRLIVYETIDAGCLQLRSAAANGCEEEKNEQGVGIS

SEQ ID NO: 11563 - protein, 72 aa, Glycine max
CDNEPAPWTSDEIGDRPRPLPKIDELKGAVDITERKGDPSWDFDEKGSWLWKKPPPESKKSVDIPFCRLLQP

SEQ ID NO: 11564 - protein, 175 aa, Solanum tuberosum
MADVEYRCFVGGLAWATTDQTLSDAFSQYAEVVESKIINDRETGRSRGFGFVTFKDEQAMRDAIEGMNRQDLDGRNITVNEAQSRGGVEAGGGRGGGGYGGGRREGGGGGYGGYGGGRREGGGGGGYSGGGGGYGGGRREGGYGGGGGGYGGGDRYSDRSSRGGGGGSSDGNWRN

SEQ ID NO: 11565 - protein, 510 aa, Arabidopsis thaliana
MWKQILSKLPNKKSSKHEHRGREHGGHSSSSSHTSGASTSKSTDNGAAKSHAKNASPAGKSAASDSGFKDGNLKSSGNNNNNNNNGVFTPYEALPSFKDVPNTEKQNLFIKKLNLCRVVFDFTDPTKNIKEKDIKRQTLLELVDYVNSPNGKFSEVGIQEVVRMVSANIFRTLNPQPRENKVIDALDLEEEEPSMDLAWPHLQLVYELFLRFVASPETDTKLAKRYIDQSFVLRLLDLFDSEDPRERDCLKTILHRIYGKFMVHRPFIRKSINNIFYRFVFETEKHNGIAEFLEILGSIINGFALPLKDEHKVFLVRVLIPLHKPKCLQMYHQQLSYCITQFVEKDCKLADTVIRGLLKYWPVTNSSKEVMFLNELEEVLEATQPPEFQRCMVPLFRQIARCLNSLHFQVAERALFLWNNNHIENLIMQNRKVILPIIFPALERNAQKHWNQAVHSLTLNVRKIFHDLDPELFKECLAKFKEDESKAAETEAKREATWKRLEELGVRKAS

SEQ ID NO: 11566 - protein, 180 aa, Shewanella oneidensis MR-1
MKILRIIQGVGTQLRSLSMVFSHAWHPRETLNYPEEAVYAAPRYRGRIVLTRDPDGDERCVACNLCAVACPVGCISLQKSERDDGRWYPEFFRINFSRCIFCGLCEEACPTTAIQLTPDFEMGEYRRQDLVYEKEDLLISGPGKYPDYNFYRMSGMAIDGKPKGDAENEAKPIDVKSLLP

SEQ ID NO: 11567 - protein, 137 aa, Medicago truncatula
MADIFAWLFSFFTLIALIVIIIYQLMCLADLEFDYINPYDSASRINKMVLPEYITVAALCGFYLVTGHWVMALLCAPYLYYNYRLYSQGKHLVDVTEIFNMLAREKKQRLIKLFYLIFILFLSLFWLIYTSLDDPYD

SEQ ID NO: 11568 - protein, 601 aa, Shewanella oneidensis MR-1
MKLTRDFPHNDTMAQWQPSDHKDAKVVGELFAHFGAEHFTVQTTRTGVPVVWLPRELLQDVVGFLRKLPAPFVMLYDLSATDERLRSHRDGLPQSDFTVFYHLISIDRNADVMLKVALAESDLHLPTITNHFPNANWYEREVWDLMGITFDGHPHLTRIMMPKSWQGHPLRKDYPARATEFDPFMLDAAKQDMEQENLLFKPEEWGLARGNENEDYMFLNLGPNHPSAHGAFRLVLQLDGEEVRNCVPDIGYHHRGAEKMGERQSWHSYIPYTDRVEYLGGVMNNLPYVLAVEKLAGIKVPQRVDMIRVMMAELFRIQSHLLFLGTYIQDVGAMTPVFFTFTDRQHIYTIIEAITGARMHPAWFRIGGVAHDLPKGWQRLVQDNLLSWLPKRLMDYEKAAMRNSILRGRTIGVAAYTTEQALAWGTTGAGLRATGLNFDVRKWRPYSGYEQFDFEVPVGSNGDAYDRATVRIEEIRQSMRIIEQCMNNMPEGPFKADHPLTTPPPKERTLQHIETLINHFLQVSWGPVMPAAESFQMIEATKGINSYYLTSDGSTMSYRTRIRTPSFAHLQQIPSVIKGSMVSDLIVYLGSIDFVMSDVDR

SEQ ID NO: 11569 - protein, 222 aa, Streptococcus thermophilus CNRZ1066
MQPLFGPLLAPSLAYASQNGYGKLSWFPAAAGFLLGGVALRLIDAVVPHLHLENDISKAEGIQPRKKKLSKTALLFLAITIHNFPEGLAVGVTFGTLAGGNMALAGLMGAIGLAIGIGLQNVPEGAALSIPIRADAKSRIKAFYVGSMSAIVEPIGAIMGAALVMWMMAIIPYALAFAAGAMIFVVTEELIPESQANGNTDMATLGLMVGFVVMMVMDVALG

SEQ ID NO: 11570 - protein, 162 aa, Brassica napus
  misc_feature (25)..(25): Xaa can be any naturally occurring amino acid
KSKDGMKIRGDVHICLMGDPGVAKXSQLLKHIINVAPRGVYTTGKGSSGVGLTAAVMRDQVTNEMVLEGGALVLADMGICAIDEFDKMDESDRTAIHEVMEQQTVSIAKAGITTSLNARTAVLAAANPAWGRYDLRRTPAENINLPPALLSRFDLLWLILDR

SEQ ID NO: 11571 - protein, 350 aa, Bacillus thuringiensis serovar konkukian str. 97-27
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 11572 - protein, 427 aa, Arabidopsis thaliana
MNPSPITIDLILEILSRLPAKSVRRFHCVSKRWASIFGSPYFKELFLTRSSTKPRLLFAIAEKGNKEKDCVWRFFSSPQLENPYEKSSSTLVATAEFHVRFSPDNLLICHYYDLKYFSIGYAFGLIYIYGNRGRARPLICNPTTGRYAILPNRYTYRKAFSFFGFDPIDKQYKALSMVYPSGPGHSRVITFGAGDLKWRRIKCSLRHDIKSEGVCINGVLYYLGDTSDWSRVNGNHVTSGYMIVCFDVRSEKFTFIDVKRFCRLINYKGKLAVIYWEDDVDIQELYYKKGIDVEEYVENNVNADATNELCVWILADVEKQEWSKHAYTWTDEKFFRRLVSIAGVTASGEIVFSMRKCNPKQPFYVFYFNPERNSLQRVEIQGFGEAVTKSCDVCTFVNHVEDLNVYDLKQLKSVHPPLVEPEYYDSD

SEQ ID NO: 11573 - protein, 534 aa, Gibberella zeae PH-1
MGILTLIEDRPTPPSVYNWRVYVLAIVASCGSNMIGYTSAFIGTTITLDSFRKEFGIDQKSAEERNLISENIVSLFIAGAFFGALLTYLLSHWIGRKWCLSIASATFTLGAGLQCGANSSTGLGILYAGRVLSGLGTGIASNIIPIYLSELAPPAIRGRLVGLYELGWQIGGLVGFWINYGVEKHMPESHQQWIVPFAVQIIPSGLLFLGTLWLRESPRWLFLKDRRTQAMKNLCWIRQLTPTDIYITEEVAAIDHAHEVQKHTVGLGLWKPFQALAQRPNMMYRLFLGCMLFFWQNGSGINAINYYSPTVFSSIGVQRDTVNVMTGVFGVVKAVMTFVWLLFLVDQLGRRKLLLIGGITGSICMWVLGAYIYIVDPTKNPQDHLTGSGIAAIVFFYLWTAVYTPTWNGTPWVINSEFFDPSFRSLAQACTTASNWLFNFLVSRFTEQMFAAMGYGVYMFFATLSFFAFIFAFFLIPETSGIPLEQVHRLFKIKPIWKAEGILKEQLKQEEQQFRHDVKADVSQTENLEDSDKV

SEQ ID NO: 11574 - protein, 329 aa, Bacteroides fragilis NCTC 9343
MDKIIGLGNALVDVLATLKDDTLLDEMGLPKGSMQLIDDAKLQQINERFSRMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 11575 - protein, 297 aa, Prosthecochloris aestuarii DSM 271
MSNTSISGSAVALVTPFRQDTSIDTDALRRLVQFHLASGTDILIPCGTTGESPTLCQEEQAAIIRIVKEEAGNHILVAAGAGTNDTRKAVELALNARKAGAEAILSVAPYYNKPSQEGFYQHYRHIAEALDIPVIIYNVPGRTGSNIAAETILRLASDFQNIAAVKEASDNIGQIMELLADRPDHFSVLTGEDTLILPFMAMGGDGVISVAANQVPAEIKQLITLVQEGNLPEARRLNNRLRKLFRLNFIESNPVPVKYALSLMGMIEEVYRLPLLAMEEKHKKILKQELETLGLIS

SEQ ID NO: 11576 - protein, 391 aa, Marinobacter sp. ELB17
MTELSNARITDYYTESTFNRIRQFAEGKQTPFVVIDTATIDSHYNELVEGFPYAQVYYAVKANPAPQVLTLLRDKGANFDIASVYELEQVMALGVTAERISFGNTIKKAKDVRTFYEKGVRMFATDSEADLRNIAEVAPGSKIYVRILTEGTLTADWPLSRKFGCQQDMAMDLLILARDLGLVPYGVSFHVGSQQREIGAWDAALGTVKVIFERLKEEDGIELKMINMGGGFPANYITRANEVKVYAEEIGRFLREDFGDELPEIIIEPGRSLISNAGVLVSEVVLISRKSSTALHRWVYTDVGKFSGLIETLDEAIKFPIWTEKDGEGEDCVIAGPTCDSADIMYEDHKYPLPLSLAIGDRMYWFSTGAYTTTYSAVGFNGFPPLKDYYI

SEQ ID NO: 11577 - protein, 197 aa, Triticum turgidum subsp. dicoccoides
NQRSKSAFVPSVSILNMKKFASCSLRPLYLTWLDDPHTSELKPRRQLLDFWCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 11578 - protein, 322 aa, Cenarchaeum symbiosum
MIPLAGEIQTARGIKGGMVGAGSSVRGSSTVKRGLAHMLKGGVVMDVTTVRQAQIAEEAGAVSVMVLDKLPSDVRKAGGVARTASMEIVREIMDAVTIPVMAKCRIGHTYEAKVLQELNVDMIDESEVLTPADESQHIWKWDFTTPFVNGARSLGEALRRIEEGAAMIRTKGEPGTGNVTEAVIHIKKVRDEIREIKSLYDADDRQGLVQAAREFRASYKLVEDTARLGDLPVVNFAAGGISTPADAAYLMSLGCSGVFVGSGVFKADDASERARAIVLATAHWEDPAKVAEAQSMIDERQSMLGLGPDKMELRMQERGGSA

SEQ ID NO: 11579 - protein, 303 aa, Medicago truncatula
MIPYQSLHDAEISLGRNLTFAETLWFNYSATKSDYFLFCHNILFLFLIFSLVPLPLVFLEIKRLYPFDEYKIQPKVRLSLHEMLNCYKDVLKMFFLVVGPLQLISYPSIKMIGIRTGLPLPSGFEILSQLLVYFLVEDYTNYWIHRFLHNKWGYEKIHRVHHEYQAPIGFAAPYAHWAEILILGIPSFLGPAMVPGHMITFWLWIALRQVEAIDTHSGYDFPWNPTKYIPFYGGAEHHDYHHYVGGQSQSNFASVFTYCDYIYGTDKGFRYQKKILQKLKEDSTNGAAQNGRSYSEQENYKSE

SEQ ID NO: 11580 - protein, 666 aa, Xylella fastidiosa 9a5c
MTKPTRRQLANAIRFLAADAVQAAHSGHPGMPMGMADIAEVLWNDFLRHNPNNPNWFNRDRFVLSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQGFDNYARQYPKEAAELTRRSHAELPTDFLSQLDAYIAKVHAAGPSIASRKASQMAIEAFAPFLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRKNGPSCLVFSRQNLPHQPRHDAQLEQIARGGYILVDAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKAL

SEQ ID NO: 11581 - protein, 420 aa, Sulfolobus solfataricus P2
MMEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKLEDHDLRTAAMALAVDRVVRAMKARGIL

SEQ ID NO: 11582 - protein, 132 aa, Brassica napus
  misc_feature (52)..(52): Xaa can be any naturally occurring amino acid
DEEEEEVSPCLNEGKRMRLGEENDAPKADEGKRVEKEEGLKRKNERGWTDEXELALEGAYLTVKPSPSFWKKVSKMVPGKSAQECFDRVNADLITPRQTQPRSRAKKSNLSPIPQFSLSASKLLKPILPTKS

SEQ ID NO: 11583 - protein, 275 aa, Brassica napus
MGVICQEIKLLLKLKKKKKKKKKYPGKPLANVAFKTYGYISMSQALYFVGDFKLGHYMKIPPRSMFLVQLVATMVSSTVCFGTTWWLLSSIENICNKDKLPVSSPWTCPGDEVFYNASIIWGIIGPGRMFTSKGVYPGMNWFFLIGLLAPVPVWFFARKFPEKKWIKKIHIPLIFSATTAMPVAKAVHYWSWGFVGVVFNYYIFRRYKAWWARHNYILSAALDAGTAIMGVLIYFALQNNNIYFPDWWGSENTDHCPLAQCPTEKGIVIKGCPVF

SEQ ID NO: 11584 - protein, 355 aa, Bdellovibrio bacteriovorus HD100
MTTITKNLTNTPKALPPSDQLGFGQHFSDHMFVAKYTEGKGWSEASVVPYGPLSLDPGASVFHYGQALFEGMKAFRKESGEVVFFRPEFNYHRLAEGAARLCLEAPPMDLFMEGLHQVVAADERWIPKGPNTSLYIRPTLIGSEPFLGVRPSRETLFFILLSPVGSYYSEGTKPIKIWTEEKYLRAAPGGLGAVKAGANYASSLKAALEAKKKGYAQVLWLDVEHQGIEEVGTMNVFFVFDNEIVTPALNGSILSGGTRDAILQLLRSKNLPVVERRITITEVVDRLAKGELKEAFGTGTAAVISPVGVLHYQGKDWTINNNENGPLSTQLYNEITAIQRGAQADTLNWLVPLKK

SEQ ID NO: 11585 - protein, 213 aa, Glycine max
  misc_feature (167)..(167): Xaa can be any naturally occurring amino acid
MGREKETTKVAYAVEQLVAFNRYNPDILPDLENYVNDQVSSQTYSLDANLCLLRLYQFEPEKMSSQIVARILVKALMAMPAPDFSLCLFLIPERVTGRFRQFWDEAAKSRHIVEAVPGFEQAIQGYAIHVLSLTYQRIPRTVLAEAINIEGLSLDKFLENQVANNGXWLLEKSQGRAQLIVLPRNEFNDPALKKNAADSVPLEHITRIFPILS

SEQ ID NO: 11586 - protein, 432 aa, Bacillus licheniformis ATCC 14580
MQHTQSEKLHEEALQHIVGGVNSPSRSYKAVGGGSPVAMERGSGAYFWDVDGNKYIDYLAAYGPIITGHAHPHITKAIQTAAENGVLYGTPTKHEVTFAKMLKEAIPALDKVRFVNSGTEAVMTTIRVARAYTGRTKIIKFAGCYHGHSDLVLVAAGSGPSTLGTPDSAGVPKSIANEVITVPFNDIDSYKEALDKWGNDIAAVLVEPIVGNFGIVEPKSGFLEQVNELTHNAGALVIYDEVITAFRFMYGGAQDLLGVKPDLTALGKIIGGGLPIGAYGGRKEIMEQVAPLGPAYQAGTMAGNPASILSGIACLEVLKEKGTYEKLDRLGAMLEEGILAHAETHGIDITVNRLKGALTVYFTNEKVENYEQAENTDGDMFAAFFKLMLERGINLAPSKYEAWFITTAHTEEDIKDTLKAVDDSFKQLKQRM

SEQ ID NO: 11587 - protein, 265 aa, Saccharomyces cerevisiae
MDYKEEQKQELEVLESIYPDELRIINDEYPKIKFEVAIKLELDTGDSTSVLTKEHTIIAEFKLPENYPDEPCLISLEAQEVALNDNEEDNEEDEDEVEYDDHGNKVLKKFENLPDLISFKGYLPELTVQLESQIETDMLLGMQMCFALISSIKERCEQWYSEQLNKLEKQYELEAQEREKKEQAKFHGTKVTRESYLEWRSKFRQELKLDERDQVRRMKAHHGKLTGKQMFEQGVVGTGDEYMEEDDASVDDVAKGLAKTEIANQ

SEQ ID NO: 11588 - protein, 162 aa, Saccharomyces cerevisiae
MSQVYFDVEADGQPIGRVVFKLYNDIVPKTAENFRALCTGEKGFGYAGSPFHRVIPDFMLQGGDFTAGNGTGGKSIYGGKFPDENFKKHHDRPGLLSMANAGPNTNGSQFFITTVPCPWLDGKHVVFGEVVDGYDIVKKVESLGSPSGATKARIVVAKSGEL

SEQ ID NO: 11589 - protein, 401 aa, Prosthecochloris aestuarii DSM 271
MKKIGILTSGGDCGGLNAVIKGAAFMALSKGIEMYIIPNGYAGLYNLIDNEKLVLLDQARLDQFSGNFAGSEAGHSRVKIKAISNPEKYNRIKEGMKKFELDGLVVSGGDDSGSVMVDLNSNGIHCIHAPKTMDLDLQTYSVGGDSTINRIAQFVQDLKTTGRTHNRILVTEVFGRYAGHTAFRSGIAAEADCILIPEIPVDWDVVYEHIVGRFTRRIRQSDVSAGTYTIVVAEGMKNADGTDIIDESAGVDAFGHQKLAGAGKYVCQEMKKRLKADPDMPIFMKETGMFVEGIYEIPEIREIHPGHLVRSGNTSAYDVNFGYEAGAAAVILLSEGKSGVTISKVKGRKIEYIESTKAIEQRFVDLDQVALYESIGVCFGRHVAAYEPILREVDGVYDRIY

SEQ ID NO: 11590 - protein, 795 aa, Escherichia coli
MKFSELWLREWVNPAIDSDALANQITMAGLEVDGVEPVAGSFHGVVVGEVVECAQHPNADKLRVTKVNVGGDRLLDIVCGAPNCRQGLRVAVTTIGAVLPGDFKIKAAKLRGEPSEGMLCSFSELGISDDHSGIIELPADVRIGTDIREYLKLDDNTIEISVTPNRADCLGIIGVARDVAVLNQLAAGNPEIVPVGATIDDTLPITVEAPEACPRYLGRVVKGINVKAPTPLWMKEKLRRCGIRSIDAVVDVTNYVLLELGQPMHAFDKDRIEGGIVVRMAKEGETLVLLDGTEAKLNADTLVIADHNKALAMGGIFGGEHSGVNDETQNVLLECAFFSPLSITGRARRHGLHTDASHRYERGVDPALQHKAMERATRLLIDICGGEAGPVIDITNEATLPKRATITLRRSKLDRLIGHHIADEQVTDILRRLGCEVTEGKDEWQAVAPSWRFDMEIEEDLVEEVARVYGYNNIPDEPVQRSLIMGTHREADLSLKRVKTLLNDKGYQEVITYSFVDPKVQQMIHPGVEALLLPSPISVEMSAMRLSLWTGLLATVVYNQNRQQNRVRIFESGLRFVPDTQAPLGIRQDLMLAGVICGNRYEEHWNLAKETVDFYDLKGDLESVLDLTGKLNEVEFRAEANPALHPGQSAAIYLKGERIGFVGVVHPELERKLDLNGRTLVFELEWNKLADRVVPQAGEISRFPANRRDIAVVVAENVPAADILSECKKVGVNQVVGVNLFDVYRGKGVAEGYKSLAISLILQDTSRTLEEEEIAATVAKCVEALKERFQASLRD

SEQ ID NO: 11591 - protein, 350 aa, Nocardia farcinica IFM 10152
MKALTYAGPQAISCTEVDDPALPGPDGAIVRVTAAGICGSDLHIYGGHGFTPGTGYGVGHEAVGQVVELGPQAHGLSVGDRVLVPASAGCDRCGNCRAGVVAACARQPLPVDACYGLGGALAGAQAQLLAVPHAGGNLVRLPDAIGDEAAVVLTDNAPTAWYGARRARIAPGDTVVVIGLGPVGLMAVQAAFVMGAARVLGVDLVADRRARAAALGAEPVEDDDPKQAVREMLGGGGADVAVEAVGADATIALATAVVGHRGRVAVVGVSQNRAFPFHLPLAQVKELEFHIGLCSVQYELPALLSLTAAGRLRPEVVVSHRLPMSAGARAYRMFADRADDVCKVVLDPWR

SEQ ID NO: 11592 - protein, 594 aa, Zea mays
MPTVSVGRDRLLAAIGRTYTQEEFEALCFEFGIELDDVTTEKAIIRKEKHLEDDSEVDEDDEVIYKIEVAANRYDLLCFEGLARALRVFTGTEASPVFQVSSIPRGSMLQMHVKPETSKIRPYIVCAVLRGVTFDEARYNSFIDLQDKLHQNICRKRTLVAIGTHDLDTLQGPFSYEALPPNEINFVPLKQEKSFRADKLMEFYKSDMKLKKFLHIIENSPVYPVIYDSNRTVLSLPPIINGAHSAITLATRNVFIECTATDLTKANIVLNTMVTMFSEYCETKFEVEPVEVIHHDGRKTVYPDLSCYKMDVLLSDILGPIGISQDEKQVVCLLNKMQLQAESHSLKGEARISVSVPPTRSDILHARDLSEDVAIAYGFNNVPKSKPKCMTIGGRQPLNRFSDKIRAEVARAGYMEVLTFILSSHEENFDMLNRTDDKSKAVIIANPRTSEFEVVRTSLMSCLLKTLKHNIDHPRPIKIFEVGDVVMLDSSRDVGASNNRRLAALYCNRVSGFEEIMGLVDSIVKVVRAPHVNFGENYYVPTDEPEFFPKRQCKIVTSDGKQVGYLGIVHAEVLRKFGIPDPCTFVEMDLEALL

SEQ ID NO: 11593 - protein, 426 aa, Lactobacillus plantarum
MTKKAAFHNDEVVLDIHDRPKLGSWLGLSVQHLFSMFGSTVLVPILVGLNPGIALFSSGVGTLMYILITRGKIPAYMGSSFSFIVVMQSLMKTAGYPAIAQGTVAVGCVYLLVSLLVTLIGSDWIDKALPPIVVGPIVMVIGLSLAGTAAKDATMNGSSYDIKYFGVAMATMLLTVIFNMYLRGFMSLVPILLGIVCGYIIAVLVGIVDFSGVEKAQWFAMPAFQLPFISYHPGIYWGAILSMAPIAFVTMSEHMGHIMVLNKLTKRNFFKNPGLNHTLAGDGTASIIAGFVGGPPVTSYGENIGVLAITRVHSIYVLGGAAFFAIVFSFVGKLSALIESIPSPVIGGVSFLLFGVIASSGMRILIDNKVDFNQKRNLMIASAILVIGIGNAYLQLGSFQFSGLAVATVLGIVMNLVLPKTAVNEK

SEQ ID NO: 11594 - protein, 200 aa, Glycine max
MSDEERTKQIAELSKSLKEGERIVGPTRRPDGTLRKPIRIRAGYTPQDEVAIYQPKGAFLKKEMGSAGPPGYEPDADSKPKPKPKTKSVKRNERKKEKRIQAALEKEKNVSEVEESGKQEFVEALTSQVNELAVQDSPQAQDIDKRIRALKKKIRLTEALEQKSAEQDLKPEQLEKLAKLEDWRRELKLLEDEKGETTVS

SEQ ID NO: 11595 - protein, 557 aa, Streptococcus pyogenes MGAS10394
MVLSDIEIANSVTMEPISKVADQLGIDKETLCLYGKYKAKIDARQLVALKDKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGVPREDGYDITVASEIMAILCLSENISDLKARLEKIIIGYNFQGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGGRELAEKVVALAEQDNQFRFVYNEDDSIETKLTKIVTKIYGGKGIKLTPTAKRELAELERLGFGNYPICMAKTQYSFSDDAKKLGAPTDFIVTISNLKVSAGAGFIVALTGAIMTMPGLPKVPASETIDIDEEGNITGLF

SEQ ID NO: 11596 - protein, 377 aa, Parvularcula bermudensis HTCC2503
MTTEAEVKYGLAGVLADDTAISKVMPETNSLTYRGYAVQDLSANCRFEDVAYLLWNGDLPSKTDRERLDQQERSQRAVSDDVLEVMSRFSKHAHPMDTLRTAVSFLGQEDPTTEDSSASGLMEKSIRMYARIPTIVAADFRRRNGKDPIAPSDVLGFSENFFHMCFGEVPADEIVKCFDISMTLYAEHSFNASTFTARTIASSLSDVYSAVTGAIGSLKGPLHGGANEAVMHMLKEIGEPAEAKQWMLDAIAEKKKIMGFGHRVYRSGDSRVPTMTKAYEKMVEVIDTPEAKKYWEMSRILDDTMVDAKGIYPNLDFPAGPAYYLMGFEIPMFTPIFVMSRITGWTAHVMEQLANNKLIRPLSNYSGVAQRDVPAGH

SEQ ID NO: 11597 - protein, 783 aa, Zea mays
MASGSRATPTRSPSSARPEAPRHAHHHHHSQSSGGSTSRAGGGAAATESVSKAVAQYTLDARLHAVFEQSGASGRSFDYSQSLRAPPTPSSEQQIAAYLSRIQRGGHIQPFGCTLAVADDSSFRLLAFSENSPDLLDLSPHHSVPSLDSSAPPHVSLGADARLLFSPSSAVLLERAFAAREISLLNPIWIHSRVSSKPFYAILHRIDVGVVIDLEPARTEDPALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVFHGDSTGLSTDSLADAGYLGAAALGEAVCGMAVAYITPSDYLFWFRSHTAKEIKWGGAKHHPEDKDDGQRMHPRSSFKAFLEVVKSRSLPWENAEMDAIHSLQLILRDSFRDAAEGTNNSKAIVNGQVQLRELELRGINELSSVAREMVRLIETATVPIFAVDTDGCINGWNAKIAELTGLSVEEAMGKSLVNDLIFKESEATVEKLLSRALRGEEDKNVEIKLKTFGSEQSKGPIFVVVNACSSRDYTQNIVGVCFVGQDVTGQKVVMDKFVNIQ

SEQ ID NO: 11598 - protein, 257 aa, Burkholderia vietnamiensis G4
MTTPLKVFITGASSGLGLALADEYARQGATLALVARRTEALDAFARRFPKLSVSVYRADVRDADALATAAASFIAAHGCPDVVIANAGISQGAVTGQGDLAAFRDVMDINYYGMVATFEPFVGPMTAARHGTLVGVASVAGVRGLPGSGAYSASKSAAIKYLEALRVELRPAGVGVVTIAPGYIRTPMTAHNPYRMPFLMDADRFAARAARAIARQHAFRVIPWQMGVVAKVLHVLPRWLYDRLFEKAPRKPKAGAH

SEQ ID NO: 11599 - protein, 577 aa, Streptococcus thermophilus CNRZ1066
MTKMLKGIAASDGVAVAKAYLLVQPDLSFETVTVEDISAEEARLDAALAASQDELSVIREKAVESLGEEAAAVFDAHLMVLADPEMTGQIKETIRAKQVNVEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIAAVLGINNITELVKDGDILAVSGITGEVVINPTEEQIAEFKAAGEAYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKELPYFDLPKEMNPFLGYRALRISISETGNQMFRTQLRALLRASVHGKMRIMFPMVALLTEFRTAKGILEEEKAKLVAEGVAVADDIEVGIMIEIPAAAMLADQFAKEVDFLSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 11600 - protein, 362 aa, Triticum aestivum
  misc_feature (138)..(138): Xaa can be any naturally occurring amino acid
  misc_feature (184)..(184): Xaa can be any naturally occurring amino acid
  misc_feature (197)..(197): Xaa can be any naturally occurring amino acid
  misc_feature (313)..(313): Xaa can be any naturally occurring amino acid
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGXARFAKWRAVLKIGATEPSQLSIDQNAQGLARYAIICQENGLVPIVXEPEILVDGPHDIXTGCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSXGKTENEEKARAAFLVRCKANSEATLGTYKGDATLAEGASESLHVKDYKY

SEQ ID NO: 11601 - protein, 292 aa, Shewanella sp. ANA-3
MTDMPSVTTPALDRYAVFGNPIGHSKSPFIHGQFASLTQQTLSYEAILAPIDGFEASLRAFFQAGGKGANVTVPFKEQAFALCDSLSAEATLAGAVNTLSLLADGTIYGDNTDGLGLVADLVRHLGSLQHKRVLLVGAGGAARGCILPLLKAEVGQLVITNRTQSKAQALVDIFSQVQEGRYSDKLQAVSMSELSGVFDLVINSTSASLAGELPPLSQSIIGNKTACYDMMYGAKPTAFNQWALQQGAAQVIDGLGMLVGQAAKSFALWRGVEPDTSGVLKLLRDKLQVDAQ

SEQ ID NO: 11602 - protein, 337 aa, Aspergillus nidulans FGSC A4
MSISSTSPPYPLHPSVKDLLDPEYVAFYNAHVIDKQQVHLQPVETSRTSGILIPGGGPLVDVGKTVDITIKRRATEGPEILLRAFTPIGEAPEGGWPVMLYFHGGGWVLGNIDTENVVCTNLCSRGGCVVVTVDYRLAPENPWPAAVHDCWESFLWLLSDGPANLNINISKIATGGSSAGGNLAAIITHKALTLSPPVRFLAQLLSVPVMDNTATVSNNESYRRYEFVPALPAAKMLWYRNHYLPNEKDWSHPEASPLFYTGDWSALPRALIMVGELDVLRSEGEQYAEKLKQAEVEVDLQVMKGMPHPFLAMDGVLKEGKRSITLMCDLLKEVFSS

SEQ ID NO: 11603 - protein, 205 aa, Glycine max
MQGGMRSFLSHGNVIRNAVLQRVRMVNPLLQTIASSRFESVTPARIEEHGFESTTISDILNDKGKGADGSWLWCTTDDTVYDAVKSMTQNNVGALVVVKSDANKAIAGIITERDYLRKIIVQGRSSKSTKVGDIMTEENKLITVTPDTKVLQAMQLMTDNRIRHIPVIDEKGMIGMVSIGDVVRAVVREHRQEVERLNAFIQGGY

SEQ ID NO: 11604 - protein, 394 aa, Yarrowia lipolytica CLIB122
MLTAARRSTRLTSRLGHQVRAYSIADDADKKCTITLKEDSYTTYMLDSPPPLEFEMTKGELLQMYKDMVTVRRLEMAADALYKAKKIRGFCHLSTGQEAVAVGIEKAIDHDDSVITAYRCHGFAYMRGASVRAIIAELLGKRTGVSYGKGGSMHMFTEGFYGGNGIVGAQVPVGAGLAFAHKYLEQTGKATFALYGDGASNQGQIFEAYNMAKLWDLPCIFACENNKYGMGTAAARSSALTQYYKRGQYIPGLKVNGMDILSVYQGAKFAKEWTTHGKGPLVMEFETYRYGGHSMSDPGTTYRTREEIQYMRSHNDPISGLKAHILELNFATEDELKSVDKAARAMVDKEVALAESDPAPEATAKVLFEDIYVPGTEPPVIRGRIPSEDYYFKN

SEQ ID NO: 11605 - protein, 629 aa, Aspergillus nidulans FGSC A4
MASKTPVLTSKAPKPLPGIYSQAIKCNGMVYCSGAVAMDAETGKIIDGDVKAHTAQCIKNLSAILEEAGSDITKVVKVNVFLANMDDFTAMNEEYMKHWGDVKPVRTCVAVKTLPLNTDVEIECRLEDGAEFDIRPHSVWLGASVAGLVVVSQQAYCLPDGNTGSFWNVGVSCALHRAVVIISVLSFITVCLYFCSRELCERPYDVSLLGVYSHQPSSRDGSIFSASTLYSEKGLKGDTLCVCRHPDITYGQGPYITPSDDSGDSKSMPSIRQPAPIRPTSSLRFSPDPEAEAVFLSKTTVAPGTQSELQPSISRTPSTATAHDTYQSQEQAIPELPDATLQSQSAHTRNQSSLSSLRRFLPRTLPVSVPLSSDPQIRALAEATTHIDHTKQELQKEEPISRQPDALETHTEPPALPSKEDTQLQTTQDCEPSTSKSLPRSTTMNSAEAPEVISPASAPDHNSLTNRRSNTTRATSLPLNMNPNSNPHPSSWSTLLGPSQHSLPRTNSSTVHIPRRHGQNLSQDQFGAPHIPRYTQSQRFPGPRGHNRYSRQLRRNASDVQYQYQYRYQQQGFRRPRSSTFGNMSIASVPGRLDCIRETGASIDELPMDNSRGPDHGESPMSRFMCNHK

SEQ ID NO: 11606 - protein, 575 aa, Arabidopsis thaliana
MTEYENGKKRKVRNKQQVKVQFLSQRYLILCFCCFFVLLFFLSSDRISTLSVRSDSLRPSLRVPTLSVLSSSMDSFHRGRFPPLSVEDRVQFPDHLLLILSHGIGKGEKNLVCVYRGVKEETLVLPSISSDEFDEFRSIVRCPNAPLNYSSSVDLQFRGDLVKKKMKKQSRRVHNWGKVGYEAVIDGDTVVVFVKGLTRRPHKESDPSYYKCQFEIENSEEKEVTQAIAAAQEVVRCGLPESLKLNPEMMFRVSVIHIDPRGRTTPALPSVARIYGSDSIEKKEKKSGVKHELCVCTMLWNQAPFLREWIMYHSWLGVERWFIYDNNSDDGIQEEIELLSSENYNVSRHVWPWIKTQEAGFSHCAVRAKEECNWVGFFDVDEFYYFPTHRSQGLPSKNALKSLVSNYTSWDLVGEIRTDCHSYGPSGLTSVPSQGVTVGYTCRQANPERHKSIIRPELLTSSLLNEVHHFQLKEGVGHMSLVESVAVVNHYKYQVWDTFKAKFYRRVATYVVDWQENQNQGSKDRAPGLGTEAIEPPDWKRRFCEVWDTGLKDLVMSNFADQVTGYLPWQRQQQE

SEQ ID NO: 11607 - protein, 352 aa, Glycine max
MGEVDAAFIQDPPHRPKLSTIQAEGIPIIDLSPITNHRVSDPSAIEGLVKEIGSACNEWGFFQVTNHGVPLTLRQNIEKASKLFFAQSAEEKRKVSRNESSPAGYYDTEHTKNVRDWKEVFDFLAKEPTFIPVTSDEHDDRVNQWTNQSPEYPLNFRVVTQEYIQEMEKLSFKILELIALSLGLEAKRFEEFFIKDQTSFIRLNHYPPCPYPDLALGVGRHKDPGALTILAQDEVGGLEVRRKADQEWIRVKPTPDAYIINIGDTVQVWSNDAYESVDHRVVVNSEKERFSIPFFFFPAHDTEVKPLEELINEQNPSKYRPYKWGKFLVHRGNSNFKKQNEENIQIYHYKIA

SEQ ID NO: 11608 - protein, 518 aa, Oryza sativa (japonica cultivar-group)
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 11609 - protein, 481 aa, Escherichia coli
MLVAQHTVYFPDAFLTQMREAMPSTLSFDDFLAACQRPLRRSIRVNTLKISVADFLQLTAPYGWTLTPIPWCEEGFWIERDNEDALPLGSTAEHLSGLFYIQEASSMLPVAALFADGNAPQRVMDVAAAPGSKTTQISARMNNEGAILANEFSASRVKVLHANISRCGISNVALTHFDGRVFGAAVPEMFDAILLDAPCSGEGVVRKDPDALKNWSPESNQEIAATQRELIDSAFHALRPGGTLVYSTCTLNQEENEAVCLWLKETYPDAVEFLPLGDLFPGANKALTEEGFLHVFPQIYDCEGFFVARLRKTQAIPALPAPKYKVGNFPFSPVKDREAGQIRQAATGVGLNWDENLRLWQRDKELWLFPVGIEALIGKVRFSRLGIKLAETHNKGYRWQHEAVIALASPDNMNAFELTPQEAEEWYRGRDVYPQAAPVADDVLVTFQHQPIGLAKRIGSRLKNSYPRELVRDGKLFTGNA

SEQ ID NO: 11610 - protein, 254 aa, Bacillus licheniformis ATCC 14580
MKKLVKVRGITLGEGRPKICVPLVGKNLAQLKEEAAYFQTLDADIAEWRADFYEDVDDVDQVCAALAEIRGLLKDTPLIFTFRSAAEGGEKEISTARYFSLNEAVVKTGLADVIDIELFNDEEQVKALVETAHGHEVSVIISNHDFEKTPAAEEIVSRLRKAQELGADLPKIAVMPETTADVLRLLEATCTMNEKYADRPIITMSMAGKGIISRLAGEVFGSAMTFGAAKKASAPGQIAAGELKEILHILHRNL

SEQ ID NO: 11611 - protein, 172 aa, Kandelia candel
MANPRVYFDMSVGGSPAGRIVMELFADVVPRTTENFRALCTGEKGKGRSGKPLHYKGSTFHLVIPNFMCQGGDFTAGNETGGESIYGSKFADENFVKKHTGPGILSMANAGPGTNGSQFFICTAKTEWLDGKHVVFGQVVYGMDVVKAIEKVGSGNGRTSKPVVIADCGQLS

SEQ ID NO: 11612 - protein, 255 aa, Burkholderia vietnamiensis G4
MNTQDNPLSHLFANNDAWVKRQLAEDPEFFTRLADQQAPEYLWIGCSDSRVPANQIIGLPPGEVFVHRNIANVVVHSDLNCLSVIQFAVDILRVKHIMVVGHYGCSGVNAALHNRRVGLADNWLHHVQDVRERHAALLDEWPVGEARYRRLIELNAIEQVVNVCRATIVNDAWARGQSLTVHALVYGVHDGRMRNLGMSVSRFDALEATYRRCVAALTARGQHAPDNDMVAADAAHLEHVAQAVADTLKPCDDAQ

SEQ ID NO: 11613 - protein, 914 aa, Zea mays
MAAAFSAAILFHLLLLLFSPSAAQPGFISLDCGGARDHTDAIGIQWTSDASFVSGGQAAQLLVQNGLQQTQQQLTTVRYFPADNRKHCYTMNVRNRTRYLVRATFLYGNFDNSNVYPKFDISLGASPWSTIVVDDATTPVVEEAIILAAAPTLSVCLSNASTGQPFISTLELRQFNGSLYYTTDETRFFLGLSARINFGAGSNDSVRYPDDPFDRIWESDSVRRANYLVDVAPGTERISTTKPIFVGTNEEPPEKVMQTAVVGQDGSLNYRLDLEGFPANAWGVSYFAEIEDLAPNETRKFKLEVPGMPALSKPTVDVEENAQGKYRLYEPGYTNLSLPFVFSFGFRKTNDSSKGPILNALEIYKYVQITMGSQDANIMASMVSRYPQEGWAQEGGDPCLPASWSWVQCSSETSPRIFSITLSGKNITGSIPVELTKLSGLVELRLDGNSFSGQIPDFRECGNLQYIHLENNQLTGELPSSLGDLPNLKELYVQNNKLSGQVPKALFKRSIILNFSGNSGLHIVSNGISHTIIVICLVIGAVVLLGVAIGCYFITCRRKKKSHEDTVVIAAAPAKKLGSYFSEVATESAHRFSLSEIENATGKFERRIGSGGFGIVYYGKLADGREIAVKLLTNDSYQGIREFLNEVTLLSRIHHRHLVTFLGYSQQDGKNILVYEFMHNGTLKEHLRGADNEKITSWLKRLEIAEDSAKGIEYLHTGCSPTIIHRDLKSSNILLDKNMRAKVADFGLSKPAVDGSHVSSIVRGTVGYLDPEYYISQQLTEKSDIYSFGVILLELISGHEPISNDNFGLNCRNIVAWARSHIESGNIHAIIDESLDRGCYDLQSVWKIAEVAIMCVKPKGAQRPPISEVLKEIQDAIAMERVLVSNCSNRMGSGSVEQNGGASFDELLMQPGLR

SEQ ID NO: 11614 - protein, 903 aa, Bdellovibrio bacteriovorus HD100
MHQNVNSDKQASKTAVPQKFVYFFAAGDSEGNAGMKNILGGKGANLAEMTSLGIPVPPGFTISTEICAHFYEAGGKLPDWVRPAVQESMNKVESKIGKKFGDVNNPLLVSVRSGARASMPGMMDTILNLGLNDQTVEGLAKSSNNPRFAWDSYRRFIQMYSDVVMGMNSSLLEVTLEDMKEEKHYKLDTEMTVDDLKLLVKKFKDLVHQMTGQSFPADPWEQLWGAISAVFHSWNTPRAITYRELHSIPAAWGTAVNVQSMVFGNMGDDSATGVAFTRNPSTGEKAFYGEFLINAQGEDVVAGIRTPQPITKIAAAAAGVMSLEEALPQAYGQLVEIYKKLEGHYRDMQDIEFTIERGVLWMLQTRNGKRTAAAALKIACDMIDEKLITQDEAILRLDPSSLDQLLHPTLDPKAAKTTLAKGLPASPGGVNGQIVFTSEEAVEWREQGKKVILVRIETSPEDIAGMVAAQGILTTRGGMTSHAAVVARGMGKCCVAGCGDIEVDYRNETMKVKGYVLKKGDVITLDGSTGEVYLGEVKTIEPKLDGNFERIMKIADGIRRLKVRTNADTPKDAQTARNFGAEGIGLCRTEHMFFGADRIDAVREMIIADNKMDREKALAKLLPMQREDFYQLFKIMDGLPVTIRLLDPPLHEFVPHTDEETKELAKRLNTDYERLRSKVKSLHEFNPMLGHRGCRLAITYPEIYQMQVRAIAEAAAQLMAEGKTLAPEIMIPLVATDKELDTLRGQAVAEVNKVQSEKNVKFEYTVGTMIELPRAAITADAIAEHADFFSFGTNDLTQTTLGLSRDDSGRFLGTYVSHGILPKDPFMSIDQVGVGSLVKMGVDLGRRTKPDLKVGVCGEHGGDPESIEFFHKVGLDYVSCSPFRVPIARLAAARAALIGKKIH

SEQ ID NO: 11615 - protein, 493 aa, Zea mays
  misc_feature (473)..(473): Xaa can be any naturally occurring amino acid
MRALAPRPSQSRSLQQPRNLCRALHTGVQAAPGPALMNLAAFSSTLATLPWYEMPSINSSATFSSSLLRRSLCASLRTISHMASAAAPTSAPVATTENGAAKAIEQRPVQVAERLEKFKTTIFTQMSMLAIKHGAINLGQGFPNFDGPDFVKEAAIQAINAGKNQYARGFGVPELNSAIAERFLKDSGLQVDPDKEVTVTSGCTEAIAATILGLINPGDEVILFAPFYDSYEATLSMAGANVKAITLRAPDFAVPLEELEAAVSKDTKAIMINTPHNPTGKMFTREELESIAALCKENDVLLFSDEVYDKLVFEADHISMASIPGMYERTVTMNSLGKTFSLTGWKIGWAIAPPHLTWGLRQAHSFLTFATCTPMQAAAAAALRAPDSYYDELKRDYSAKKAILLEGLEAAGFIVYPSSGTYYIMVDHTPFGFDSDVEFCEYLIREVGVCAIPPSVFYLDPEEGKKLVRFTFXKDEGTLRAAVERLKAKLRRK

SEQ ID NO: 11616 - protein, 248 aa, Magnetospirillum magnetotacticum MS-1
MAKLDGKVAVVTGASKGIGAAIAKALAADGAAVVVNYASSKAGADSVVEAITSAGGKAIALQGDVSKAAQAHSLIEAAVTQFGRLDVLVNNSGVYEFAPIEEVTEEHYRRQFDVNVLGVLLATQAAAKHLGEGGSVINISSAITHLNTPNASVYSGTKGALNAISGVLANELAPRKIRVNTVSPGFVVTEGTHSAGIVGSEMAAGIVAQTPLGRAGQPDDIADVVRFLASDEARWLTGEVITASGGMR

SEQ ID NO: 11617 - protein, 199 aa, Helicobacter pylori
MVKIGVCGPVGSGKTALIEALTRHMSKDYDMAVITNDIYTKEGAEFMCKNSVMPRERIIGVETGGCPHTAIREDASMNLEAVEEMHGRFPNLELLLIESGGDNLSATFNPELADFTIFVIDVAEGDKIPRKGGPGITRSDLLVINKIDLAPYVGADLKVMERDSKKMRGEKPFIFTNIRAKEGLDDVIAWIKCNALLED

SEQ ID NO: 11618 - protein, 603 aa, Phanerochaete chrysosporium
MPSSIDFPDRLVLRVIAYELVFLFYPAVPAAAGLVLLRRLTDIWLPTWAIVLLSVCSLPVVHGLSIWRNHWRAARKAARMGAVLPPRLKGRWPGSIDLLMRLTDAFETGFMSDLLWEYMHTIGQTFEVYVLWDSNYVTSDANVVKAILATDFTSFVKGKKFDVCMRSVLGTGVFNSDGDMWKFHRTMTRPFFTRERISHFDLFDRHADDAMAKMKARFAEGYAVDFQDLISRFTLDSATEFLFGQCVHSLASVLPYPHNAPAHLQTTSASAAEDFARAFAEAQTVLNFRIRMGWLWPWFELFGSRTKAPMAVVDAFLDPILKAAVERADKIKHANGGKVPEAKEEIDEDETLLDHLVKYTNDPKILHDEVLNIMIAGRDTTAGTLTSAVYFLSQYPEVLRRLREEILEKVGPTRRPTYDDIREMKYLRAFINETLRLYPAVPWNVRYPVKDTTIPGPEPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWAKAHLTLYAKGGLWVKMREAPTSEAV

SEQ ID NO: 11619 - protein, 514 aa, Shewanella sp. ANA-3
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDAAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYELITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 11620 - protein, 519 aa, Zea mays
MATATYLPSSFSFSSPPPPPSSRARLRRQTTRAGASAATDRPREVLSPKRRLPLREVPGDYGPPVLGAVRDRFEYFYGPGGRDGFFASRVRAHGSTVVRLNMPPGPFVARDPRVVALLDAASFPVLFDTSLVDKTDLFTGTFMPSTDLTGGYRMLSYIDPAEPSHGPLKALLFYLLSHRRQHVIPKFREVYGDLFGVVENELARVGKADFGHHNDAAAFSFLCQALLGRDPAESALHGDGPKLITKWVLFQLSPLLSLGLPKHLEDSLLHSFRLPPALVRKDYGRLADFFRDAARTVVDEGERLGIAREEAVHNILFATCFNSFGGMKILFPSLVKWLGRAGARAHGRLATEVRDAVRAHAGEVTMKALAEMPLVESAVYEALRIEPPVAMQYGRAKRDMVVESHDYGFEVREGEMLFGYQPMATKDPRVFARAEEYVPDRFLGEDGAQLLRHVVWSNGPETASPTLQDKQCAGKDFVVLIARLLVAELFLRYDSFDVQVGASALGSSVTITSLKKATF

SEQ ID NO: 11621 - protein, 399 aa, Erythrobacter sp. NAP1
MSISPLMPVYPRCGVRPVRGEHCHLIDEDGTRYLDFASGIAVNLLGHSHPGLTKAIQDQAATLMHVSNLYGSPQGEKLAQQLVDKTFADTVFFTNSGAEAVEGAIKAARAYHQNAGEHGDKDRFELITFSNAFHGRTMATISASNQTKMHHGFSPMLEGFKYAEFDNLESAKEFIGPRTAGFLVEPIQGEGGIRPASDSFMKGLRELADQHDLMLVLDEVQCGVARTGKMYAYQHYGIEPDILATAKGLGGGFPIGAVLATEKAARGMTFGTHGSTYGGNPLAMAAGGAVMDAVANEEFLAEVTEKGERIRARLEQFIGNYPELFELVRGKGLMLGIKMKVESRPFFVHLRDNHQLLTVAAGDQTLRVLPPLVIGDAEIDEFFEKLSAGAASFKVPEAA

SEQ ID NO: 11622 - protein, 598 aa, Bacillus licheniformis ATCC 14580
MKQESVQQKNISIMSSFSGSRKVYVEGSRPDIQVPMREISLSPTTGSFGDEENQPVRVYDTSGPYTDANADVDILKGLKPLRATWIRERGDTEEYEGREIRPEDNGYKGKEKASHSYTGLKRKPLRAKKGQNVTQLHYARKGIITPEMEFIAIREHVSPEFVRDEVASGRAIIPSNINHPESEPMIIGRNFHVKINANIGNSAVTSSIEEEVEKMTWAIRWGADTMMDLSTGKDIHTTREWIIRNCPVPVGTVPIYQALEKVNGVAEDLTWDIYRDTLIEQAEQGVDYFTIHAGVLLRYVPLTAKRVTGIVSRGGAIMAQWCLAHHEESFLYTHFEEICEIMKTYDIAFSLGDGLRPGSIADANDEAQFAELETLGELTEIAWKHDVQVMIEGPGHVPMHKIKENVDKQMEICKEAPFYTLGPLTTDIAPGYDHITSAIGAAMIGWYGTAMLCYVTPKEHLGLPNKDDVREGVITYKIAAHAADLAKGHPGAQIRDDALSKARFEFRWRDQFNLSLDPERALEYHDETLPAEGAKTAHFCSMCGPKFCSMRISQDIRDYAKENNLDEEKAIQKGLKRRRRNLKKQAAAFTVKSGQYSR

SEQ ID NO: 11623 - protein, 237 aa, Yarrowia lipolytica CLIB122
MDCHSEHVEHDHGDHGHDHGHDHSHVPQPHTSSAQTLYNRISHAGIRTLNESEEGAGASVFKDWESRLDTSKYLESDVDEQLLIHVPFTGLCKIHSLLIRTTNDDSAPRHMKLFKNRDDLDFSTASDLTANHVIEHPEGVGGTLDHSIEVAPTSSSLDEEGIAEYALSRAQWSNITSLTLFVEDNYGEDVTRILYIGLRGEFKELNRAPVVTLYESAANPADHKKIVPGEEYVGDTL

SEQ ID NO: 11624 - protein, 87 aa, Glycine max
MALGDDSPASYIRMVHHLIEKCMTFGMSMEECMEALSKRADVQPVVTSTVWKELEKENKEFFDRYNKQLRSEKEGRSSCSSSSDSSS

SEQ ID NO: 11625 - protein, 564 aa, Oryza sativa
  misc_feature (493)..(493): Xaa can be any naturally occurring amino acid
MGSMEQQQPESAAPATEASPEIIFRSKLQDIAITNTLPLHRYCFERLPEVAARPCLIDGATGGVLTYADVDRLSRRLAAALRRAPLGLRRGGVVMSLLRNSPEFVLSFFAASRVGAAVTTANPMSTPHEIESQLAAAGATVVITESMAADKLPSHSHGALTVVLIDERRDGCLHFWDDLMSEDEASPLAGDEDDEKVFDPDDVVALPYSSGTTGLPKGVMLTHRSLSTSVAQQVDGENPNIGLHAGDVILCALPMFHIYSLNTIMMCGLRVGAAIVVMRRFDLAAMMDLVERHRVTIAPLVPPIVVAVAKSEAAAARDLSSVRMVLSGAAPMGKDIEDAFMAKLPGAVLGQGYGMTEAGPVLSMCLAFAKEPFKVKSGACGTVVRNAELKIIDPDTGKSLGRNLRGEICIRGQQIMKGYLNNPEATKNTIDAEGWLHTGDIGYVDDDDEIFIVDRLKEIIKYRGFQVAPAELEALLNTHPSIADAAVVGKQIXLKFGEIPVAFVAKTEGSELSEDDVKQFVAKEVIYYKKIREVFFVDKIPKAPSGKILRKELRKQLQHLQQEA

SEQ ID NO: 11626 - protein, 448 aa, Borago officinalis
MAAQIKKYITSDELKNHDKPGDLWISIQGKAYDVSDWVKDHPGGSFPLKSLAGQEVTDAFVAFHPASTWKNLDKFFTGYYLKDYSVSEVSKDYRKLVFEFSKMGLYDKKGHIMFATLCFIAMLFAMSVYGVLFCEGVLVHLFSGCLMGFLWIQSGWIGHDAGHYMVVSDSRLNKFMGIFAANCLSGISIGWWKWNHNAHHIACNSLEYDPDLQYIPFLVVSSKFFGSLTSHFYEKRLTFDSLSRFFVSYQHWTFYPIMCAARLNMYVQSLIMLLTKRNVSYRAQELLGCLVFSIWYPLLVSCLPNWGERIMFVIASLSVTGMQQVQFSLNHFSSSVYVGKPKGNNWFEKQTDGTLDISCPPWMDWFHGGLQFQIEHHLFPKMPRCNLRKISPYVIELCKKHNLPYNYASFSKANEMTLRTLRNTALQARDITKPLPKNLVWEALHTHG

SEQ ID NO: 11627 - protein, 269 aa, Pyrococcus furiosus DSM 3638
MFENFISNLASYILSISGGNIIVVSIYAGLFVALMTTLGALVAIIAHKLPEWSVDISLSFAAGVMIVASFTSLIIPGIELSGRFLPVGVGIFLGVLLIYAIDNLLPHEHLVKGYEGPRELKERLRTVWLIVFAVIIHNLPEGLAIGTSLVYNLKSGLVTAIAIGIQDFPEGTVVSLPLASIQKKRLTPIAMGALSGIAEMIMVVLGALLFSFFHGLLPYGLGLAGGAMLYVTVKEMIPEIYKREENEKLVTLGFFLGFYVMLFLDSMLG

SEQ ID NO: 11628 - protein, 156 aa, Nostoc sp. PCC 7120
MQDIGEILDNRVLLVALVACFVAQALKLFVELIKNRKLNVRVLVTTGGMPSAHSALVTSLAAGVGQTLGWASPDFALATVFAIIVMYDAAGVRQAAGKQARILNQMIDELFHEKPDFSQDRLKELLGHTPVQVIAGSALGVTISWLARALFIVNSP

SEQ ID NO: 11629 - protein, 434 aa, Sulfolobus solfataricus P2
MSWNNFLFLKYLIKAMEELLTSNLFVQQVKKLYKVGELLGLDIDTLEALSQPERVIQVKIQIRGSDGKLRTFVGWRSQHNSALGPYKGGVRYSPNVTQEEVIALSMIMTWKNSLLLLPYGGGKGGIRVDPKKLTLKELEDLSRKYIQLIHNYLGSNVDIPAPDINTNPQTMAWFLDEYIKITGEVDFAVFTGKPYELGGIGVRLYSTGLGVATIAREAANKFIGGIEGSRVIIQGFGNVGSFTAKFLSEMGAKIIGVSDIGGGVINENGIDVNKALEVVQRTGSVVNYPEGKKVTNEELLISDCDILIPAAVENVINKFNAPKVKAKLIVEGANGPLTADADDVIKQSGIVVIPDILANAGGVVGSYVEWANNKSGGIISDEEAKKLIIDRMTNAFNTLYDFHKRKFADQDLRTVAMALAVDRVVKAMKARGLL

SEQ ID NO: 11630 - protein, 297 aa, Burkholderia vietnamiensis G4
MHTRFEGIWLPIITPFHDGEVDHGALARLARHYAAAGIAGFVAGATTGEGVLLDAREQDAVFATLRDAAPGMPIVVGLTASATHFAAARARELAALRPDGLLVTPPVYVRPTQDGIRRHVEAIVAAADVPVLVYNIPYRTGVNVELETLQALARDARVAGVKECGGTLDRLSRLVHDTPLAILSGDDNQNFAALCAGAHGAIASSAHVLPEWHVRIHALLRDGRLADARRLAVALQPLVAALFAEPNPAPVKALLAAQGWCEDGLRLPFVPASAALRDRLGELWAALQAHAPAVAAV

SEQ ID NO: 11631 - protein, 162 aa, Triticum aestivum
THPVPAAAAACRSLPPPLPSRPPYASAAMDAATDGEQRRLLSIPKEGERVIAPTRRPDGTLRKEIRIRAGYVPQDEVAIYQSKGALMKKSGPDVTPGYDPALDAKPKTKAAKRNERRKEKRHQGAPNIEKGRSLENKGLIWKTPHHVFFFQKRGGGEHYNFY

SEQ ID NO: 11632 - protein, 378 aa, Nostoc sp. PCC 7120
MMVCEYKPGLEGIPAAQSSISYVDGQKGILEYRGIRIEDLAQQSTFLETAYLLIWGELPTKEELQVFEEEVRLHRRIKYRIRDMMKCFPESGHPMDALQASAAALGLFYSRRDLHNPAYIRDAVVRLIATIPTMVAAFQLMRKGNDPVKPRDDLDYSANFLYMLNEKEPDALAAKIFDICLILHVEHTMNASTFSARVTASTLTDPYAVVASAVGTLGGPLHGGANEEVIQMLEEIGSVENVRSYVEERLQRKDKLMGFGHRVYKVKDPRATILQGLAEQLFAKFGADKYYDIAQEMERVVEEKLGHKGIYPNVDFYSGLVYRKMGIPTDLFTPIFAIARVAGWLAHWKEQLEENRIFRPTQVYNGKHSVTYTPIDQR

SEQ ID NO: 11633 - protein, 898 aa, Burkholderia thailandensis E264
MSAVPNEVMKYVAAERDDDAQETVEWLEALDGVISSVGPGRAHYLIEKQIEFARMHGEHLPFSANTPYINTIPVEAQAKIPGDQDIEHRIRSYTRWNAIAMVLRAGKDTNVGGHIASFASAATLYDVGYNHFWHAPSAEHGGDLVFVQGHSSPGVYSRAFLLGRLSEEQLDNFRQEVGGNGISSYPHPWLMPDFWQFPTVSMGLGPIMAIYQARFMKYLESRGIAKTAGRKVWAFLGDGETDEPESLGAIGMASREKLDNLVFVINCNLQRLDGPVRGNGKIIQELESEFRGAGWNVIKVIWGSRWDALFARDKTGALMRRMMEVVDGEYQTYKSESGAYVREHFFNTPELKALVADWSDDDIWNLNRGGHDPHKIYAAFHAASNSKGAPTVILAKTIKGYGMGESGQAMNITHQQKKLPVEQLKKFRDQFRLPITDEQIADVPYVKFEEGSKELEYMRKQRMDLGGYLPQRRQKAESLPVPPLEAFEPLLKGTGEGREISTTMAFVRILNILLKDKTLGKRVVPIVPDESRTFGMEGLFRQIGIWNQEGQKYVPEDSDQLMFYKESETGQILQEGINEAGGMCDWIAAATSYSTHGEIMVPFYIFYSMFGFQRIGDLAWAAGDMRSRGFLLGGTAGRTTLNGEGLQHEDGHSLMWAASVPNCVSYDPTFGYELAVIMQDGLRRMVQEQEDVYYYVTVMNENYEHPAIPQGEHVAADIIKGMYSFKKADADKKAPRVQLLGAGTIFNEVIAAAELLKNDWGVAADLWSVPSFTELAREGHEVERWNLLHPAEPRRLSHVQKCLKDTQGPVIASTDYVRALADQIRGQIDRRYVVLGTDGFGRSDTRKALRHFFEVDRYWVTVAALNALADEGAIDRKVVADAIAKYDLDPAKPNPMTV

SEQ ID NO: 11634 - protein, 319 aa, Shewanella sp. ANA-3
MTVLLSFGEVLVDLLPTDISGKSHQAIAGGAPANVAVGYAKLGGKSYFAGGISTDDYGAMLKQALANEGVVTDYLTQVPEAPTATVVVNLDEHGERTFEFNRQGTADLCYSPRHFDAIPWQQMDIFHLCSNTFTEASIFNASLYGACCANSFNKIVSFDVNLRLSLWPDTALLAERVEQCFRYTQVLKMSREEAEYLALTRNKSFEDYLQFCLAHGVEVILITDGANPVQCITVNERFSVPVPQIKAVDTTAAGDSFMAGFLFALGFELAFDLEHLTLKHRLACQAQLRKAIEFAVRCGAVTCGQKGAFPALPTLSQVS

SEQ ID NO: 11635 - protein, 618 aa, Prosthecochloris aestuarii DSM 271
MITPAHDLPSDVLSLARKISREQLLKAKENGFSDFQLANIFNATEPDIRMLRKHYGVESVFKTVDTCAAEFDASTPYHYSSYDDENESVRSDNKKVIILGGGPNRIGQGIEFDYCCVQAVFALREAGYETIMVNCNPETVSTDYDIADKLYFEPLTFEDTIRIIEHEDPLGVIVSFGGQTPLKLSSKLEEAGVTILGTSSKGIDLAEDRKKFGAVLRELNIPHPDYDTAISYEEAQEITRRIGYPVLVRPSYVLGGRAMKIIYSDDSLKEYVDQALFITEKYPLLIDRFLETAVEFDIDAIADTTDCVVSGIMQHVEAAGIHSGDSTSILPYHNINPEVIKTMKEYTRRLAERIGVVGLMNVQYAVQNDSVYVIEVNPRASRTVPFVGKATAIPVVKIATRVMLGEKLSDLRKEYRLADCDELGMNHLAIKEPVFPFSKFVKSGVYLGPEMRSTGEAMSLAYNFPEAFAKAYQAANMELPTSGTVFISVNDHDKDERIIRIAKDLYRIGFDLVATSGTQQYLIEHGIECKKVYKVGEEGRPNIFDTIRLGKIDFVINTPLGERALNDEEAIGAASVTSGVPFVTTIEAAEASIQAIDCLRQQEFGVKSLQEYASYRNQ

SEQ ID NO: 11636 - protein, 290 aa, Enterococcus faecalis V583
MDLTNATIITAMVTPFQESGEIDFDKLPQLVDYLLANHTEGVILAGTTGESPTLTHEEELQLFQRIIELIDGRIPIICGVGTNDTRDSVAFVKELATIAGIDAVLAVVPYYNKPNQEGMYQHFKTIAEASELPIILYNVPGRTAACLEVETTLRLAQLEKIVAIKECAGLDAITELIERAPKDFLVYTGEDGLAFATKALGGQGVISVASHVFGSSMYEMYQALEQGNLPEAAKIQRQLLPKMNALFSVPSPAPVKAALNHLGIPVGNLRLPLVACTPEEEQRIIRTLEI

SEQ ID NO: 11637 - protein, 401 aa, Glycine max
MATKRSVGTLKEGDLKGKRVFVRVDLNVPLDDNLNITDDTRVRAAVPTIKYLTGHGAKVILSSHLGRPKGVTPKYSLKPLVPRLSQLLGIEVTMANDSIGEEVEKLVAQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDKTQTVIWNGPMGVFEFDKFATGTEAIAKKLAELSGKGVTTIIGGGDSVAAVEKVGLADKMSHISTGGGASLELLEGKQLPGVLALDDA

SEQ ID NO: 11638 - protein, 506 aa, Pyrococcus furiosus DSM 3638
MSKFIHHKIFDEIYEIGEDGVPEFKTYIAGKWIYGEKFKDIKSPINGEVIARVSILSREQIEEAISTTYEIGREKIRDYPGEKRISSFLKAAEMMKEAFDDFVRILILDAGKPKSNAMGEVKATIERLEKTTFEFGRLIGDYIPGDWSEETLESEAIVKREPYGLILAISPFNYPLFISATKVIPALLSGNAVLLKPASADPLAPILFTRVLELSGLPKESFSLLTVPGGFMDDIVRDKRIRAITFTGSTEVGEHIIRTGGIKAYHLELGGKDPAIVLNDANIEESVEKIVKGIVTYSGQRCDAIRLILVEEDIYEQFRESLVAQLSKIEPKNPLEDENAIMGPLIDEDSANYIEEIYKDAIEKGARPLLEFRRRGNYVWPIVLEVNNEILPTLRAFNEDVFGPLALLIKVKDEDEAIEIANSSRFGLDAAVFTTCEKRARKVARKLEVGSVFINEYPRHGIGYYPFGGMKDSGIGREGIGYSLEMLTTTKTIVHNFRGQGVWEYI

SEQ ID NO: 11639 - protein, 433 aa, Sulfolobus solfataricus P2
MGIIDEAKRGQITDEMRAISKLEGIPVEKVRNRISEGKIMLIRNAKYPSRKLVPIGKGLTTKVNVNIGTSSEVVDLDMELQKVKVANKWGDTLMDLSTGGDLDAIRRDIIKASDLPVGTVPVYQIFIESFKKKSGGAYFTEDELLNTVEKHLKDGVAFMTIHAGITKDLAIRALKSDRIIPIVSRGGDMIAGWMIHNNSENPYRKNWDYVLEMFKEYDAVISLGDALRPGATGDAHDEFQIGELLETARLVKSALQKGVQVMVEGPGHVPLNEIAWDVKLMKKLTGGVPYYVLGPLPIDVGAPYDHIASAIGAAISSASGVDLLCYLTPAEHLGLPTVKQVEEGAIAYRIAAHAGDVVKLGRKARKWDDEVSYYRGKLDWENMISKLIDPQRAYQVYTQFGTPKVKACTMCGGYCPMMWAMDQVRKIGSSSSL

SEQ ID NO: 11640 - protein, 365 aa, Cryptococcus neoformans var. neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAGDIWSTGCIFAEMLEGKPLFPGKDHVNQFSIITELLGTPPDDVIQTIASENTIRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 11641 - protein, 334 aa, Zea mays subsp. parviglumis
MARQGVVASMHALALLLGAFAAIPTGVQSIGVCYGVNGDNLPPASDVVQLYQSNGINLMRIYFPDANALNALSGTSIGLIMDVPNTDLASLASDPSAAAAWVQSNVQAFPSVSFRYIAVGNEVSGGDTGSILPAMKNLNAALANAGLGGSIKVSTAVQSGVTQGFPPSQGTFLQGYMAPIAQYLQSTGAPLLCNVYPYFSYVGNPAQIDLSYALFTSPGTVVQDGSNAYQNLFDALVDTFVSALENAGAGNVPVVVSESGWPSAGGDAATAANAQTYNQNLINHVGQGTPKRPGPIETYIFAMFNEDQKTGAESERHFGLFNPDKSPAYPINFS

SEQ ID NO: 11642 - protein, 530 aa, Nostoc sp. PCC 7120
MNLVNKAEKTFALTTPLYYVNDVPHIGSAYTTMAADAVARFQKLLGRDVLLITGTDEHGQKIQRSAESLGKAPQEFCDEIVPSFMSLWRLLNIQYDRFSRTTAVRHKAIVDEFFARVWEAGDIYQGQQKGWYCVSCEEFKEERELLEGNRCPIHVNKEVEWRDEQNYFFRLSKYQTQLEEFYQSHPDFIQPESRRNEVLNFVSQGLQDFSISRVNLDWGFPVPNDPKHTLYVWFDALLAYVTALLDPEDEPTLENALGKWWPINLHLIGKDILRFHAVYWPAMLLSAGLPLPDRVFGHGFLTKDGQKMGKSLGNTVDPVGLVQQYGSDAVRYYFLKEIEFGKDGDFNEVRFIHVLNADLANDLGNLLNRTLNMVKKYCANYALSITNEDIPAENTLKALGVDLGAKVKQAYEVLAFNQACGVVLSLVQASNKFIDDQAPWSLYKQERQQEVETVLYTVLESVRLAAYLLSPVIPNISSNIYQQLGFGINFNEQTDITPFAIHAQWGLLSNKQQLGQPQPIFKRIEQTKNV

SEQ ID NO: 11643 - protein, 182 aa, Mesembryanthemum crystallinum
MASSMVSSAAVATVNRTPAQASMVVPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELREAKKAYPEAFIRIIGFDNVRQVQCISFIAYKPASYDA

SEQ ID NO: 11644 - protein, 447 aa, Legionella pneumophila subsp. pneumophila str. Philadelphia 1
MMEIKRVLKDRLSARVCVIGAGPSGIAAIKNLQEHGITNVTVFEKNNQIGGNWVYDEQNEHSSVYETTHIISSKRWSEFEDFPMPVDYPDYPSHSQLLKYFQSYVEHFHLDRYIRFNTVVQKVHRLDDNTWHVIYEDAQGIHEACYDYLLVANGHHWDPFMPVYPGVFDGEILHSHQYKKASIFKGKRVLVVGGGNSACDVAVEISRVAPGTCISMRRGYHIFPKFIFGKPTDVAVAKIQWMPSWLRQKFISLVIRGLQGRYAKYKLMKPDCGPLEIHPTINSELLYFIRHGKIHPRSGISRFEGNTVHFTDRTQGEFDTIIFATGYQISFPFFDKSCIDFSNSTTIPLYRKMMHPEFENLYFIGLCQPQGCIWPLADYQSKIVARIIAGTLKRPDQLHRKIAKEINKPHHRFKSHMRHALEVDYHIFRKELLEMLGQKHKRLKFYP

SEQ ID NO: 11645 - protein, 457 aa, Alkaliphilus metalliredigenes QYMF
MTYDVLVLGGGPGGYVAAIKAAHLGGKVALVENGYFGGVCLNWGCIPTKALLKNARVYQDVLMGDFYGIEGIDKSQLSINWPAMLKRKDRIVRQLVGGVKGLLKKNKVDVFDGFGTLIDANHIEVKGQQLEGKKLIIATGTSPMIPDIPGLEASMKAGNILTSKELLSIEALPKSVVILGGGVIAIEFATLLNALDVEVTVIQRSDRILKGVEEEMALTLSKDLIKRKVKIVTNSSVEKIEGTRVFTKINGEEEIFEGDKILLSLGTSPNVKGLEALSLDMDKKGIITNDKMETSITGVYAIGDVNGKYQLAHVASAEGIVAAENAMGGNEELNYNIVPSCIYSFPEIASVGLTEEEARQKDYDVVVSKFPLAANGKAMAEGENIGFVKIIADKKYGEILGTHIMAVHATDMISEAIVSMQLEGTAYDVAKAIHPHPTMSEIVMEAAHGIMDQPIHF

SEQ ID NO: 11646 - protein, 387 aa, Bacteroides fragilis YCH46
MKTVFPIHKFRELPTPFYYYDTKVLRDTLACVNREVARYDNFSVHYAVKANANPKVLTIIRESGLGADCVSGGEIRAAIKAGFPAGKIVFAGVGKADWEIDLGLDYDIFCFNVESVPELEVINELAAAKGKVANVAFRINPNVGAHTHANITTGLAENKFGISMHDMDKVIDVALELKHVKFIGLHFHIGSQILDMGDFIALCNRVNELQDKLEARHILVEHINVGGGLGIDYDHPNRQPIPDFADYFRTYDEHLKLRPHQTLHFELGRAITGQCGSLISKVLYVKQGTNKQFAILDAGMTDLIRPALYQAHHKMENLTSEDPVVETYDVVGPICESSDVFGKAVDLNKVKRGDLIALRSAGAYGEIMASGYNCRELPKGYISEELV

SEQ ID NO: 11647 - protein, 108 aa, Filobasidiella neoformans
MGVTVENISAGDGKTFPQPGDSVTIHYVGTLLDGSKFDSSRDRGTPFVCRIGQGQVIRGWDEGVPQLSIGQKANLICTPDYAYGARGFPPVIPPNSTLKFEVELLKIN

SEQ ID NO: 11648 - protein, 1796 aa, Gibberella zeae PH-1
MAVPSKPVNDNSAVERHNSIETETPPADGFVPEQTDVENHVDDISSKILDIIFDYALNKFNDSKERLESGRPKFLAVVSKFVAAGTRVDMCLPAFPFKSANKAYKVFGILPDKAEELSLGRLNTMCVRISEIYPPGAQCIIISDGIVYNDLLSISDRDTWAYGQALRKMASAKDFKHIGFSRIKDLIDFPMPPDLREIAYVANCTNFRRAFLNRFGKDDIDIDKEIKDNPDTMMTYLGYRRFLESDLKHIFPVGNGRTANDYRRDVRYLAKQMLIRGYAFAGAVKNGFPNHLRLSIHHSTGEHKISMSLLDTKTGFTTPWHCCVARMANGEWTSAPMGEYLKDSNMKVVHENGRPSYFQETIDGAGIEEVSAAQPVHMPRIKSRDTSPDTKSTILSPFTGEEEERLKVLAKSISTQLKQQDNKPINPFSTSENPALDPHSSEFSIAAWLQAVMSITSRDPEKYPRGVAGVAYKDLSAHGVGEATDYQKTFGNYPLELVKFAKKLMSQGESAKIQILRDFDGLIRSGEMLLVLGRPGSGCSTFLKTISGETSGFKIGEESYLNYQGIPKETMHKDFRGECIYQAETDAHFPQLTVGQTLDFAGRARTYVTHLRDVVMAAFDCFQLTSPKVGNDFVRGVSGGERKRVSIAEVAIGGSAVQCWDNSTRGLDSATALEFVRTLRTSTKLTGATALVSVYQASQSIYNVFDKVSLLYEGRQIYFGNIHAAKEFFINMGFECAPRQVTADFLTSLTNPLERRVRPGFQAAWKRSKDRDRLLQEIDEFNKEYPIGGPSLDSFKKFRKTVKATSQRAKSPYNLSIPQQVALCVRRGFQSLRSNATLVIIGSLFNSIMALVVGSIFYDLPNTTDALYSRGALLFFGILLAAFASALEVGIIMTLYAQRPIVEKHTKYAFYHPFTEAVASMICDLPNKILTSITFNLVLYFMTNLRRTPGHFFVFLLFTFTCTLTMSMYFRSIGALSRSLPEALAPASIFSLALAIYTGFSIPIKDMVPWFQWLNYLNFHGRTIECSRFVPQGPTYERVSSGERICATTGAAAGADFVDGDVYLDVNFGYHHSHLWRNFGIMIALMLFGCAVYLVATEYISAKRPKGEVLVFRRSHMPYLQSRMDEEAASSGNGFDILPNHKTALDPPVGLEKQTAIFQWSDVTYDIKVKKETRRLLHQVDGWVQPGTLTALMGITGAGKTTLLDVLANRTSVGIVDGEFLVNGQARDTGFQRKTGYVQQQDLHLSTTTVREALTFSALLRQPRTTSRKDKLQYVEHVIDTLEMRSYADAIVGIPGEGLNIEQRKRLTIGVELAAKPALLLFLDEPTSGLDSQTAWSICQLLRRLADNGQAILCTIHQPSAHLFQVFDRLLFLAMGGRTMYFGDIGPHSKTMTSYFERNGARTCGPDENPAEWMLEITGSLSEQDWPAIWNESPERKAVRAELATKKAELSQRAIAITVPSDVDVLRPFAAPFTTQLHVVLKRVFQQYWRTPSYLYSKVALCLSSNQMYAIFMLLVIFANVCSQIMPHYDAQRALYQSRESPSKTYSWQVFVLSNLLVEIPWNSLSALLIFVSWYYPIGLRHNALEVNEGPEREALMFLFILAFMNFAGTFTNMVLSAVGSAEAAGNLTNLLHSLSLIFCGILVSPDAMPGFWIFMYRVSPFTYFFSGVLSVGLGNSHISCSTEEYLHFSPPPSMNCSAYLEPYIEAFDGYLTSESMGSTTECVFCSGNDTNIFLETVSANYDDRWRNFGIFWVYIIFNMAAAPLLFWLTKVPKDKMSIGKKGKGPEVKSDNVSAE

SEQ ID NO: 11649 - protein, 179 aa, Saccharomyces cerevisiae
MKSFQKSYEFDYPWEKVTTANWMKYPNKISTHVIAVDVLRRELKEHGDVLLTERLITIRQNTPHWMSILVGNTNLAYVREVSTVDRRDRSLTMRSCNMTFPHILKCYETVRYVPHPKNPSNVTLFKQDAKFLSGVPTKTFSEKVENWGVKRFSDNAVKGKVGFDSILAMFNDIWKNANE

SEQ ID NO: 11650 - protein, 327 aa, Alkaliphilus metalliredigenes QYMF
MAVINLLQAVNQTLKQEMKRDKRVIVFGEDVGLEGGVFRATVDLQKEFGPDRCMDSPLSESGIVGAGIGLAINGLIPVVEMQFMGFSYPAFNQIISHMARMRNRSRGRYTVPMVIRMPYGGGIRALEHHSESTEALYAHIPGLKVVIPSTPYDAKGLLAAAIRDEDPVIFLEPKRIYRAFKQEVPDEEYILPIGKANIVKEGGDVTLISWGAMMRETLKAAELANEKGIHAEVIDLRTVAPIDQETVIESVKKTGRVVIVHEATKTLGIGAELISIINEKAFLYLEAPPARVTGFDMPFPLPRGEQHYIPSPDRILRKIEAVSNYLT

SEQ ID NO: 11651 - protein, 502 aa, Thermus thermophilus HB8
MVEPKIYKETVERLEALGFPFRLPLEVTHYIGGEFVRGENFFPVVYPATGEVIGTAPEGREKEVEQAVAAAKEAFKKWSKMPPSQRRPYLRRFAEKIREYKPVFEVLETLDVGRPIHENRLGYVDRMANNIEFFADFAVTHGSEAYPMENGYINYVLRFPVGVAALITPWNMPSMLATWKIGPTLAFGNTAVLKPAEFTPLGAWLLAKCAHEAGLPPGVFNVVHGFGPDSAGELLTKHPDVRLISFTGETTTGKIIMKNASDTLKRLSMELGGKAPNLIFESADLDRAVEVTMRASFFNQGEVCLAGSRLLVQRSVYEPFLERLVKAARSLKVGDPLDPETRMGALIAEEHLNKVMSYVEIARETATILTGGRRPELPHPFDKGYFLEPTVVVDVKPSDKVCQEEIFGPMVVVMPFDTEEEAIELANNTPYGLNAIVQTRDVGQAVRVSEALEVGTVWVNDWFVRDLRVPFGGAKQSGIGREGGHYGYEFYYETKNVCIANR

SEQ ID NO: 11652 - protein, 366 aa, Yarrowia lipolytica CLIB122
KRYIVHRVNMSVDLKPKTLKRKNFKKLSLNADAGVAPQATASPPPSQPFTLDKPTLQRAPSAGNLISQMASLELGVEFKIDIRAQDLRTIQELGAGNGGSVSRVEHIPTGAVMAKKVIHIEAKEAVRRQILRELHIMHECDSPYIVSFYGAFINESSGDVVMCMEFMDCGSLDRIYKKAGPLTEEIVGHITVAVVEGLTYLYNEHRIVHRDVKPSNILVNSHGQIKLCDFGVSGELINSIADTFVGTSTYMSPERIQGGNYTVKSDVWSLGISLLELLLGKFPFDMANGAVGPMGILDLLQRIVNEPPPTLPAEDTRFSPVCRRFVDRCLYKEAERPSPQQLINDAFIITSRAKQVDMKAWAMSVQ

SEQ ID NO: 11653 - protein, 416 aa, Prosthecochloris aestuarii DSM 271
MLDSRFFSYKDTVLSCEGVALDALAAEYSTPLFVVSRNALVEQYRAFEEAFSSLSHFTCYSVKANFNIHVIKALSDQGCGCDVNSGGELFRALKAGVDPQKIIMAGVGKSDQDIEYALQSGIFMLKAESLSELRHIEAVARRLGVTASVGVRINPNVTAETHPYITTGDSKEKFGIDEGSLDEMFDLFKSMKHVNFMCLDMHIGSQIFDTEFYHAATEKLLDVLDAARAKGFSIDYLDIGGGFPVTYEPQKPATPIEQFASVLIPVLKKTGTTIIFEPGRFIAANSGVMVTKVLYRKRNHIGKEFVIVDAGMTELIRPALYQSYHEIIGVKQQEATIVADVVGPVCESGDFFARGRTIDAVGEGEYLAILSAGAYGAVMSNNYNGRLRPAEVMVDNGRTSLIRKRDTFEQLIENEV

SEQ ID NO: 11654 - protein, 366 aa, Aspergillus nidulans FGSC A4
MTSQRPTSSSSSLLDIVANLASPKSLLFNAHHTNPPPSLPSQRAPTMDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 11655 - protein, 221 aa, Enterococcus faecalis V583
MKKAIAECLGTFILVFFGTGTAVLGNGMEGIGTTGIALAFGLTIVAAAYSIGTISGAHLNPAVSIGMWLNKRMTTMELIYYVVGQIVGGLIASFALLSILKGAGKSIENLGQNGVGELSVAGALTVEIILTFIFVLVVMTVTSAKKGNASLAGIVIGLTLTMIHLVGIPLTGTSVNPARSIAPAVFAGGSALSELWIFIVAPLIGGLLAALVAKFVLDTEE

SEQ ID NO: 11656 - protein, 179 aa, Alyssum lesbiacum
GFVNREALATTISSRKATFFSRSRSSLWIKGETSNNFINILDVYIDCDRDSIIYLGTPDGPTCHTGAETCYYTSVFDQLNDEEPIGNKLALTTLYSLESIISKRKEESTVPQEGKPSWTRRLLTDDTLLCSKIREEADELCRTLEDNEEVSNTASEMADVLYHSMVLLSKRDVEIEDVL

SEQ ID NO: 11657 - protein, 201 aa, Aspergillus awamori
MNPEYDYLFKLLLIGDSGVGKSCLLLRFADDTYTESYISTIGVDFKIRTIELDGKTMKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 11658 - protein, 1091 aa, Coprinopsis cinerea okayama7#130
MSLPKSGLKKVAEPVPLESLRSPEVPAFAVQDDKSSASDSEKLPERDSIASSLSGFNDIALDSDDSSESPSVATAKPIVQDQQNQSTTSSRPASPASLNGDANERPTSVFSIALDSPIGNPKSHKKTSSTTTIRSSFRANRSEDSDEEDVSRRRASARVSLDGQQMLQEEFARLQKEEMEHSASTDGTIDWDFWGAVISDYQSFAAERPQELAQAIARGIPPALRGMMWQHMAASKDPELEATYLKLLKETSAHEKAITRDLGRTFPHHTFFTDGQGIGQENLFNVLKAYSLYDPQVGYCQGLPFVVAILLLNMPDEEAFSLLVKLMYVYDLRGHFLPEMPKLQLRLFQFDRLVEELLPVLHVHFLRQGVKSTMYCSQWFLTMFSYRFPLDVVFRIYDSCLANGIEAIFGFSIQLLRKNEEQLLKLKFDEILAFLNKRLFEVYQITEGPEEEGTPKYRVDEFVQEAVSVNITPFMLDSFRHEYEDLMRETHKQKTLIEDLTTTNRQLSQQVKSLEETLAQLNAEHVELLNELVKQRLKGEEMEGELVRYKLLHTVLAVVRCSRIADAAIRGAIDYKVMMSKSYGSDEEVNRAWSECHTRSAKRVLKALLANGGVFIKMGQHMATLVVLPVEWTSTMRPLQDQCEPTSYEELEGLFKQDMGVEVNELFEDFDPNPVGVASLAQVHVARHKPTGRRVAVKLQHPHLAEFCDIDVEMVDVTLGWIKYWFPEFEFTWLGDEMRTNLPKEMDFVHEAENAERTKRDFAHVKTSLYIPEVIHAAKRVLIMEFIEGGRVDDLEYLARHNIDRNKVAVELSRIFSEMVFHNGWFHADPHPGNLLIRPSPPSSKSPYNFEIALLDHGLYFDLDDELRVNYSRLWLSLISAASPTVIAERKRLAQLVGNVGPDLYPIFEAALTGRAALEGSFEDGKDVSFKRGSSMIDTTSRAEIEAVRHAVANTDGLILSVFDVLRRVPRRILMVLKLNDLTRGLDRALATTHSNVRVFLVHAKYCLKASWVADQHQILSNVRTFGFTRSLCLWISGWWHYRTSYAAFAVYEALLDFQGWKVKKLAWLRGLWRQGFRGAHDAAAGLRIEA

SEQ ID NO: 11659 - protein, 202 aa, Salinibacter ruber DSM 13855
MSTPSFSPRTATVERTTAETDVSVALTLDGDGSYDVDTGVGFFDHMLSLFAKHGALDLEVRCDGDLEVDDHHTVEDVAIGLGRALDDALGDKAHIARYGHAYVPMDDALARAVVDLSGRSYCHLEASFERNQVGGLSTELVEHVWRSVADHARCNLHLTVLRGHNAHHKIEALFKAAARALRTAVRRRADHAEVASTKGTLA

SEQ ID NO: 11660 - protein, 316 aa, Petunia x hybrida
MEQENHNNNNCTNDKESACISSVLPGWFSEISPLWPGEAHSLKVEKILFQGKSDYQNVMVFQSSTYGKVLVLDGVIQLTERDECAYQEMITHLPLCSIPNPKKVLVIGGGDGGVLREVSRHSSIEQIDICEIDKMVVEVSKQFFPDVAVGYEDPRVNLHIGDGVAFLKAVPAGTYDAVIVDSSDPIGPAQELFEKPFFETVARALRPGGVVSTQAESIWLHMDIIENIVTNCRQIFKGSVNYAWTTVPTYPSGMIGFMLCSTEGLEVDFKNPVNLIENDEIHSKTLPPLKFYNFEIHKASFALPSFAKRVIESKGN

SEQ ID NO: 11661 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 11662 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLIKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 11663 - protein, 503 aa, Zea mays
  misc_feature (48)..(48): Xaa can be any naturally occurring amino acid
WTRRRRPCRRAATLPFSSLPSPSPCSSSRRPSGPRGGVPLHRSLAALXAAHGAGGQLAPLLSLRLGARRALVVSERGVAEECFTAHDAALAGRPRVLAGDRLGYGYTMLVWASHGDHWRALRRLLAAEIFSAARVAARAADRRSEVAALVTSLAALHLHCGGGAVSLRPRLFELVLGVMLRALTGERAHGGDVRTFQGIVEETFAVSGAPSVGDFFPALRWVDRLRGVDAALVRLQARRDAFVGGLVQDQRRRRRDAGDGRGRHAAEKQSIVDELLSLQETDPEYYTDTIIKGVVLMLLTAGTDTSALTTEWAMALLLTHPEAMRKARAEIETSVGTARLVEESDIANLPYLQCVVKETLRLRPVGPVIPAHEAMEDCTVGGFHVERGTMVLVNAWAIHQDPKLWDAPEEFRPERFLDAAGTVTAVTTPMLPFGLGRRRCPGEGLALRLISLTLAALVQCFEWDVGEGGVVDMTEGVGLTMPMAMPLAAVCRPREFVKGMLST

SEQ ID NO: 11664 - protein, 203 aa, Bacteroides fragilis YCH46
MDLDFDKMNGLVPAIIQDNDTRKVLMLGFMNKEAYEKTVETGKVTFFSRTKNRLWTKGEESGNFLNVVSIKEDCDKDTLLIQVNPVGPVCHTGTDTCWGEKNEEPVMFLKLLQDFIDRRHEEMPEKSYTTSLFQSGINKIAQKVGEEAVETVIEATNGTDDRLIYEGSDLIYHLIVLLTSKGYRIEDLARELQIRHSDSWTKH

SEQ ID NO: 11665 - protein, 535 aa, Rhodotorula sp. CBS 8446
MLALVCVGLFLYLLCKYRSHAIATSDRTDLAGPKGWPLMGVFKFPLPTLSVTYVVVDVTEKTLSGNLIFYATQSSTRGLEWGVRFVKTYGHAWTLSVPGLRLIDISTRPDWIEYVQKTNYHNYVKGSAFRNRLSDIIGNGIFVTDGRVWQFQRKVTSHIFTGRSFQDAICPAIAEELRSLNKLLDNYADTGETVDLQDVFYRFTFQAFGRFAFNLDLRNLEIDHKPVPFTTAFDQCQKPSLDASSTRSGAFASALPLPAVEYQTPPSCFRLCLRNDDKRAALLAKKDAKVPSDLLTMFMTARYDDSRPLSRVEIRDAIINLLLAGRDTTAQSLTWALYRLVDNPAHQRLVREEICGQLAGGTEPVTLENVKNLVQTQAAHLESLRLHPPVPRIVKQAVKDDALPNGGPLIKAGEFIRLSDWALGRNEEVWGADAKEWKPSRWIDDEGRPIQYSQWKAHFFNGGPRICLGKSLATLEGVAVIANLLHRYNIAFAPGWWENVEKTGRIAGDLEETPLYGPALTLPMKSPFWVTISRR

SEQ ID NO: 11666 - protein, 505 aa, Ostreococcus tauri
MDFEFGRALNKTTTTTARASAESAIDARLEGDDDESEDDAFYSWRVGGANDLKITHLRDVYRGDVPLVAQPSPFCTTTACPLSGPRTSVEFNSNFVSNSDRVLLNSVAFGSSADPTQTCSLWAETFDPNGCDYVPQWVVRAGPRSEVYFDSDEVHAAIVTCGGLCPGINDVIRSLVNTLEVGYGVKKISGIRYGFKGFFSGVEFMKLNKKTVRNIHTLGGSMLGSGRGGGDVQKIVESIIHHGINMVFVIGGNGTHAGANAISDECAKRGVKVSVVGVPKTIDNDILLLDKTFGFDTAVEEAQKAILAAATEAQSAYRGVGVVKLMGRQSGFITMFATLANGQVDCCLIPETTWAAHGPNGVINYVRNLLDTQGHAVVVLAEGAGQEFVTSTGVDAGGNPKLGDIGQWFCKQLKSELKCDIKYIDPTYMVRGCQANAHDSIMCTVLGQNAVHGAFAGFTGISVGTVSAHTAYLPIPRMIEHERLVDPDGRMWHRTLESTGQPDFF

SEQ ID NO: 11667 - protein, 175 aa, Triticum aestivum
MAAAGDAGEKKMITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDQATLFDLILAANYLNIKGLPDLTCQTVADMIKGKTPEEIRKTFNIKNDFTPEEEEEIRRENQWAFE

SEQ ID NO: 11668 - protein, 178 aa, Brassica napus
PRVLPRVRGRVGFGNNLDIENILLDGTLTVKISGYTIPLPSKVGAESNQVKTPRSNEDGEKEDVYQFGVILLQIITGKVVAAGSSEMGSLKLQLENGLRDEPSVLSSLADPSVRGSYAYESLRTTVEFAINCLCEDQSKRPSIEDVVWNLQYTIQVQQGWTNSGNHEATMKAIYERKH

SEQ ID NO: 11669 - protein, 127 aa, Brassica rapa subsp. pekinensis
LLDEVAEKSFDLIVLPGGNGAQRFASCEKLVNMLNKQAEANKPYGGICKSPVYVFEHNGLLKDKKATTHPRVSNELSDQSHIDHRVVVDGNVITSRAPGTAMEFSLAIVEKFYGREKALQLAKATLV

SEQ ID NO: 11670 - protein, 181 aa, Magnetospirillum magnetotacticum MS-1
MEARRHSALKDSVRSIPDYPKPGIIFRDITTLLSDPRSFRRAVDSLVHPFAGGRIDQVAGIEARGFILGGAVAHQLSSGFVPIRKKGKLPHKTVSTAYALEYGTDEIEIHVDAIRPGDRVILVDDLIATGGTATAAVNLLRQLGAEVVAACFVIDLPEIGGAQRLRDLGVTVRTLMEFEGH

SEQ ID NO: 11671 - protein, 320 aa, Legionella pneumophila subsp. pneumophila str. Philadelphia 1
MNFCTLGLAVIETEAQAVFELTQRIDEHFEKACELLLSCKGRIVVTGMGKSGHIANKLASTFSSTGSPAFFMHPGEASHGDLGMITRQDIVVAISNSGNTHEIVTLLPLLKRLEVPLITLTGNKQSTLAKSADVNLDVSIKQEACPLGLAPTTSTTVSLVMGDALAISLLQARGFSAEDFALSHPGGALGKKLLLKIDDLCHTGEQLPLANENATVSDALIEVTNKKLGMTCVVDNHGYLVGVYTDGDIRRTLTRQFNINTTLIKDVMTKNCRTISKGMLAAEALAIMQKYSITSLVVVENDNRPYAVLHLHDLLKAGVF

SEQ ID NO: 11672 - protein, 689 aa, Haloarcula marismortui ATCC 43049
MGTDQNRNPRAEQTVCPYCGVGCTIQYAGNGKATGTAGPVNTKGEICPKGGAAFDVVEHEDRLTEPLVRENGRFVTALWETALSRVTDQLGEIIDQHGPDAVEFFASSNCTNEENYVFQKIARMLGTNNVDNCARLCHSSTVAAMSERLGAGAMTNTLDDLAETDCLLVTGANPAEQHPVIFRSYFLPAIRNGATLIHIDPRETDTTEAADIHLDVRPGYDIQLLNSMAKVVLDEGLVDESFVEERTTGYADLTAHLDDVDVGSGADVAGVDPETVREAARAYAEADSAAIVTGMGMSQHTCGTDNVHALLNLALLTGNVGRPGTGVNPLRGQNNVQGAGDVGALPSVLPGYEPVTDADARQRLADEWGVEPPSEPGLTETTATHQFGDSVKAAVVFGENPAVTEPNASSVRAGFDDLDFCVVIDLFETATVDHADVVLPGSSWAEKAGTVTNTDRRVMRMRPNADLPGNARRDLDILTGLGQRLVGQSDAFDYDGPEAVFEELTRVNPLYAGMSYDGIGDSYQRWPFPADADSGTDVLHTETFASGQQTAPLRPVSPTPPADAVSGEQLVLTTGRALQHFNSGALTRRSETLMRMRGEDVLEIHPDDAAARGIEDGDTVIVENDRGSVTVSAAVTAAIRPGVVFCTFHYLDPLANALTGDALDPVAEIPEYKHSAVQVQKSSASTDDN

SEQ ID NO: 11673 - protein, 154 aa, Prosthecochloris aestuarii DSM 271
MKKDSHHQSLKYHEEIPPEHDDRLISFLHRVIRFAVKILALLMVLVIIWGIGDVVHVLYIRLNQPPFLLLNINDLLETFGAFLAVLIAIEIFINIRLYLGTNIIPVKLVVATALMAISRKVIILDLDKLSADYLVGIAAVVLGLGLSYWVITKE

SEQ ID NO: 11674 - protein, 531 aa, Candida glabrata CBS 138
MEQVTIGVISLDSSPTENYTLNTAETRQSFQLSGKSEVNTIPGEKYEELKMKYIRQHTKAVVLCCLISFGGMILGWDIGTVGGVSIMPSFNNAFGDQTTIVSSAKELSNMKRGLYISIFNIGCALGGIMFSRLSNTVGRRVGILTAIAKYTLVLTVQLFSNGNFILLLASRFVLGVTVGAISVLVPMFVSESAPIKIRGALVVVYQLAITLGILFGNILNYMTNKHLSMVDPMNNMAWKIPMLFGYLWAAIVAVGACITPESVHFLAKIRNDYESAKISYSIMNNISVFDHETIDYVNNLLVKQDVYNENDLRNHKFEFLYGKPKYGKRLLIGIMVMAFQQLSGINYFFYYGTSLFKSVGIKDTYATAIILSSVNFISTFAGIYLVESLGRRSTLIYGSFGMFICMIFYASFGTLSLRKDLLSFVLIIVTCLFISIFAITIGPVSFVVVAELFPTRTRSVSMSICSSFNWLVNFAIALATPVIINRIGFLYGFFFAGCLLLATGFEAFFVPETKNKTEEEIDYMFQNNLKS

SEQ ID NO: 11675 - protein, 355 aa, Arabidopsis thaliana
MSEFDKHVQNHIKNEKPFNSIKPSEIDSTLSLSDSLLLKIIEKLPESQSNDVSLVCKRWLNLQGQRLRSLKLLDFDFLLSERLTTRFPNLTHVDLVNACMNPRVNSGILFCHKSISFHLSSDSSNWEFLEENLLHSDVIDRGLRILSRESFDLLNLKVINASELGLLSLAGDCSDLQELELHKCNDNLLHGIAACKNLKGLRLVGSVDGLYSSSVSDIGLTFLAQGCRSLVKLELSGCEGSFDGIKAIGQCCEVLEELSICDHRMDDGWIAALSYFESLKILRISSCRKIDASPGPEKLLRSCPAMESLQLKRCCLNDKEGIKALFKVCDGATEVNIQDCWGLSDDCFSLAKAFR

SEQ ID NO: 11676 - protein, 129 aa, Alyssum lesbiacum
FDVHVRATGDTHIDDHHTNEDVALAIGTALLKALGERKGINRFGDFTAPLDEALIHVSLDLSGRPYLGYNLEIPTQRVGNYDTQLVEHFFQSLVNTSGMTLHIRQLAGKNSHHIMEATFKAFARALRQA

SEQ ID NO: 11677 - protein, 148 aa, Arabidopsis thaliana
MAFRITSQLRPVGNQFGGSRRFATTVADGAKQTYNKFSIMGEFAPVAIIGGFVGLAVLMAGHSLKQQLMHAPAISTRKNRRAAVAEVDDPENCVSSADKFINKSWLRKVGQIQDKSKAILSDPTRPNPFTTPRNAETLNSVGVAPKGI

SEQ ID NO: 11678 - protein, 375 aa, Pneumocystis carinii
MEDEIAALVIDNGSGMCKAGFAGDDAPRAVFPSIVGRPRHQGIMVGMGQKDSYVGDEAQSKRGILTLKYPIEHGIVSNWDDMEKIWHHTFYNELRVAPEEHPALLTEAPLNPKSNREKMTQIMFETFNTPAFYVAIQAVLSLYASGRTTGIVLDSGDGVTHTVPIYEGYALPHAILRLNLAGRDLTDYLMKILTERGYNYTTTAEREIVRDIKERLCYVALDFEQEIHTASSSSSLEKSYELPDGQVITIGNERFRAPEALFQPSLVGMETCGIHETTFNSIMKCDVDIRKDLYSNIVMSGGTTMYPGIADRMQKEITALAPSSMKIKIVAPPERKYSVWIGGSILASLSTFQQMWISKQEYDENGPSIVYRKCF

SEQ ID NO: 11679 - protein, 455 aa, Prochlorococcus marinus str. MIT 9301
MSHEIFMPALSSTMTEGKIVEWLKNPGDKVERGESVLVVESDKADMDVESFQDGYLAAVLMPAGSTAPVGETIGLIVENEDEIASVQEQNKGNQPEVSSSDQLELVSNKTEEKPVVQSEIVEKQEKEVVLMNEKAASSFNSDQINAATSNVSSRVIASPRAKKLASQMGVDLAKVHGSGPHGRIQADDILKANGQPVSIPWIGEGGSPASIPGANLGVESKPETSGNSFGNPGEIVQFNTLQKAVNKNMESSLDVPCFRVGYSINTDKLDNFYKKVKQNGVTMTALLVKAVAKTLKKHPQVNSSFSENGISYPENINIAVAVAMEDGGLITPVLKEPCNTDLFELSREWKDLVKRSRSKQLEPDEYSTGTFTLSNLGMFGVDRFDAILPPGTGAILAIASSKPTVVANSDGSISVKKIMQVNLTADHRVIYGADGASFLKDLASLIEDEPETLVS

SEQ ID NO: 11680 - protein, 259 aa, Brassica napus
MELSSAIYSQSSAAQILRPKLCFTVSIPQRASIVSSSSSRPRYLRMETQSQPRQSISCASSPSNNVSPATSNESDRVGEVKRVTKETNVSVKINLDGTGLADSSTGIPFLDHMLDQLASHGLFDVHVRATGDVHIDDHHTNEDIALAIGTALLKALGERKGINRFGDFTAPLDEALIHVSLDLSGRPYLGYNLEIPTQRVGNYDTQLVEHFFQSLVNTSGMTLHIRQLAGRNSHHIIEATFKAFARALKTATENDPRRG

SEQ ID NO: 11681 - protein, 115 aa, Triticum aestivum
QGLKSTACLPVSRRSNGASLGSVSNGGRIRCMHVWPIEGIKKYETLSYLPPVSTEALLKAVDYLIRSKWEHSLEISRVGFILREHNASSGYYDGRYWTMWKLTMLGCTDATQVIN

SEQ ID NO: 11682 - protein, 362 aa, Xylella fastidiosa 9a5c
MSISFDIARSLSTTSDEALSMILQAPGFGVHFTDHMIAIAWDKDNGWHDAQVRAYGPLLLDPAAAVLHYGQEIFEGIKAYRHADGSIWTFRPEANARRLQRSAKRLVLPELPVELFTESLRQLIAVDARWVPSAPEASLYFRPFMIATEAYLGVRAAQHAAYYLIASPAGPYFAKGVAPVSIWLSTDCARAALGGTGAVKCGGNYAASLLPQQVAQAQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTYLKE

SEQ ID NO: 11683 - protein, 431 aa, Haloarcula marismortui ATCC 43049
MGPELSSASSSDNSSTPSEPESALETARLQLHRAADHLDIDPNIVERLNHPQNVHEVTVPIERDDGTVEVFTGYRAQHDSVRGPYKGGLRYHPDVTRDECVGLGIWMTWKCAVMDLPFGGAKGGIAVNPKTLSRDEKERLTRRFAQELRAVIGPNRDIPAPDMGTDPQTMAWLMDAYSMQEGETIPGVVTGKPPIVGGSEGREDAPGRSVAIITQQVCEYYDQPLSETTVAVQGYGSVGANAARLLDEQGATVVAISDVNGAMYDPAGIDTATVPSHDEEPEAVTEYADTVISNDELLTLDVDVLIPAALGNVITEANADDIAAEYVVEGANGPTTSTADSILADRDVVVIPDILANAGGVTVSYFEWLQDINRRSWSLERVNDELDEEMRAAWDAVRTEFENRDITWRDAAYIVALSRIAEAHEARGLWP

SEQ ID NO: 11684 - protein, 507 aa, Streptomyces coelicolor A3(2)
MTRYAAPGTEGAIVSYQSRYDHFIGGEYVPPARGQYFENPSPVNGLPFTEIARGTADDVERALDAAHEAAPGWGRTSVTERSDILLKIADRMEANLERLAVAESWENGKPVRETLAADIPLAIDHFRYFAGAVRAQEGSLGEIDDDTVAYHFHEPLGVVAQIIPWNFPILMATWKLAPALAAGNAVVLKPAEQTPASIHYWLSLVADLLPPGVLNVVNGFGVEAGKPLASSPRVAKVAFTGETTTGRLIMQYASENIKPVTLELGGKSPNIFFEDVWARDDDFRDKALEGFTMFALNQGEVCTCPSRALVQRGVYAEFMEAAVARTELIKPGHPLDTDTMIGAQASNDQLEKILSYLDIGRQEGAKVLTGGERIEHDGELKGGYYVQPTIFEGHNRMRIFQEEIFGPVVSVTSFDDFDDAVKTANDTLYGLGAGVWTRDMNTAYRAGRAIQAGRVWTNCYHAYPAHAAFGGYKQSGIGRENHKMMLEHYQQTKNILCSYSPKKLGFF

SEQ ID NO: 11685 - protein, 402 aa, Haloarcula marismortui ATCC 43049
MSITKRLKAVGPGAMVAAAFIGPGTVTTASVTGAEFGYALLWTMVFSIVATIVLQEMSARLGLVSGEGLGEALRERFDNQIVEYVSIFLVVGAIGVGTAAYEAGNILGGAAGLATITGIDSTVWGVVMGLVAGLLLYTGRYKLIERALIGLVAVMAFSFVASAILIGPDPGAIAMGFVPGIPSGSLYLITGLIGTTIVGYNLFLHASNVQERWSGPDDIGHSRIDTVLSIVAGGVITITIMVTAAAAFEPGTQISDIGRMAEQLRPIAGPYAELFFSIGIFAAGFTSATTAPLAGAWATTGALGWDSDMQSTQFRAVWGTILSVGVLSVLLGGSPVQIIVFAQVVNGILLPIVAVFLIYAMNQRDLLGEYTNGSIANALGAIVTLIVVWLGVRTLLSVAGVL

SEQ ID NO: 11686 - protein, 151 aa, Yarrowia lipolytica CLIB122
MAFMQRSIFALRAATPAMRAPAFRIAPSMRRFISTETKDAIETAIGTAPVVLFMKGTPEFPQCGFSRATIQVLGHQGVDPQKFAAFNVLEDEELREGIKEFSQWPTIPQLYINKEFIGGCDIVMSMSQSGELAEMLQQQDLLAPEEEEHME

SEQ ID NO: 11687 - protein, 139 aa, Frankia sp. EAN1pec
MASTVADVMTRNPATVGMDQPIAEAARRMKTVNAGDVIVLDNTGRVAGIVTDRDITLRVVAEGRDPERTATREVCTQTGLITIAPDTTTDTAVQLIRERHIRRLPVVDKGRPVGVISLGDLARALDPSSTLAEVSAAQR

SEQ ID NO: 11688 - protein, 127 aa, Triticum aestivum
  misc_feature (85)..(85): Xaa can be any naturally occurring amino acid
  misc_feature (92)..(92): Xaa can be any naturally occurring amino acid
MSGGNPAGVDNTFRRKFDKEEYLERARQRERDEKDEARRGKDRGPPVQRQPLKHRDYEVDLESRLGKTQVVTPIAPLSQQAGYYXSVCECVXVKISATYLDHLNGQKPQKALGMSYSCLKGRPLKRV

SEQ ID NO: 11689 - protein, 220 aa, Bacillus licheniformis ATCC 14580
MIKAVIFDFDGLILDTETHEYEVLQEIFEEHGSELPMSVWGNVIGTAAGFQPFSYLEEQLQKKLDHEQLTKLRQERFTKRMENEKARPGVEAYLSAAKELGLKIGLASSSDYKWVSQHLKQIGLYDDFECIRTADDVEEVKPNPELYLKAAECLGVKPEECIAFEDSVNGSIAAKRAGMKCVIVPNKVTKSLLFEHYDHRLESMAEMELEQLIEKISDPS

SEQ ID NO: 11690 - protein, 567 aa, Oryza sativa (japonica cultivar-group)
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLARRAFRALKGIIRLQALIRGHLVRRQAVATLRATWLIVKFQALVRGRNVRLSTNTIQVNWKLVQQQSGSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNIAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPTVETMPLQDIHNEENALVNDMEQRSKEEPLSTESLKSSKRRSSFSTKTEYPENGSKNSPAVPSYMAATQSAKAKLRGQNSPRLSSDSAEKNGFTRRHSLPSSNGKLNSHSPRTQRPTHAGGKEGVKADKSMLSSRDASGKL

SEQ ID NO: 11691 - protein, 531 aa, Coccidioides immitis RS
MLEELVTAVSPGQAVLIAFGLFATFLFILDLKIDWRIQKLGPQAPRVRTYLPLGADFIYRAMKAAGKQKDLEFWTKMTEVPKYTGPGRLSTFEVKFSCYSRSLFTIDPDNIKAVLTGQFADYGKGRRFHEEWRDFLGDSIFATDGELWSKSRQLIRPMFSRDRIVDTEIFEKHIHKLIPLLGGGANQDGSKVVDVGPLFFRFTLDAATDYLLGQSVDSLDNPKTTFAESFQYVLHRQSVIFRSGPLSPLLSRKLFHENLKKMDDFMQPFIEQVRALTPEELDHKLSKKDTFLHALARFTRDPTVLRDQLVAILLAGRDTTAATLSFCIFELSRHPAVVQRLRNEIETVCGNRKPTYSELKEMKYLNAVLNETMRLYPVVPFNVRHALVDTTLPRGGGSDGQSTIGVPADTRIVYSTMAMQRRRDLYPPPPVPGEKTLQPYFDPLLFHPERWLSGWQPKPWHFIPFNGGPRICLGQQFATIEMGYTVTRILQHYPEIIGVGAPKPGTDPKFKFDVTLSPGQRLDCVFVKKEE

SEQ ID NO: 11692 - protein, 133 aa, Brassica napus
MAAPLRRSLPSLGRALLTPAPARMLSAEASDALVEIKPGEIGMVSGIPEEHLRRKVLIYSPARTASQQGSGKVGRWKINFLSTQKWENPLMGWTSTGDPYANVGEAGLTFNSAESAKAFAEKHGWNYVVRKRH

SEQ ID NO: 11693 - protein, 397 aa, Hordeum vulgare subsp. vulgare
MAVLSSAKRVLPCASAGGVSGGLRALLGTDGGGRSLLPSRWKSSLPQLDPVDRSDEESGGDIDWDNLGFGLTPTDYMYVMRCSREEGGFSRGELARYGNIELSPSSGVLNYGQGLFEGLKAYRRSDGAGYMLFRPEENARRMQHGAGRMCMPSPSVEQFVHAVKQTVLANRRWVPPQGKGALYIRPLLIGSGAILGLAPAPEYTFMIYAAPVGTYFKEGMAAINLLVEEEIHRAMPGGTGGVKTISNYAPVLKPQMDAKSKGFADVLYLDAVHKRYVEEASSCNLFVVKGGAVATPATTAGTILPGVTRRSIIELARDDGYQVEERLVSIDDLVGADEVFCTGTAVGVTPVSTITYQGTRHEFRTGEDTLSRKLYTTLTSIQMGLAEDKKGWTVAID

SEQ ID NO: 11694 - protein, 496 aa, Burkholderia vietnamiensis G4
MNKLTLADWQDKAASLRIEGRAFIDGASRDAHGGKTFDCVSPIDGRVLAKVADCGEADVNAAVAAARRAFDAGVWAGLNPRARKAVLLRWAALMRTHLDELALLETLDAGKPIGDTTTVDVPGAAYCVEWFAEAIDKVGGEVAPADHHLVGLVTREPVGVVAAVVPWNFPILMAAWKFGPALAAGNSVVLKPSEKSPLTAIRVAQLAYEAGIPAGVFNVVPGAGEPGKLLALHRDVDCIAFTGSTAVGKLIMQYAAQSNLKRAWLELGGKSPNIVLPDCPDLERAAQAAAGAIFYNMGEMCTAGSRLLVHRDIKDAFIAKLVAAARAYVPGNPLDPSVSMGAIVDGIQLERVLGYIEAGRSEGTLVTGGARVRQETGGFYVEPTVFEVKPDAKIAREEIFGPVLSVIVFDDVDEAVRIANDTEYGLAAAVWTSDLTTAHDVSRRLRAGTVWVNCYDEGGDMNFPFGGYKQSGNGRDKSLHALEKYTELKSTLIRLR

SEQ ID NO: 11695 - protein, 965 aa, Aspergillus oryzae
MSPHDYADRRSESVTDAVTAMNLEPDRATDTPALNGGSTSLKDDTNGVSRSPSAQNMDVAVKSRSSSQTPVKKEEETSNTADMEEKVGGDITVKQEPGQPPKLTRSSSQKVVARPPQLFSHLRDSTAEARVSFELMDSCTYANKYMGYTEHAMECDCAEEWVSSVSGNILSMPISLYALEPALSKNLACGEDSDCINRATKIECVGDCGCGPDCQNQRFQRKEYAQVAVIKTEKKGFGLRAEADLRPHQFIYEYVGEVINEGQFRRRMRQYDEEGIKHFYFMSLSKGEFVDATKRGNLGRFCNHSCNPNCYVDKWVVGEKLRMGIFAERDIQAGEELVFNYNVDRYGADPQPCYCGEPNCTGFIGGRTQTERATKLSNATIEALGIEDADGWDTAVAKRPRKKKMGEDDEEYVDSVQPKSLEENGVTKVMAALMQCQEKWIAVKLLGRIQRCDDERVRNRVVKMHGYQILNSQLTMWKDDFNVVLQILDILDKFPRLTRNKIIDSKIEVTIQPLTSCGDERVEKRAATLLQVWSTLEVGYRIPRMKRDPNATAQAVNQFERRETIRDQRRRSKSRSRSRSRSIEAPRGPAAQTRGVYGQRNPHHHGPRSFRRQFNPLPTGWFAAESNGRTYYYSARGDTTWTRPTKPAPQPPPPPKESRDKALQDIIDGIMNAKENTPKEKSGTPGTPQVSKPIPVKKEGQEKWRGYSEDKQKKVYENTLFPHIKYVVDKFKHKLPKEDLKRYAKDVAKKLVNSDFKNNRVEDPTKISEKQQKKVKKYCKEFFDKAVLKHRAYEQRKYEKQAKGMDSKVETPQAPSDDEALDVKMSDDEEDKADEKDTPMTAEETQGGTKRKREGGIAEDSNLGEYISSSKRQRSSTPPPLPPISPGDDPQNMDNAKKILRDDIDSRSENNEFTPPPPPPPPPDDEMPSESPETDHAIDQSPSRAEYITDMNKLKSSQPEIEGKV

SEQ ID NO: 11696 - protein, 477 aa, Burkholderia vietnamiensis G4
MTYRNESAWVQPAAPATAPRTTQARTTAEYRALDAAHHIHPFSDMGALNRAGSRVIVKADGVYLWDSDGNKIIDGMAGLWCVNVGYGRKELADAAYRQLQELPFYNTFFKTTHPPVIELSAMLAEVTPAGFNHFFYCNSGSEGNDTVLRLVYQYWRVQGKPQKKYVISRHNGYHGSTIAGATLGGMDYMHEQMPSKVEHIVHIDQPYFFGEAQAGETPEAFGLARAQQLEAKILELGAENVAAFIGEPFQGAGGVIFPPSTYWPEIQRICRKYDILLVADEVIGGFGRTGEWFAHQHFGFEPDLITMAKGLTSGYVPMGAVGIHERVARPIIDNGEFNHGLTYSGHPVAAAVAVANLKLLRDEGIVERVKRDTGPYFQALMRDTFAQHPIVGEVHGQGMVASLQLAQAPAERRRFANGGEVGTICRDFCFNGNLVMRATGDRMLLSPPLVISRQEIDELVSKAKKAVDATAQQLGLS

SEQ ID NO: 11697 - protein, 375 aa, Oryza sativa
MTDAELRVEALSLSGASAIPPEYVRPEEERADLGDALELARAASDDDATARIPVVDISAFDNDGDGRHACVEAVRAAAEEWGVMHIAGHGLPGDVLGRLRAAGEAFFALPIAEKEAYANDPAAGRLQGYGSKLAANASGKREWEDYLFHLVHPDHLADHSLWPANPPEYVPVSRDFGGRVRTLASKLLAILSLGLGLPEETLERRLRGHELAGVDDDLLLQLKINYYPRCPRPDLAVGVEAHTDVSALSFILHNGVPGLQVHHAGSWVTARPEPGTIVVHVGDALEILTNGRYTSVLHRGLVSRDAVRLSWVVFCEPPPESVLLQPVQELLADGAGKPLFAPRTFKQHVQRKLFKKLKDQQDNNAAAASNGMITK

SEQ ID NO: 11698 - protein, 178 aa, Erythrobacter sp. NAP1
MTPEALKALVRTVPDFPEPGIQFRDITTLIGHAEGLSASVEHLAAKACAGGAQKIAGMEARGFIFGAAVAAALGIGFVPIRKPGKLPIDTIGIDYALEYGTDRLEMDPQAVAAGERVVIVDDLIATGGTALAAAELIRMAGAVVEQALFVIDLPDLGGAEKLRGAKVAVEALMHFEGE

SEQ ID NO: 11699 - protein, 223 aa, Anabaena variabilis ATCC 29413
MGQNQFELVIFDCDGVLVDSEPIINRIFAETLTEAGFPITYAEVTQKFIGKSLKTCLEIIETSYNKPLPKNFMELCKEREMAPLEKEIKPVPGISEVLEQITLPKCVASNNSHRHIQMVLKLTGLLDKFDGKIYSANDVLRPKPFPDVYLYAAEQMNTNPEYCAVIEDSVPGVQAASAAGMTVFGYAYHSDVSQQAVVRRCTALFEAGAKIVFNDMRQLSQLL

SEQ ID NO: 11700 - protein, 440 aa, Coccidioides immitis RS
MNSVLSMCGPTRPSDLFETWVRNGLIPSSPSVDRSARCTMPSDLPAASPPASPYCVPRTKLLGYPPSARPSQSPGGNHRWKAPVAAAGRTPNNGQCYVILLSLSVLQLISRPAFAGKQLNSATMDRSNKPAAIPVTSSLPQPSVTVQDGRVEASLASGESVTVHLFGATVTSWKLANGHELLFLSEKAHLDGSKPIRGGIPLVFPVFGPPPQNHATSALPQHGFVRNSSWELLGKSTSESESGASVKLDFGLSNSMLSDKFKGDWPYEFGLVYSVTLSKRSLETSLRVQNEGLKSFEFQTLLHSYFKVEDISKIRVQNLQSKTYVDKVRNAEIFTESSPALAVEGEVDRVYQSLDPKVPIVIASESDKPIFSITRESLNDVVVWNPWIEKAKGMADFAPDEAYKNMICVEAGSVVGWQTLEPGDTWEDFKSLFLQGVYSS

SEQ ID NO: 11701 - protein, 299 aa, Triticum aestivum
  misc_feature (116)..(116): Xaa can be any naturally occurring amino acid
  misc_feature (122)..(122): Xaa can be any naturally occurring amino acid
GAATNEASKLRAALESWGLFLLSNHGVETTMMDGMMIASREFFKRPLEDKKRYTNLIGGEQFQFEGYGNDQVRSPDQILDWSDRLYLKVEPEDERRIALWPTHPENFRNNLHNFTXKMWGSXRTISLRAMAKLLKLDDDNYFVDQLGEKAETNVRCSYYPECPRPELVFGLKPHSDGTVLTLLMVDDSVGGLQVLRDGVWWDVPIVPHTLLVIIGDQTEIMSNGFFKSPVHRVLTNAKKERLSVAVDYSVDHEREIEPSAQLIDEKRPALYMKVKVKDYIAGLYEHFSQGTMVIDTLQI

SEQ ID NO: 11702 - protein, 861 aa, Solanum tuberosum
MIGQITSGLFGGHDDSKKVKGTVVMMNKNVLDFTDLAGSLTGKIFDVLGQKVSFQLISSVQGDPTNGLQGKHSNPAYLENSLFTLTPLTAGSETAFGVTFDWNEEFGVPGAFIIKNMHINEFFLKSLTLEDVPNHGKVHFVCNSWVYPSLNYKSDRIFFANQPYLPSETPELLRKYRENELLTLRGDGTGKREAWDRIYDYDIYNDLGNPDQGKENVRTTLGGSAEYPYPRRGRTGRPPTRTDPKSESRIPLILSLDIYVPRDERFGHLKMSDFLTYALKSIVQFILPELHALFDGTPNEFDSFEDVLRLYEGRDQLPQGPLFKALTAAIPLEMIRELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDVIIPYLRRINTTITKTYASRTLLFLQDNGSLKPLAIELSLPHPDGDQFGVTSKVYTPSDQGVESSIWQLAKAYVAVNDTGVHQLISHWLNTHAVIEPFVIATNRQLSVLHPIHKLLYPHFRDTMNINASARQILVNAGGVLESTVFQSKFAMEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMKTPQELIDSCTTIIWIASALHAAVNFGQYPYAGYLPNRPTVSRRFMPEPGTPDYEELKRNPDKAFLKTITAQLQTLLGVSLVEILSRHTTDEIYLGQRESPEWTKDKEPLAAFDRFGKKLTDIEKQIIQRNGDNILTNRSGPVNAPYTLLFPTSEGGLTGKGIPNSVSI

SEQ ID NO: 11703 - protein, 389 aa, Glycine max
MHSQNVVEMEGKTEIRMTSAAAFVEGGIQESCDDACSICLEEFCASDPSTVTTCKHEFHLQCILEWCQRSSQCPICWQPISLKDPTSQELFEAVEQERSWRATPSRNAAIFHHPAFGDFELQHLRMNANDADFEERIIQHLAAAATMRRVNQLGRREGQQTRSSPHVHPHFLVFSNQPIAPSSGLDPVSRGENDPTAIPNRSPSAPITSDGNEASQQILHLQTQSSSSASGSPVMATNRQGIYSNDRGSTARSSPVVQDRAESSELQSFSDSLRSRLNAVSMRYKESISKGTRGWKERLFSHSSSMSELGSETRRREMKAGIASVSRLMESLETSENNRAVGTSLSNQNHIEDSSMGGVSNQNNVEASGEKSSHDDNTPAACSASSHLN

SEQ ID NO: 11704 - protein, 474 aa, Aspergillus nidulans FGSC A4
MASTLRLSTSALRSSTLAGKPVVQSVAFNGLRCYSTGKTKSLKETFADKLPGELEKVKKLRKEHGNKVIGELTLDQAYGGARGVKCLVWEGSVLDSEEGIRFRGLTIPECQKLLPKAPGGEEPLPEGLFWLLLTGEVPSEQQVRDLSAEWAARSDLPKFIEELIDRCPSTLHPMAQFSLAVTALEHESAFAKAYAKGINKKEYWHYTFEDSMDLIAKLPTIAAKIYRNVFKDGKVAPIQKDKDYSYNLANQLGFADNKDFVELMRLYLTIHSDHEGGNVSAHTTHLVGSALSSPMLSLAAGLNGLAGPLHGLANQEVLNWLTEMKKVVGNDLSDQSIKDYLWSTLNAGRVVPGYGHAVLRKTDPRYTSQREFALRKLPDDPMFKLVSQVYKIAPGVLTEHGKTKNPYPNVDAHSGVLLQYYGLTEANYYTVLFGVSRALGVLPQLIIDRAFGAPIERPKSFSTEAYAKLVGAKL

SEQ ID NO: 11705 - protein, 216 aa, Coccidioides immitis RS
MSTKPGVSSSGITTNTATGERHVPSSIRADGSVRREIRIRPGYRPPEDVELYKNKAAESWKSRSKAGIPGTEGLKDGDSKPSTAASAKNAKRREAKKKAKSTNEAMSNGAEDHKANGGIMAQGNWRNGPPGGQEAEAPVDPEVEREKKARNLKKKLKQARELRDKKDNGENLLPEQFEKVIRINELIRQLDALGFDSEGEKKVKGPTTTKEQGDAV

SEQ ID NO: 11706 - protein, 450 aa, Campylobacter upsaliensis RM3195
MRAVVKESKSLDLRAVNLGLDELILMENAGIALAKLIKKECKKIQNKKVLFLLGGGNNAADGLVALRHLKKAKAYKLGFKENAMFLKQEQILKNYGFSFLNKEPKIKRYGVIVDCIFGSGFKGNLDAKTANFLKKINQHKALKIACDIPTALGSEVCFKADITLSMGAFKEFLLEDFAKEFVGRLKLAKLGISHKLFSGKTRTHLLEKKDLKLIKRKAASHKGAYGHIAIVGNGGAANLAGLGALNFGAGLVSLVREKPNSALLMEKENLDFNFNATALGMGLLNLEFLKDENLSKMPLVLDANVFLSEAILPFLQREDVVLTPHPKEFTRLFKMCFKEDLSVEELQKRRFFYVEKFLQNYPCVLILKGANPIIGQKNRHYVVNLGTANLAKGGSGDVLAGMIAALLGAGFSPLKAAKNAVLAHALVSKAYQFNANSFDALKLIKGLKCL

SEQ ID NO: 11707 - protein, 127 aa, Quercus suber
ASRKAACGITKKPKDLIENIDAADVDNELAVAEYVDEMYKFYKETEDLSQVHDYMIKQTDINPKMRSILVDWLIEVHRKFELTPETLYLTINIVDRFLSIMAVSRRELQLVGISSMLIASKYEEIWP

SEQ ID NO: 11708 - protein, 333 aa, Yersinia pestis KIM
MSPVSRSYNLIHYRYAPDAPEGKKRMTKKADYIWFNGEMVPWAEAKVHVMSHALHYGTSVFEGVRCYESHKGPVVFRHREHMQRLHDSAKIYRMPVSQSVDELMEACRATLRKNNLTSAYIRPLVFIGDVGMGVNPPEGYNTDVIIAAFPWGAYLGAEALEQGIDAMVSSWNRVAPNTIPTAAKAGGNYLSSLLVGSEARRHGYQEGIALDVHGYLSEGAGENLFEVKDGILFTPPFTSSALPGITRDAIIKLAKDMGLEVREQVLSRESLYLADEVFMSGTAAEITPVRSVDGIQVGIGKRGPVTAKIQQAFFGLFTGETEDKWGWLDQVNP

SEQ ID NO: 11709 - protein, 451 aa, Burkholderia vietnamiensis G4
MDFDYDLFVIGAGSGGVRLARMSASYGARVAIAEQEQIGGTCVLRGCIPKKLLVYASHYPHELEDAQGFGWRFDAGTHDWPALIAAKDREINRLSDIYINLLRQSGVDMHAGRATLVDAHTVAVGERTFRARHIAIATGSRPSLPPRPGIEHAITSREALSLPALPGRIAVVGGGYIAVEFAGIFNGFGSRVDLFYRGDRILRGFDDDVRQFLTDEMTKQGVAIHAHAVVESIARADDGTLSVQVGDATHGPYDAVLYATGRVPNVDGLGLERAGVLLDARGAIAVDAYSATSVPSIHALGDVTSRPQLTPVATRDGSLLARTLFGGARVATDHEWVPSAVFSQPEVATVGFTEAHARGVYGDLDIYRTSFRALRHTLSGRDERTLMKLVVARDSQRVVGAHMVGRDAGEIIQGIAIAIRAGATKAQFDDTIGIHPTAAEEFVTMRQKVAD

SEQ ID NO: 11710 - protein, 861 aa, Solanum tuberosum
MIGQITSGLFGGHDDSKKVKGTVVMMNKNVLDFTDLASSLTGKIFDVLGQKVSFQLISSVQGDPTNGLQGKHSNPAYLENSLFTLTPLTAGSETAFGVTFDWNEEFGVPGAFIIKNMHITEFFLKSLTLEDVPNHGKVHFVCNSWVYPSLNYKSDRIFFANQPYLPSETPELLRKYRENELLTLRGDGTGKREAWDRIYDYDIYNDLGNPDQGKENVRTTLGGSAEYPYPRRGRTGRPPTRTDPKVKSRIPLILSLDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDVIIPYLRRINTTITKTYASRTLLFLQDNGSLKPLAIELSLPHPDGDQFGVTSKVYTPTDQGVESSIWQLAKAYVAVNDTGVHQLISHWLNTHAVIEPFVIATNRQLSVLHPIHKLLYPHFRDTMNINASARQILVNAGGVLESTVFQSKFAMEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMKTPQELIDSCTTIIWIASALHAAVNFGQYPYAGYLPNRPTVSRRFMPEPGTPEYEELKRNPDKAFLKTITAQLQTLLGVSLVEILSRHTTDEIYLGQRESPEWTKDKEPLAAFDRFGKKLTDIEKQIIQRNGDNILTNRSGPVNAPYTLLFPTSEGGLTGKGIPNSVSI

SEQ ID NO: 11711 - protein, 357 aa, Bacillus clausii KSM-K16
MEPLELGVLYGDGIGYEIVSASVKIVSAAAAKSGLAIDWHVLPMGLDAIKQTGSSMPAETVQALDKLDGWLMGPHDSQSYPKQLQNVRNPSGELRHHFDLYANIRPAKSEPYVKGVVERADLVIYRENTEGFYVDRNMYKGIGEWMVTADVAVTAGVFTRKAIERIAHAAFRAARERRKKVSIVHKANVISLGSGLFLNVCKEVGHHYPDVSVDDYHIDAMCAHLVRRAAEFDVIVAENMFGDILSDLTGELVGSLGLAGSINASESKAMAQAAHGSAPDIAGLGLANPIGMIRSSAMLLGWIGKKHKSQLCSTVERRINQGVADTLVSGVCTKDLGGTASTQQFTDVVCEKIEEAE

SEQ ID NO: 11712 - protein, 345 aa, Bacillus clausii KSM-K16
MRAIEVRKPGDIHVVEVQKPELETDKDVLVKVQAVGICGSDMHIYHGSNPFTVYPRIIGHEVGGIVEEVGSGVHGLRRGDRVALEPISSCGVCYACKKGRPNVCAKLEVFGVHRDGGMREWMVAPEANWHKVNGDLPFEAAALVEPMTIGAQAAYRGNIEPGDTVFIMGAGPTGIACLIMAKQKGATVFISDLQANRLDYAKQVGADFTIHLPHEKPEAVLFEKTDGEFANVVIDAVGTSTTFAEAVKLASVAGTVVTLGFNETPSDIPSLLLTKKELTVAGSRLQTNQFPDVIRQVNEQKVDPASIISHRFDFDEVKKAIELLEKEPAHVRKAVLIFEREDESK

SEQ ID NO: 11713 - protein, 153 aa, Ashbya gossypii ATCC 10895
MSFVKNMLFGGVATSEDPTGLTQDANGEVSKGQSSVEEPIVEGKFFPRTLYKFNGHDDEKIFIAVRGKVYDCTTGRQFYGPSGPYSNFAGHDASRGLATNSFELDAVKHWDQPVDDLSDLSEQQLEALDGWAAHFEKKYPCIGVLVPEPGVNY

SEQ ID NO: 11714 - protein, 266 aa, Shewanella sp. ANA-3
MCILFVALKTHPQYPLIICANRDEFHHRPTAPAHFWPPEQNMLAGKDLQAGGTWFGVNKQGQIAGVTNLRVAQKSQEPMRSRGELIIKALSSGSLICPNWLEEHAEDYQPFNLVFGQGTNLYCFNSLKRNTVKLTAGFHAISNGALDDIWPKMAKGQRSLEALIQQSEPLELESLIKLMQDDSRPEDNELPDTGVGLEWERRLAAIYIRHPDYGTRSTSILLQNAQGEVQFTEVRYDGKGRRLGQQDFHFTLPSQLPKEPECLANF

SEQ ID NO: 11715 - protein, 257 aa, Triticum aestivum
MIYTAIDTFYLTDEQLRDSPSRKDGIDEAAETTLRVYGCDLIQESGILLRLPQAVMATAQVLFHRFYCKKSFARFSAKRVAASCVWLAGKLEESPRRSKHIIFVFHRMECRRESLPIEFLDVFSTKYTELRHDLIRTERHLLKEMGFICHVEHPHKFISNYLATLEAPELTQEAWNLANDSLRTTLCVRFKSEVVACGVVYAAARRHRVPLPEEPPWWTVFDADEAAIQEVCRVLAHLYSLPKAQYIPVYKDNDSFS

SEQ ID NO: 11716 - protein, 207 aa, Campylobacter upsaliensis RM3195
MKQFKNLIKELDWQKVGGLVPVIIQDAKSCEVLMLGFMNEEALKKSLECGKVVFYSRTKKRLWLKGEESGNFLNIVDLGLDCDKDSLLILVNPVGITCHNGTISCFESVSKGGDYIFLSRLERLINARKMADESSSYTASLFQNGTKRIAQKVGEEGVETALAAVAGDREELICEGADLLYHLSVLLSDKNLSLNDLITKLKERNRG

SEQ ID NO: 11717 - protein, 538 aa, Coccidioides immitis RS
MEKLRDYIHFGRNRASSELEKDVSAQHAEAQAGQFVETPIRWVTLHSVIMGMFVSMGGFLFGYDTGQISGILAMEDFLKRFGEKDATGDGYHFSNVRSGLIVAILSVGTLMGALIAGPIADRLGRKWSISSWCIVLAVGIIVQVASEAPDWWQVVIGRWIAGLGVGALSLLVPLYQGIFVANCINYGTEGIDNTGSWRIPMAVTFLWLLILGFGMMFFPESPRYAYRQGKIAEAKRTMMKFYGIPENHKRLHEEFVEIQQKYEEDMAAKDESWWQMFRAPRMRYRLLLGIILQALQQLTGANYFFYYGTVIFKGAGVENSYVTQMILGAVNFGSTFLGLYNIEHFGRRKSLIVGAGWMFICFLIFASVGHFALDLERPESTPKAGTAMVVFACLFILGFASTWGPMIWAIVAELYPSRYRARSMALATASNWLWNFLIGFFTPFITEKIDFRYGYVFAGCLFLAAATVYFGVIEGSGRTLEELDTMYILRVKPWQSAKYELPPVEELPLENRTAGTSHASSHEEADLNPPTSEQKNYD

SEQ ID NO: 11718 - protein, 620 aa, Arabidopsis thaliana
  misc_feature (606)..(606): Xaa can be any naturally occurring amino acid
MVMNNPANNNPVAASSASAVALAPPPHPPQPHRPSTSCDRHPDERFTGFCPSCLFDRLSVLDITGKNNNAVASSSKKPPSSSAALKAIFKPSSSSGSFFPELRRTKSFSASKAEAFSLGAFEPQRRSCDVRVRNTLWSLFHEDAEHNSQTKEGLSVNCSEIDLERINSIVKSPVFEEETEIESEQDNEKDIKFETFKEPRSVIDEIVEEEEEEETKKVEDFTMEFNPQTTAKKTNRDFKEIAGSFWSAASVFSKKLQKWRQKQKLKKHRTGNLGAGSSALPVEKAIGRQLRDTQSEIAEYGYGRRSCDTDPRFSIDAGRFSLDAGRVSVDDPRYSFEEPRASWDGYLIGRAAAPMRMPSMLSVVEDSPVRNHVHRSDTHIPVEKSPQVSEAVIDEIVPGGSAQTREYYLDSSSSRRRKSLDRSSSTRKLSASVMAEIDELKLTQDREAKDLVSHSNSLRDDCCSVENNYEMGVRENVGTIECNKKRTKKSRWSWNIFGLLHRKNGNKYEEEERRSGVDRTFSGSWNVEPRNGFDPKMIRSNSSVSWRSSGTTGGGLQRNSVDGYISGKKKVSKAENGMLKFYLTPGKGRRRGSGNSTAPTSRPVPXASQPFGSRNVMNFY

SEQ ID NO: 11719 - protein, 421 aa, Triticum aestivum
MLTVHSCSKKQIALSATACILMFSLLLFIFCSLQTIFLNDKPFVIATASSRSLHEIDSNSKPINGLQIFSLEVIANLSASKVETGQQMEGGTHNITNVTENATSGWSIVKEELTFSAGSAPFSSCHASTIVEIGKDNFLVAYFGGSKEGAPDVKIWLQRYSDGHWHPPEVADEQDGVPMWNPVLFQLPSHELLLFYKIGQEVQKWSGAMKRSLDGGISWSEREQLPPGILGPIKNKPFLLEDGRLLCGSSVESWNSWGAWLEVTKDGGRTWRKHGPIYIEGETLGVIQPVPYQTANGTIRMLLRSFETIGRVCLADSADGGVTWSYAHKTELPNPNSGIDGAKMKDGRVLVAYNTFSRGTLKIAVSTDDGDSWNEVMTLEDTKGMEFSYPAVIQTMDELVHITYTYNRTQIKHVVLRHSET

SEQ ID NO: 11720 - protein, 512 aa, Sclerotinia sclerotiorum
MTILVAMGGFIFGYDTGQISGFLEMHVFLQRFGERSSNLVAHPAGYYFTNLSIGTLIGCLVAGPLANRFGRRTCIPPFVIGVVIQMAVGKGEWVGIVMGRWVAGLGVGGLSVLVPMYMAETSPVPVTGAVISCYQLFITIGIFTADCINYGTESFKSTASYRIPMGVGFIWAIILGGGILFLPETPRYNWNHGKPEKAQETMAAFYGVEESHPMIRTEVAEIEKVRAATVGDHPWYEAVTGPRMLYRVSLAMALQMLQQLTGANYFFYYGTTIFAGVGIKNSYVTAMILGGVTVGATFFGVYMARHFRRRECLYIAALWQTMCFLIFASVGQFIFKDAAEGSHTAKTSGTVMIVFAVLFIVGFASTWGPLVWACIGEMFPYRYRAVAMAFATSAKWFWNFMLAFFTPFITQDINYAYGYVFAGCNLAAFFVVFFFLVESSGKTLQEVDAMYLMGVKPIGSHAFQFDSELRESLGTDINTDAMNLETRNGRVQKVNEAGQGGVFHDEGGNVKE

SEQ ID NO: 11721 - protein, 529 aa, Sclerotinia sclerotiorum
MLGAIASIGGFMFGYESGQISGFVQMSDFLDRFGENGELSAVRQGTIVAILCAGTLVGCLGSSYLCDTIGRRYTISSSAFFYIIGVIIEITSSTHWVQFAMGRFTAGLGIGALSTSVPMYQSESVPKNIRGAVVSSYQLLITLGIWTAYMINYGTHSAYTNSAQWRIPNGLSALWAIILGTAVLFMPESLALHTVSDVKMKARKNMALLNGVDPYSPLIDSEIQEIEQKLAAEREGGDHPWYEIFTGPRMLYRTLLGMVLQAGQQLTGANFFFYYGTTIFKSGGISDSYVTSIILGTVNVVATIGGLWIVKNCGRRKALMVGAAEMFVCMLIYSFVGHFKIQRQAQCSSPWAVLICFTCIYIVGSATTWGPLVWAIVGELYPARYRASCMALATASNWLFNFLISFFTTFITNDIDYYYGLVFAGSLFALFWIVYFFVIETKDRSLEEIDTMYVLHVNPRTSSTWDPKSLGAEGVKGVDTDGMFLTTGGKDIKKSEMAGRPMLEHDERRFPETAGGAASQEHKPEIMNA

SEQ ID NO: 11722 - protein, 295 aa, Helianthus annuus
NLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHE

SEQ ID NO: 11723 - protein, 271 aa, Helianthus annuus
NWGFFEIVNHGISTELLDTVEKMTKGHYKKCMEDRFKDMVASKGLEAVQNQIDDLDWESTFYIRHLPESNISEIPDLEDEYRKVMREFAKELEKLAENILDIFCENLGLEKGYLKKAFYGAKGPTFGTKVSNYPPCPKPDLIEGLRAHTDAGGVILLFQDDKVSGLQLLKDDKWIDVPPMHHSIVINLGDQLEVITNGRYKSVMHRVIAQPDGTRMSIASFYNPGSDAVIYPAPQLVNKEEEKSNIYPKFVFEDYMKLYTAVKFQAKEPRF

SEQ ID NO: 11724 - protein, 145 aa, Triticum aestivum
  misc_feature (70)..(70): Xaa can be any naturally occurring amino acid
  misc_feature (74)..(74): Xaa can be any naturally occurring amino acid
  misc_feature (94)..(94): Xaa can be any naturally occurring amino acid
  misc_feature (107)..(107): Xaa can be any naturally occurring amino acid
  misc_feature (109)..(109): Xaa can be any naturally occurring amino acid
  misc_feature (112)..(113): Xaa can be any naturally occurring amino acid
  misc_feature (116)..(116): Xaa can be any naturally occurring amino acid
  misc_feature (127)..(127): Xaa can be any naturally occurring amino acid
  misc_feature (133)..(133): Xaa can be any naturally occurring amino acid
  misc_feature (138)..(138): Xaa can be any naturally occurring amino acid
FVKAPGGAPANVAIAVARLGGGAAFVGKLGDDEFGRMLAKILRDNGVDAGGVVFDPGARTALAFVTLRAXGERXSCSNRNPSADMLLTAERVKXRLIKEGCIFHYGXIXLIXXACXTTHLTHEVAKXAGASLXYDPNXRRILASL

SEQ ID NO: 11725 - protein, 523 aa, Bacillus subtilis
MYPDRNIRYTYAQFDSLCRQTAKGLMRMGIGKGDHVAIWASNISEWLAVQFATAKIGAVLVTVNTNYQAHELDYLLKQSDAAALIIMDSYRGTSYPDIVNSLIPELQEAKPGQLKSERYPFLKTLIYIGNKRLSGMYHWDDTEILAKTVTDAELEERMNSLDKDNVINMQYTSGTTGFPKGVMLTHFNVINNAANIAECMALTSQDRMCIPVPFFHCFGCVLGVLACVSVGAAMIPVQEFDPVTVLKTVEKEKCTVLHGVPTMFIAELHHPDFDAYDLSTLRTGIMAGSPCPSEVMKAVIERMGMKDITIAYGQTEASPVITQTRANDSFIRRVETTGRALPHTEVKIVEPGTCQEVQRGMQGELCTRGYHVMKGYYKDKDATRKAINHDGWLFTGDLAVMDEDGYCRITGRLKDMLIRGGENIYPREIEEFLYQHPAVLDVQVVGVPDAKFGEEAAAWIKLKDGKSVSPDELKAYCKGKIARHKIPRYVIFTDDYPMTASGKIQKYKLREKTIEMFNLSSSQ

SEQ ID NO: 11726 - protein, 578 aa, Penicillium chrysogenum
MVFLPPKESGQLDPIPDNIPISEFMLNERYGRVRHASSRDPYTCGITGKSYSSKEVANRVDSLARSLSKEFGWAPNEGSEWDKTLAVFALNTIDSLPLFWAVHRLGGVLTPANASYSAAELTHQLLDSKAKALVTCVPLLSISLEAAAKAGLPKNRIYLLDVPEQLLGGVKPPAGYKSVSELTQAGKSLPPVDELRWSAGEGARRTAFVCYSSGTSGLPKGVMISHRNVIANTLQIKAFEQNYRDGGGTKPASTEVALGLLPQSHIYALVVIGHAGAYRGDQTIVLPKFELKSYLNAIQQYKISALFLVPPIIIHMLGTQDVCSKYDLSSVTSLFTGAAPLGMETAADFLKLYPNILIRQGYGLTETCTVVSSTHPHDIWLGSSGALLPGVEARIVTPENKEITTYDSPGELVVRSPSVVLGYLNNEKATAETFVDGWMRTGDEAVIRRSPKGIEHVFIVDRIKELIKVKGLQVAPAELEAHILAHPDVSDCAVIAIPDDRAGEVPKAIVVKSASAGSDESVSQALVKYVEDHKARHKWLKGGIRFVDAIPKSPSGKILRRLIRDQEKEARRKAGSKI

SEQ ID NO: 11727 - protein, 547 aa, Bacteroides fragilis YCH46
MTKSALQIARAAYQPKLPKALKGSVKAVEGAATQSVADQEAIQKLFPNTYGMPLIKFEEGEAIQLPAMNVGVILSGGQAPGGHNVISGLFDGIKTLNKDNKLYGFILGPGGLVDHNYMELTADIIDEYRNTGGFDIIGSGRTKLETPEQFEKGLEIINKLGIKALVIIGGDDSNTNACVLAEYYAAKNAGVQVIGCPKTIDGDLKNEMIETSFGFDTACKVYSEVIGNIQRDCNSARKYWHFIKLMGRSASHIALECALQVQPNVCIISEEVEAKDMSLDDVVTYIAKIVADRAAQGNNFGTVLIPEGLVEFIPAMKRLIAELNDFLAANAVEFANIKRSRQREYIISKLSKENAEIYASLPEGVARQLSLDRDPHGNVQVSLIETEKLLSEMVGTKLAQWKEEGKYVGKFAAQHHFFGYEGRCAAPSNYDADYCYSLGYTASMLIANGKTGYMSSVRNTTAPAAEWIAGGVPITMMMNMERRHGEMKPVIQKALVKLDGKPFLTFAAKRDQWALNTDYVYPGPIQYFGPTEVCDQPTKTLQLEQAK

SEQ ID NO: 11728 - protein, 579 aa, Anabaena variabilis ATCC 29413
MTTTDDLQKLLDILPQDLRQVLENHPKRDSLVEVVLDLGRRPEARFPNQAEYLSETPVTQAQIDDCVQRVGNFGGDNRAGIEQTLHRISAIRNRSGKIIGLTCRVGRAVFGTIGMIRDLVETGKSILMLGRPGVGKTTALREIARVLADELHKRVVIIDTSNEIAGDGDVAHPAIGRARRMQVAHPELQHQVMIEAVENHMPEVIVIDEIGTELEALAARTIAERGVQLVGTAHGNQIENLIKNPTLSDLVGGIQAVTLGDDEARRRGSQKTVLERKAPPTFEIAVEMLERQRWVVHESVADTVDTLLRGRQPSPQTRTVDDQGKVAITRQLSVVNGRGGQLATPEESFSPARASNGWRASGQMLAIPSLPLERERISGQSEFDRLLDESFNYPEAIDFGSSARQPGPNGEDLPLHIYPYGVSRHQLEQVISVLTLPVVLTKDIDNADAILALRSHVKNHAKLRQMAKARHVPIHVIKSSTIPQITRGLRRLLNLDDPEIADDRELQLFLHNGSDDEMDALEEARLAVEQIVIPKGQPVELLPRSPQVRKMQHELVEHYRLKSHSFGEEPNRRLRIYPA

SEQ ID NO: 11729 - protein, 237 aa, Bacillus clausii KSM-K16
MFTTSLRQAQRIVVFTGAGMSTESGVPDFRSSRGLCKGNNPEALASLQAMNDNREAFVDFYRRRMEQLQHVQPHKGYDVLATWEQQLSVTAIITQNTDGLHERAGNQRVLPLHGSIQKLYCIQCGQHYDVDRYMNNQPSCSCGGFIRPSVVLFGEPLDSNILALAEQHSIEADVFIVLGSSLVVSPANLFPRIAKEHGAKLIIVNHDSTPLDTIADYVVNDKPIGSFLVETNRALQK

SEQ ID NO: 11730 - protein, 377 aa, Solanum tuberosum
MDSSNPKVITCKAAVVGKEGEMIKIEEIQVDPPKSNEVRIKMLFASLCHTDILASNGYPYSLFPRVLGHEGVGMIESVGENVTNLKEGDIVMPLYLGECKECPNCKSGKSNLCHKYHLTFSGLMLDDTSRISIHGGQVLYHSFSCSTWSEYIVINANYVIKVDPQKIPLQHASLLCCGFTTGYGATWREVHVEKGSTVAVLGLGVVGLGAIEGARSQGASKIIGVDINESKQGKGELFGMTDFINPKESMTSVSEMIKDVTEGLGVDYVFECTGIPSMLNEAIEASKLGIGTIVVIGAGHGLTREFNLVPLLCGRTLKGSIYGGIRLHSDLPAILHRCATKEIQLNELITHQISLTEINQSFELLKDPHCVKIIIKF

SEQ ID NO: 11731 - protein, 469 aa, Candida glabrata CBS 138
MLRIYRPRVMAIARRYVSQTAQTSNAMVADTTDPMMNPMQPKLSSHSQLPPSSVAYLKTLSRAEVFSLGMIGLATTSKPVLNLVIKLFPYVPMPLIKMFVSRLYCGGDNINEVKTFGEKLQKRGISNMMLSLTIEDSEGTKNIDINYIVEETIKSVHGVLKPNLVNQLEKCGNDAKKINEIAPGYIALKPSALVSNPHDVLMNFNNPDPHWVAQREKLIDNCSRIAQEIYDLNNDLLKKYPSRTAPFCVATIDAEKYDLQNSGVYELQRILFQKFNKLSSPMVSVIGTWQLYLVDSAAQLAREHARAMKEGYKLGVKLVRGAYIHSETKRDSIIFKTKEGTDENYDAVMTTVIQDLLKNGTKSYYGHLVVASHNYGSQMLATKILKDAPENVGKANIVLGQLLGMSDNVTHDLITKHGAKNIIKYVPWGPPLETKDYLLRRLQENGDAVKSDNGFPLVKAVIKSLFSRA

SEQ ID NO: 11732 - protein, 648 aa, Zea mays
MNSMDEINLLRQAQRQHQHHLMVRGIGEEIDLEIGPVDDPSFSGASLVAVTSTHDTVVHADDHKSLLIPCSQPGAADGLAPQQHLSQGEEHDGMLRSPSGHTKKKKKVVKKWREEWADTYKWAYVAVHDTTTRIFCSVCKEYGRKHRRNPYGNEGSRNMQMSALEEHNNSLLHKEALRLQMASKEKLQPPEIEGPVYVKALSKTAASILECVLRRDPHEAEYIQSIQEVVHSLEPVLVKNAQYIQILERLLEPERCFIFRVPWIDDRGEAHVNRGFRVQFSQALGPCRGGLRFHPSMSLSVAKFLAFEHTLKNALSLYKLGGAAGGSDFDPKGKSDNEIMRFCQSFMDELYRYLGPDQDFPAEDIGVGPREMGYLFGQYRRLSGHFQGNFTGPKIFWSGSSFRTEATGYGLVFFARLLLAEMNKELKGLRCVISGSGKIAMHVLEKLLPCGAIPITVSDSKGYLLDEDGFDYMKYSLLRDIKAQQKSLKEYLKTYPHAKYIDDAKPWSQQCDVAFPCASHNEIDQGEAVAISNSGCRVLVECSNMSCTVQAVDILRKAKVIVAPAKATAAGGVALGEIELNPEFNLMQLSVEDFENRIQDAIKQTYERSVKAAQDYGIMKESPDFLVHGANICAFLNIAQAMTDQGCV

SEQ ID NO: 11733 - protein, 333 aa, Rhodobacter capsulatus
MSLDDKATKPHDRLAQALAEDMAAVNALIRERMSSEHAPRIPEVTAHLIEAGGKRLRPMLTLAAARLVGYGGPFHVHLAATVEFIHTATLLHDDVVDESRQRRGRPTANLLWDNKSSVLVGDYLFARSFQLMTDTGNMRVMEILANASAVIAEGEVLQLTAAQNLATTEDIYLRVIRGKTAALFSAATEVGGIIGGAPEDQVQALFDYGDALGIAFQIVDDLLDYGGKSAEIGKNTGDDFRERKLTMPVIKAVALADEAERAFWKRVIEKGDQQDGDLEHAMALMTKHGTLEATRLAAIGWTDTARKALAKLPDHPLRQMLDDLADYVVERVR

SEQ ID NO: 11734 - protein, 157 aa, Glycine max
  misc_feature (29)..(30): Xaa can be any naturally occurring amino acid
  misc_feature (118)..(118): Xaa can be any naturally occurring amino acid
  misc_feature (120)..(120): Xaa can be any naturally occurring amino acid
  misc_feature (125)..(125): Xaa can be any naturally occurring amino acid
  misc_feature (140)..(140): Xaa can be any naturally occurring amino acid
  misc_feature (152)..(152): Xaa can be any naturally occurring amino acid
  misc_feature (154)..(154): Xaa can be any naturally occurring amino acid
SVWSPPLESARRPPPPHKEDTSTWIGAIXXLGIAYAGSENEQLREKFTGVLNDSKASLEVLAFAAISLGLIYVGSCNEEIAQAIIYTLLDRSESELGEPLTRLLPLGLGLLYLGKQDXCXRQLPXFQMTFNEKIRKYCDXTLLSCAYAGTGXVXHIL

SEQ ID NO: 11735 - protein, 328 aa, Ashbya gossypii ATCC 10895
MMDKLDLDQLPYYDPRVERKVALVTGGNSGIGWYTVLHLYMHGFIVYVGGRNSSRVHKAIKEIKQEAENRLETARQDPHDELERCLGELRYLPIDLTDLRSVEKAAKKFRAQESTLDVLINNAGVMALPYELTHDGFEVQMQTNYVSHFLLTMRLLPYVKRSGGRVVTLSSIGHKIQFTYCPLDCHFDYRPNIFFTWLRYAMAKTAAIQFTKMLAIKHPDVMCIAVHPGLVMNTNLFSYWTRLPIVGIIFWIFFQIVGFCFGVSNEEGSIGTLKSALSPALTLERDNGKYFTTGGVESRPSSVANNLDNAASTWIWTVHQLRDRGYEI

SEQ ID NO: 11736 - protein, 356 aa, Bacillus clausii KSM-K16
MSKESIYGLTMAQLTDWLMERGHKKFRATQVWDWLYRKRVTTFAEMTNVNKDCLQLLEDHFAIETMSEHVRQESKDGTIKFLFRLQDGNLIETVLMRHKYGFSVCVTTQVGCNIGCSFCASGLLTKNRDLSSGEIVEQIMKVQFHLDQVGKEERVSHVVVMGIGEPFDNFQNTVDFLEIIKDHKGLAIGARHITVSTSGLAHKIYEFADLKLQVNLAVSLHAPNNELRSRIMKINKAFPIEKLMDSINYYIEKTNRRVTYEYILIKDVNDHKEEALQLAELIGDKRHLSYVNLIPYNPVDEHSQYQRSEPEAISQFFDTLKKKGINCGVRLEHGTDIDAACGQLRSKQEKKKVKVN

SEQ ID NO: 11737 - protein, 454 aa, Candidatus Kuenenia stuttgartiensis
MIPAFQDFSFRDKNLYLYTKIRLYMSKIITEKSKKAFLDAQSVIPGGVNSPVRAFGGVGGTPIFIKSGSGCCLTDIDGNRYVDYVGSWGPLILGHADPRIVKRVNEAVANGTSYGAPTELEIQLAKLVKEAMPSIEKIRMVNSGTEATMSAIRLARGHTKRDEVIKFEGCYHGHVDSLLVQAGSGATTLGMPNSPGIPGDFVKHTISLPYNNIDAVNEVCSRRGNEIACIIVEAVAGNMGVVPPAKNYLAGLREITKKYGIVLIFDEVMTGFRVAHGGVQALYNITPDLTTLGKIIGGGLPVGAYGGKKEIMDGISPVGPVYQAGTLSGNPVAMTAGIATLEILKDNAVYKGLEERSKQLAAGMEKVCNDANIPAYHTRVGSMLCTFFTSKPVVDYATAKLCDTGRYAKFFHGMLERGFYFAPSQFEAAFVSTVHGEKEINDTIAAFGEVVKTL

SEQ ID NO: 11738 - protein, 506 aa, Medicago sativa
MDLLLLEKTLLALFIAATIAVTISKLRGKRFKLPPGPIPVPIFGYWLQVGDDLNHRNLTDYAKRFGEIFLLRMGQRNLVVVSSPELAKEVLHTQCVEFGSRTRNVVFDIFTGKGQDMVFTVYGEHWRKMRRIMTVPFFTNKVVQQYRYGWESEAESVVNDVKNNAEASVGGIVIRKRLQLMMYNIMYRIMFDRRFESEEDPLFVKLKALNGERSRLAQSFEYNYGDFIPILRPFLKGYLKVCKEVKDRRLQLFKDYFVDERKKLESTKSTTSNDGLKCAIDHILDAQKKGEINDDNVLYIVENINVAAIETTLWSIEWGIAELVNHQDIQNKVREEMDRVLGPGHQVTEPDLHKLPYLQAVIKETLRLRMAIPLLVPHMNLHDPKLNGFDIPAESKILVNAWWLPNNPAHWKKPEEFRPERFLEEESHVEANGNDFRYLPFGVGRRSCPGIILALPILGITIGRLVQNVELLPPPGQSKIDTSEKGGQFSLHILKHSTIVAKPRSF

SEQ ID NO: 11739 - protein, 497 aa, Wolbachia endosymbiont of Drosophila ananassae
MGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKDQHLLVFWDFLRNVGSIIVNNVPGVNRVVYDITSKPPATIEWE

SEQ ID NO: 11740 - protein, 84 aa, Brassica napus
  misc_feature (56)..(56): Xaa can be any naturally occurring amino acid
MCPLRFLLVFFSAVLAGYFAWKTVSSSPEIISKDDDGSPVELNNEKQGLCFKKKMXEKGFWVFVDMASGKYLWRNLKLMSEKAI

SEQ ID NO: 11741 - protein, 298 aa, Candida glabrata CBS 138
MAEQKYIKDGWFYEMSDEHFPGQALALKVKQVLYQSKSEFQDILVFESTNHGVCLVLDGIIQCSERDEFAYQEMIAHIPLYCHANPKKVLVIGGGDGGVVREVVKHDKVESVTMVEIDKTVIELAKKYLPGMSCAMDHPKLKLNLCDGFKFLKEASMLSNDDKYDVIITDSSDPDGPAEAFFQKEYFELLQNALKPDGIVIAQASENVWLDINYLASLRKTANEVFTNTMISYTTVPTYTSGQLGLIVCTNSNDYDLTTPQRQPSVSEQNQLRYYNSQIHSASFVLPNWADMLIYDKK

SEQ ID NO: 11742 - protein, 260 aa, Brassica napus
  misc_feature (90)..(90): Xaa can be any naturally occurring amino acid
MGSASNPLVTSSVVDDSPLPSNLTQDDLKKLAAYKAVEYVKSGMVVGLGTGSTAKHAVARISELLRQGKLRDIIGIPTSTTTHEQAVSLXGIPLSDLDSHPVVDLSIDGADEVDPALNLVKGRGGSLLREKMVEGASKKFVVIVDESKLVKHIGGSGLAVPVEVVPFCCDFTRGKLEELFREAGCKAKLRVKSGGEAAAVTDNGNYVVDLYLERDMGDLEAASEKILRLPGVVEHGMFLGIATTLIVAGKSGVTVKDRFG

SEQ ID NO: 11743 - protein, 692 aa, Triticum aestivum
MEIVDKIAEPEDPLVVTARKVQSLEPPLPIPIKASWKGKTSQQQDEKDLPDDGEESFQSVDSSDEGGRSSFSGASHPLEPIDMDLMKTVYVAIDEEKPEPPVCLVRGLSAKGPFMDDLSLRVTGLKANAVVCAGSGEGLAEERKVSGAAVASLATARSSQATETVSLPPDSEEKDCVWDASLPPSGNVSPHSSIDSMGVVTAMSIASNRSNTYKSEAIASGTMLTVERNFGSVKSSVRGDSLESAKTSMSRASDSSGVSDDSSWSHITGGTSKPHKGNDPRGKAIHAVRIRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQKQPGKYFSEYAARFYAAEVLLAIEYLHMLGVVYRDLKPENVLVRDDGHIMLSDFDLSLRCAVSPTLIRTSAFDSDPRRAGGSFCVQPTCMEPTSACIQPACFIPKLFGQKSKKKTRKTRSELGQSAINLPELLAEPTSARSMSFVGTHEYLAPEIIKGEGHGSAVDWWTFGIFLHELLYGKTPFKGSGNRATLFNVVGQQLKFPESPSTSYAGRDLIRGLLAKEPQQRLGVKRGATEIKQHPFFEGVNWALIRCSTPPEVPRPVEAELPVKYGVSEAVASTNKRVVGADAKSGGKYLDFEFF

SEQ ID NO: 11744 - protein, 458 aa, Arabidopsis thaliana
MEFTEAYKQTGPCCFSPNSRYVAVANDYRLVIRDTFSFQVVQLFSCLDKISYIEWALDSEYILCGLYKKPMIQAWSLTQPEWTCEIDEGPAGISYARWSPDSRHILTTSEFQLRLTVWSLLNTACVHVQWPKHGSKGVSFNQDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMRLLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 11745 - protein, 257 aa, Nostoc sp. PCC 7120
MSILDSLPDEPEEETSPESPNPQNPQSDQQEPEKHNAQTNGGGQHALLSPQLKVDAPLRMVETAFLASTASLIWFINFYFPLGPVLRIFFPVPIALVYLRWGKRAAWMAAVTSGLLLSVLMGPVRSLLFVMPFAFMGVVLGATWYRRAPWIVSITLGTLLGTLGVFFRLWLLSVLSGEDLWIYLITQVTELIEWIFLKLGLLNSPSVFLIQLGAVALIIINNFIYLFVVHLAAWLLLDRLGNPIPRPPRWVQVLMDY

SEQ ID NO: 11746 - protein, 110 aa, Coprinopsis cinerea okayama7#130
MFSDLECDYINPIDLCNKLNQFVIPEHAAHAFLTLLFLLSGQWMAFILNAPLVAWNANKIFNKVHMYDATEIFRTLGGHKKETFIKLGFYLLSFFYYLYRMIVALIAESE

SEQ ID NO: 11747 - protein, 402 aa, Debaryomyces hansenii CBS767
MTSPTTYTPTTHKTKTVEALIYILGWYIFSLSISIYNKWMFGNGLNFKFPILVTSFHQFCLMILSGLVLWIKPKLRPTINMKSHDSNNVNRSGNLNSKFISFLSIFRIDLFTYLEQIFPCSLASAGDIGLSNVSFKFISLSLYTMLKASSLMFVLLFGLLFRLEKFHWRLLVIVLIMTGSVIMMVKKPQNVGLVLTPEDDRTNFGILLVLGASMMSGLRWSFTQILLKHNDYTNNSISTIFYISPSMCLTLFLFGLGFEGWSNFIQSPIWELQGVFGTILLILIPGILAFMMTLCEFKLLSVAQVITLSIAGIFKELLTIILSALIFGDKLSFINCLGLLITFVDIIWYNYYRFKENQSKELEGYSSLNGKDETEDDEVSVGSSKVDINSNSKVDSIEMKKL

SEQ ID NO: 11748 - protein, 1056 aa, Lactobacillus reuteri
MPKRTDIHKILVIGSGPIIIGQAAEFDYSGTQACLALREEGYETILVNSNPATIMTDKEIADHVYIEPLTVDSLSRIIRQEYPDAILPTLGGQIGLNLAVSLSKTGLLDELGIELLGTKLDSIDEAEDREKFKELMNELGEPVPASQTVNTVDEAVEFAHQCGYPVIVRPAFTMGGTGGGICHNDAEMRTVAKNGLELSPVTQCLIEKSIAGYKEIEFEVMRDSADNVMVVCCMENFDPVGIHTGDSIVFAPNQTLSDREYQMLRDCALKLIRALKIEGGCNVQLALDPQSFQYNVIEVNPRVSRSSALASKATGYPIAKMAAKIAVGLTLDEIKNPVTKTTFAEFEPALDYVVCKIPRWPFDKFTQADRHLGSQMKATGEVMAIGRTVEEALHKAVRSLEIDEKDLFSAEAHHAPTDMLEKKLRYPQDDRLFYLAEAFRRGYSLKQTHDLTKISPYFLDIVKHLVELEDDLSTKPFDAETLIISKKYGFSDATIARLWHTSSQEVRKFRKQNEILPVYKMIDTCAAEFASSTPYFYSAYDHENESQRTKKPSILVLGSGPIRIGQGVEFDYATVHSVKAIQRAGYEAIVINSNPETVSTDFSVSDKLYFEPLTLEDVLNVIDLEQPVGVIVQFGGQTAINLAEGLAKNGVNILGTTVDDLDAAEDREVFDKVITDLNLKQPIGLTATTHSAVIKAAEKIGYPVLVRPSYVLGGKAMETVYNQEELQQYLQQNASITADHPILIDAYLEGRECEVDAICDGKDVLIPGIMEHIEHAGVHSGDSMAVYPPQHFDDDIKQQIVTATEKLAVALKCIGIMNIQFIVHNREVYILEVNPRASRTVPFLSKITGIEMAQVATRVILGQSLADQGFTNGLYPEPQTIHVKAPVFSFNKLANVDSYLSPEMKSTGEVMGTDTTYEKALHKAFSGAHVQVPNNGKILFTIENGDEEDILPLAKRFAQIGYQIFTTPQTASHFKDNGIHVHQKISNIDELNRLLKAGQIDLVINTMRHDYEQDSLGFQIRQSTIAQNVPLMTSLDTVNALLHVKEDQCLEAITIK

SEQ ID NO: 11749 - protein, 250 aa, Haloarcula marismortui ATCC 43049
MKAVVLAAGKGTRLQPLTDDLPKALVEVDGKPLLTHCLDELISLDADEFVIVVGYRQQQIIDYYGSSYDGVPVTYVHQEEPAGLAHALLQAEPKIEHDFMLMLGDNVFRGNLDTVVQRQQEQRVDCAFLVEEVPKNEASRYGVCVTNKYGEITDVVEKPDDPPSNLVMTGFYTFSPAIFKACSLVQPSDRGEYELSDAIDLLMDSGRTIDAVRLNGWRVDVGYPENRDAAEQRLAEETATLASGGGNISR

SEQ ID NO: 11750 - protein, 474 aa, Anabaena variabilis ATCC 29413
MTTSQEVLKRIQDEKIELIDLKFIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 11751 - protein, 119 aa, Escherichia coli O157:H7 EDL933
MAEETIFSKIIRREIPSDIVYQDDLVTAFRDISPQAPTHILIIPNILIPTVNDVSAEHEQALGRMITVAAKIAEQEGIAEDGYRLIMNTNRHGGQEVYHIHMHLLGGRPLGPMLAHKGL

SEQ ID NO: 11752 - protein, 356 aa, Anabaena variabilis ATCC 29413
METNVKAQVFRGVNQLSYEEIPLPTLEPDEVLVQVQVVGLCQSDIKKIRYPLYEPPRIFGHETAGTIAAVGSQVKGWQVGQRVAVMHHIPCMRCAYCMNDNFSMCDVYKNISTTAGFNASGGGFAEYVKVPGHIVENGGLIPIPDEISFEEASFVEPTNCCLKAVKKAQIAPGQTVLVTGAGPIGLMFVMLVKYFGAKAIATDLLPSRIEKALNVGAEAAFDARDPDLPAKIHALTNGLGVDVTLLAVPSEKAFFQALDCTRKGGKILFFAEFPDELEIPINPNILYRREIDLMGSYSSSYRLQNLSADIVFNRRIDVQALISDRYPLKDLSAAVDQAIAPTPETYKILIYPKIGD

SEQ ID NO: 11753 - protein, 149 aa, Zea mays
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 11754 - protein, 122 aa, Wolbachia endosymbiont of Drosophila ananassae
MSNEVYDSDNIFAQILRGELPCEKVHENENVLAFHDKYPDAPVHILAIPKNQYISYDDFILKASEEEIANFFKTVREIAHKYNLEKTGYRLVTNYGENGEQVVPHFHVHILGGKKLGKHVNS

SEQ ID NO: 11755 - protein, 434 aa, Escherichia coli O157:H7 EDL933
MTTPLKKIVIVGGGAGGLEMATQLGHKLGRKKKAKITLVDRNHSHLWKPLLHEVATGSLDEGVDALSYLAHARNHGFQFQLGSVIDIDRDAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISAAAHNELTKLGVRVLTQTMVTSADEGGLHTKDGEYIEADLMVWAAGIKAPDFLKDIGGLETNRINQLVVELTLQTTRDPDIYAIGDCASCPRPEGGFVPPRAQAAHQMATCAMNNILAQMNGKLLKNYQYKDHGSLVSLSNFSTVGSLMGNLTRGSMMIEGRIARFVYISLYRMHQIALHGYFKTGLMMLVGSINRVIRPRLKLH

SEQ ID NO: 11756 - protein, 1073 aa, Desulfotalea psychrophila LSv54
MPKRTDIKKILIIGSGPIIISQACEFDYSGAQAVKALKEEGYEVILINSNPATIMTDPELADATYIEPITPECVTKVIAKERPDALLPTLGGQTALNTAIKLAELGVLEQYNVELLAADIAVIKKAEGREEFRDAMHAIGLNVPESAIVHDLESAMAAGEDIGFPIIVRPSFTLGGTGGGIAYNRQELEELCTSGLDLSMTTEIMVERSLLGWKEFELEVMRDKNDNVVIICSIENIDAMGVHTGDSITVAPAQTLTDREYQEMRDAAVAIIREIGVETGGSNVQFAVNPADGELMIIEMNPRVSRSSALASKATGFPIAKIAAKLAVGYTLDELKNDITEETYASFEPTIDYCVVKIPRWTFEKFPEAEDKLSTAMKSVGETMSMGRTFKEAFQKAMRSLETGRAGFGGDGKELLTDIDAIDLEHNLRTPNSKRVGYIHEALKRGMSLEEIHEFTLIDPWFLYNFKQIVEKEEEIIAHGFQGIDAEFLRGCKEYGFSDIQLGYLTGTTEDDIRKLRLEMEIRPVYKMVDTCGAEFESNTPYYYSTYEQENEAIETSGKKIIILGGGPNRIGQGIEFDYCCVHAAFALKELGVESIMINSNPETVSTDYDTSDKLYFEPLTREDVLNIIEQEKPYGVIVQFGGQTPLNLAVPLENAGIRIIGTQPDAIDRAEDRKRFQQFLQKLGLRQPENDTVSTLEEALASANRIGYPVVVRPSYVLGGRNMRIVYTDQGIRDFMIAVGGTNLEHPILVDKFLQEAIEVDVDALCDGEDTIIGGIMEHIEEAGIHSGDSSCVLPPHTLSLELVKEIKAASKAMAKELGVIGLMNVQFAIKDKQVYILEVNPRASRTVPFVSKATGVPLAKLATKVMMGARLKDLGLTRDPYIDHWAVKEAVFPFDRFDKVDTLLGPEMKSTGEVMGIDDNLGLAIAKAHLASGSTLPTEGTVFISVRDNDKAHSVEVAKSLLQLGFSICATAGTAQYLQDKDIDCSPVNKISQGRPHILDKVQDGQIAWIINTSLGRRTTEDSYQIRRSALDYHIPYTTTITGAAAVIKAIHDLSTKELNVQPVQYFTGKE

SEQ ID NO: 11757 - protein, 141 aa, Coprinopsis cinerea okayama7#130
MSGMAPWFCWLFLFAVLYSAGLLFGMVFFVIMFSDLESDYINPIDLCNKLNQFVLPEYGAHAFLSLLFLLFGQWTAFIWNLPLIAYNANKVIKKNHMYDATEIFRTLSSHQKETYFKLAFYLLSFFYYLYRMIVALVAENP

SEQ ID NO: 11758 - protein, 595 aa, Coprinopsis cinerea okayama7#130
MAPKIYRSPLPDVPVFNRSIFTHLFPPTSPPAHIGQWNESVPAYIDAPSGTTITRGQTKKLSLALAYGLRNHRNLQAKRGDTVLIYSQNSLTWPIALFGSVAAGLRATLANSAYNARELAFQYTDSRAHLLFTSEEGIPVVLEMFKSLGVSSAEAQKRIIVMTTSLHWAGGPTIPVSPAARGLTTVASLLQLGTLEAEEKFDGELANETAYLCYSSGTTGKPKGVETTHRNLTSVLDQVRPAFPPLDSNTDKVLGVLPFYHIYGAIKLLHHPFLCGAPLVIMSRFDPVQFCANIEKYKITMALIVPPVLVVLSRHPAVDEYDVSTLEVLFSGAAPLGAALTQQVKERLEARKKNGQPVYILQGYGLTETSPTTHLLEKPDAVRKVGSIGILLPNLEARLVVDGEGDGNIDAEEGQPGELWIRGPSVMKGYLNNPKATKESITHDRWFKTGDIAIRDSEGYYTIVDRRKELIKYKGFQVPPAELESVLLTHPEIADTAVIGVDSAKEATELPRAYVVHANPTALKSDSDKLAFAASVQKWIQTKVARHKFLRGGVVVIDAIPKSASGKILRRELREKAKQELAGRDPADDIIRAKL

SEQ ID NO: 11759 - protein, 268 aa, Haemophilus influenzae
MDLYAVWGNPITQSKSPLIQNKLAAQTHQTMEYIAKLGNLDSFEQQLLAFFEEGAKGCNITSPFKERAYQLADEYSQRAKLAEACNTLKKLDDGKLYADNTDGIGLVTDLERLNWLHPNQRILILGAGGATKGVLLPLLQAQQNIVLANRTFSKAKELAERFQPYGNIQAASMDSIPLQTYDVVINATSAGLSGGIAPVDAEILKLGSAFYDMQYTKGTDTPFIALCKSLGLTNLSDGFGMLVAQAAHSFHLWRGVMPNFVAVYEQLK

SEQ ID NO: 11760 - protein, 103 aa, Debaryomyces hansenii CBS767
MSGRGKGGKGLGKGGAKRHRKILRDNIQGITKPAIRRLARRGGVKRISGLIYEEVRGVLKTFLENVIRDAVTYTEHAKRKTVTSLDVVYALKRQGRTLYGFGG

SEQ ID NO: 11761 - protein, 162 aa, Debaryomyces hansenii CBS767
MSQVYFDISADGNKLGRVTFKLYDDVVPKTAENFRALCTGEKGFGYASSTFHRVIPQFMLQGGDFTRGNGTGGKSIYGEKFRDENFVKKHEKPGLLSMANAGPNTNGSQFFITTVTCPWLDGKHVVFGEVVDGFDIVKKVESYGSGSGATKSRITIDASGEL

SEQ ID NO: 11762 - protein, 573 aa, Ashbya gossypii ATCC 10895
MLSRSRLLGYSARTIAQLSRPGCPRISNEAVKPFSKRDTLDWDLLRASLSKFNNSSLDVPLVINGERIYFNDAGKRELFKQVNPARHTQVLAHVTQASREDVRAAVRAAQDAKQKWYETPFYDRAAVFLKAADLVATKYRYDMLAATMLGQGKNVQQAEIDCITELADFFRFNVKYAEELYQQQPAESSPGVWNRSEYRPLEGFVYAVSPFNFTAIAGNLVGAPALMGNTVVWKPSQNAALSNYLLLTVLEEAGLPRGVINFVPGNPVDVTEEVLADKALGGLHFTGSTAVFKQLYGKIQQGVVSGLYRDYPRIVGETGGKNFHLVHPSANLPHAVLSTLRGAFEFQGQKCSAASRLYLPQSKADAFLADLAGTLAAIKPANTSASSINGGDLHAFMGPVIHEQSFDKLAAAIERARTDPELEILYGGDHSKSQGYFVGPTVVRTSNPRHDFMTAEFFGPILTVYEYPDAQFDQVCDLIDSTSAYGLTGAVFARDRDAIAAADRRLKYAAGNFYINDKATGAVVAQQWFGGARMSGTNDKAGSPNVLSRFVSVRSVKENFYELTDFKYPSNYE

SEQ ID NO: 11763 - protein, 294 aa, Brassica napus
MDQYEKVEKIGEGTYGVVYKARDKVTNETIALKKIRLEQEDEGVPSTAIREISLLKEMQHSNIVKLQDVVHSEKRLYLVFEYLDLDLKKHMDSSPDFSKDLHMIKRYVYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPTEDTWPGVTSLPDYKSAFPKWKPTDLESFVPNLDPNGIDLLSKMLLMDPTKRINARAALEHDYFKDIGVMP

SEQ ID NO: 11764 - protein, 873 aa, Zea mays
MFGNIGKIPIIGDLTGSNKNAHLKGNVVLVRKTVLGLDVTSIAGSLLDGIGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPMLVKRLTEFPPRSSLDPSKYGDHTSTIREADLENKLEGLTVQQALHGNRLYILDHHDNFMPFLVRVNSLEGNFIYATRTVLFLRGDGTLVPVAIELSLPELRDGLTTAKSTVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAREVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 11765 - protein, 407 aa, Anabaena variabilis ATCC 29413
MTNMQFSQRLQPLQSNVFADMDKAKALALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFTDIPTDVLARSRMMVLSYPHNPTAAIAPLSFFKEAVAFCQEHNIALVHDFPYVDMVFEDSSNWDQNLSQSPIPNHRSLVPSILQADPDKSVSIEFFTLSKSYNMGGFRIGYAIGNAQMIQALRQIKAAVDFNQYRGILNGAIAALTGPQAGVEAAVSTFRQRRDAFIHALHHIGWYVPTPKATMYIWAKLPSSWSQNSIEFCTQLVKQTGVAASPGAGFGKSGEGYVRFALVHEPSILRTAVERISNFL

SEQ ID NO: 11766 - protein, 463 aa, Streptomyces avermitilis MA-4680
MSRSAHPAGPRHADVLPEGHYSAPAADLNALDPKVWSHTVSRGDDGVVRVGGIDVKQLAEEFGTPGYFLDEADFRERARAWRTAFGHDADVFYAGKAFLSRAVVRWLHEEGLNLDVCSGGELATALSAGMPADRIAFHGNNKSEEEIRTAVEAGVGRIVLDSFQEIVRVAHIAQSLGKRQRAQIRVTVGVEAHTHEFIATAHEDQKFGIGLADGQAAEAVRRALALDGLELVGIHSHIGSQIFDMAGFEVAARRVVKLLAEVRDEHGVELPEIDLGGGLGIAYTSEDDPREPHEIAKALSEIVTRECEAAKLRTPRISVEPGRAIVGPTAFTLYEVGTIKPLDGLRTYVSVDGGMSDNIRTALYDAEYSVALVSRASDAEPMLVRVVGKHCESGDIVVKDAFLPADLAPGDLIAVPATGAYCRSMASNYNHALRPPVVAVHDGEARVIVRRETEEDILRLDVG

SEQ ID NO: 11767 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFEANTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTIFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYELTLIEVVE

SEQ ID NO: 11768 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAAEETTNAAAAEEETTNAAAAVDAS

SEQ ID NO: 11769 - protein, 98 aa, Medicago sativa
METLGGVRDVPGNQNSLAIDGLARFAVEEHNKKQNALLEFSRVISAKEQVVAGTIHHITLEVKDGVNKKVYEAKVWEKSWMNFKEVQEFKLVEDAPAQ

SEQ ID NO: 11770 - protein, 253 aa, Mycobacterium avium 104
MTTLAHTAALVTGASSGIGAATATALAAEGAAVALLARRADRLAELQAEIECSGGTALVVPADVTDAERVAAAVQRTVAEFGRLDILVNNAGLMQSGPATEASLRDWDRMVAVNVQGVLYATRAALPHLVDAAADSPRGVADLVTISSTAGWVARPNTAVYSLTKFGVNAFSEGIRQEVLGKRVRVGVVGPGTVDTEIFGHLSEPSREAFERQTAGMVMLRPQDIADAVLFMVTRDRRVAVNHMLVRAAEQTW

SEQ ID NO: 11771 - protein, 308 aa, Photorhabdus luminescens subsp. laumondii TTO1
MSTTFSNTLLSDILRQVRPLIGQGKVANYIPALAEVPADNLAIAICTIDGQIFHAGDAEKRFSIQSISKILSLTLAMTRYQEQEIWQRVGQEPSGQPFNSLVQLELEKGKPRNPFVNAGALIVCDMLQSRLSAPKQRMLEVVRKLAGCPDICYDSKVARSEMEHSHRNAAIAYLMKSFGNFDNDVLAVLQTYFHYCALKMNCIELAKCFIYLANQGSTIGSEQQILSPRQARQINALMMTCGMYDGSGEFAFRIGMPGKSGVGGGIVCVVPGEFTVTVWSPELDRSGNSLAGCAALELLADRVGRSVF

SEQ ID NO: 11772 - protein, 226 aa, Desulfotalea psychrophila LSv54
MKRLVVLTGAGMSAESGFATFRDSGGLWENYDVMEVASPEGWVRDKGLVNQFYNERRVQLRDSVPNGGHLALAQLEERFEVHIVTQNVDDLHERAGSSRVLHLHGELTKVESCSNSALVYDIGYRQVGLEERAEDGGQLRPHIVWFGEAVPAIEEAVNICLTADIFVIIGTSLAVYPAASLTEYVKAGAPIYLVDPHKPKINHDLDYHFINKRATAGIQELISLLV

SEQ ID NO: 11773 - protein, 83 aa, Haemophilus influenzae
MAEETIFSKIIRKEIPANIVYQDELVTAFSDISPQAKTHILIIPNKVIPTVNDVTEQDEIMLGRLFSVAAKLAKEEGIAEDGY

SEQ ID NO: 11774 - protein, 449 aa, Haemophilus somnus 129PT
MSAIVSLEDFLAKVEQRDGHQPEFLQAVREVFTSIWPFLEKNPKYRSEALLERLVEPERAFQFRVAWTDDKGQVQVNRAFRVQFNSAIGPFKGGMRFHPSVNLSILKFLGFEQIFKNALTTLPMGGGKGGSDFDPKGKSDAEVMRFCQALMAELYRHVGADTDVPAGDIGVGGREVGYLAGYMKKLSNQAACVFTGRGLSFGGSLIRPEATGYGLVYFAQAMLAEKGQSFAGKTVVVSGSGNVAQYAIEKALQLGAKVVTCSDSSGYVYDPEGFTQEKLTALLDIKNVKRGRVKDYAEQFGLQYVEGARPWGVKADIALPCATQNELELSDAQQLIANGVQLVAEGANMPTTIEATDAFLEAGVLFGPGKAANAGGVATSGLEMAQSSQRLYWTAEEVDEKLHRIMLDIHANCKKYGTVEGQENINYVVGANVAGFVKVADAMLAQGVY

SEQ ID NO: 11775 - protein, 136 aa, Debaryomyces hansenii CBS767
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLCAIHAKRVTIQKKDIQLARRLRGERS

SEQ ID NO: 11776 - protein, 132 aa, Brassica napus
  misc_feature (17)..(17): Xaa can be any naturally occurring amino acid
  misc_feature (29)..(29): Xaa can be any naturally occurring amino acid
  misc_feature (32)..(32): Xaa can be any naturally occurring amino acid
  misc_feature (40)..(40): Xaa can be any naturally occurring amino acid
  misc_feature (48)..(48): Xaa can be any naturally occurring amino acid
  misc_feature (50)..(50): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(69): Xaa can be any naturally occurring amino acid
  misc_feature (80)..(80): Xaa can be any naturally occurring amino acid
  misc_feature (82)..(83): Xaa can be any naturally occurring amino acid
  misc_feature (90)..(93): Xaa can be any naturally occurring amino acid
  misc_feature (96)..(96): Xaa can be any naturally occurring amino acid
  misc_feature (98)..(98): Xaa can be any naturally occurring amino acid
  misc_feature (100)..(103): Xaa can be any naturally occurring amino acid
  misc_feature (105)..(105): Xaa can be any naturally occurring amino acid
  misc_feature (107)..(111): Xaa can be any naturally occurring amino acid
  misc_feature (113)..(113): Xaa can be any naturally occurring amino acid
MAYSMLSSAAVVTSPAXATMVAPFTGLKXSSXFPVTRKAXNDITSIVXNXGRVSWMKVWPPVGXKKXEXLSYLPDLTEAXLXXEAYYLLXXXXILXCXLXXXXLXYXXXXXRXRPTPLHFSFPKRSAALPYP

SEQ ID NO: 11777 - protein, 126 aa, Haloarcula marismortui ATCC 43049
MKRTISTADAPDAVGAYSQATTNGSLVFTAGQIPMTPDGDLLDDKPIATQAEQALSNVEAVLASEGLEMSDVLKVTVYLDDIDDFEDMNDTYAGFFDEAPPARSAVEVANLPKGVGVEIEAIATND

SEQ ID NO: 11778 - protein, 297 aa, Zea mays
MVLLLLYHSIWLRVAGAGDSSSTDSPGGSLRRAHRDRGSTMAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 11779 - protein, 167 aa, Aspergillus oryzae
MSLTRQSHRTVDRDEVERLRKRFMKLDKDSSGTIDRDEFLSLPQVSSNPLATRMIAIFDEDGGGDVDFQEFVSGLSAFSSKGNKEEKLRFAFKVYDIDRDGYISNGELFIVLKMMVGNNLKDVQLQQIVDKTIMEADKDQDGKISFEEFTDMVENTDVSLSMTLSQI

SEQ ID NO: 11780 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLRLRVVWTISSLIAASTRHYLLRSIINGHPTLQSLVLTDADGQGTLCMGAKQLEEFRENQLSTSACSNRTQVPACNMKLKYAPYVELPGGMALQGATLVAIKPSPEGSNGSHPNRKEAEGFVFGAFDGPFKAAVKALMKRRTYLLEMNGF

SEQ ID NO: 11781 - protein, 203 aa, Ashbya gossypii ATCC 10895
MQVLFVLAQALLCAFALADPTVTHRVFFDLQHGDEPLGRVVLGLFGDVAPRTVANFVTLAKSQDASAGYINSTFHRVIPNFMIQGGDFTHGTGVGGRSIYGATFEDESFAVKHDKPGRLSMANRGRDTNGSQFFITTVATPWLDGRHVVFGQVLDGMDVVSAVEAVPRNARDVPDISVRIVACGELQDTPADATGATLETDEL

SEQ ID NO: 11782 - protein, 482 aa, Arabidopsis thaliana
MVYHVQRIVNGKEVVVISKIEESDVVSDLSSIGNAAVYTSGIVETQNLKHEDVSDDEIQVSEVQPTDSQDVASVPDDSLSESEKIQQEIAAVTVQAAYRGYLENKANSVVDTHSYLGINKLTGNAFAQKLLASSPNVLPLSLDNDSSNSIWLENWSASCFWKPVPQPKKASLRKSQKKFASNPQIVEAEFARPKKSVRKVPSSNLDNSSVAQTSSELEKPKRSFRKVSTSQSVEPLPSMDNPQVDLEKVKRGLRKVHNPVVENSIQPQLVPQIAVEKPNGSLEESVNAFDEEKEDEVAETVVQQPEELIQTHTPLGTNESLDSTLVNQIEESEENVMAEEKEDVKEERTPKQNHKENSAGKENQKSGKKASSVTATQTAEFQESGNGNQTSSPGIPSYMQATKSAKAKLRLQGSSSPRQLGTTEKASRRYSLPSSGNSAKITSHSPKTRVSNSSGKSGNKTEKTLLSSREGNGKATPVEWKR

SEQ ID NO: 11783 - protein, 647 aa, Brassica napus
MSSAPSPGTGSPPSPPSNSTTTTPPPASAPPPTTPSSPPPPSTIPTSPPPSSRSTPSAPPPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 11784 - protein, 346 aa, Caulobacter crescentus CB15
MKALRYHGARDVRYESMDDPTPQSDRDAIVQVTACSICGSDLHIYHGHGFSEDLGFCVGHEAVGEVVEVGRGVQRLKVGDKVMLPAAVGCGRCRSCLSGVIQTCENGQGACYGLSARLQGSQAEAVRVPAADMNAVPVPDGVSMDQALMMTDALATAWFGARNAEVRPGASVAVIGLGPIGLMAVESAYVMGAHVVYAIDPLPARRALAEEAGAIALHPDEALARVREDTKGRGLDCVIEAVGGEATVDAALRLVRPRGVVSVIGVQQAKRFAFPLERAFGAGLTFRVGTCSVPEELPALFPLVRSGRLRPEKYISHRLPLSDGPEAYRLFESREAGALKMVLTPG

SEQ ID NO: 11785 - protein, 523 aa, Mycobacterium avium 104
MSTVEVSAPEAAPPSPGRWRALLLAAVAACAACGIIYELALLTLSASLDGGGIVATSLIVAGYIAALGVGALLAKPLLAHAALGFIAVEALLGVVGGLSAAALYVVFAFLDGSVGSTWVLAVSTALIGGLVGAEVPLLMTLLQRGRTAGPADAGRTLANLNAADYLGALLGGLVWPFLLLPQLGMIRGAAATGMINLAAAAVVAIFLLRQVVSARQLALALCALAAALALLATLLLRSADVETTSRQRLYADPIIAYRHTPYQEIVVTRRGDDTRLYLDGGLQFSTRDEYRYTESLVYPALGNGARSVLVLGGGDGLAARELLRQPGISRIVQVELDPAVIEIARTTLRAANGGSLDNPRVRVLTGDAMAWLRGPNPDRFDAVIVDLPDPDTPVLGRLYSTEFYTLAARALAPGGLLVVQAGSPFSTPTAYWRTVSTIRAAGYAVTPYHVHVPTFGDWGFVLAQRGDTPPAPKVPPDAPPLRFLDQRVLQAAVVFSGDVGPRPLEPSTLDNPRIVGDMRHGYD

SEQ ID NO: 11786 - protein, 302 aa, Xanthomonas axonopodis pv. citri str. 306
MSLSGIITALATPFGPDGALDLDAWRRLLEQQLHGGVQGLVVAGSTGEAAALSDDEYDTLLRAAAAQVAGRVPVLAGTGLSGTAKTIAQTRRAAALGAQYALVVTPPYVRPTQAGLKAHFLAVADEGGLPVVLYNVPGRTGCDLLPETVAELVGHPNIVGIKEARSEPERVAALVALRSDSFVVLSGDDGSAAHAMLSGAAGLISVASNALPAAYRRLCDLARDGQRDAAAAWDARLSEYHNFCGIESNPIPVKALLQRAGIGHGLRLPLLPLSAAHQPAADRLAADAIALEALSSREMLAA

SEQ ID NO: 11787 - protein, 168 aa, Avena vaviloviana
VMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 11788 - protein, 404 aa, Mycoplasma mycoides subsp. mycoides SC str. PG1
MNYNNKKTLKDIDVKNKTVLVRVDFNVPIQNGVITDDNRIIAAFPTINYLLENDAKIVLFSHLSRIKSKEDKLKKSLAPVAKRLEELLNKQVKFINQTRGQELEKAISSLQSKEIILVENTRFEDVLDDQVVKYESKNNSELGKYWASLGEVFVNDAFGTAHRAHASNVGIASNIKVSAIGFLVEKELKMLFQAVNEPKKPFIAILGGAKVSDKIGVIENLLPKVDKLLIGGGMSYTFLKALGKTIGKSLLEEDKIDLAKHYLEIGKDKIVVPVDTACAKEFADVSPTIFEGNIPDEWDGLDAGPKTIELFKQEIKKAKTIVWNGPVGVFEFKNFENGTKSVCQAIAEQTQNGAFTLIGGGDSASAAINMGFKDKFSWISTGGGASLEFMEGKELLGISAIQDK

SEQ ID NO: 11789 - protein, 436 aa, Photorhabdus luminescens subsp. laumondii TTO1
MRETLMSTTFTPNFTRNNCPNLIPESLGRLPETYGTPLWVYDSETIIQKINLLCQFDVVRFAQKACSNTHILRLMREYGVKVDAVSLGEIERALRAGFCPGQEVSDIIFTADLIDVSTLQRVTELDIPVNAGSIDMLEQIGQYKKGHPVWLRINPGFGHGHSQKTNTGGENSKHGIWYQNLPQAIEKIRHYGLKLLGLHMHIGSGVDYHHLASVCNAMVEQVILCGEDIQAISAGGGLSTPYHQGDERINIAHYFGLWDDARKRIEQHLGHKIELEIEPGRFLVAESGVLMTEVRAVKQMGNRNYVLVDAGFNDLMRPVMYGSYHHISVLPADGRKIEQLPLRETLVAGPLCESGDIFTQVEGGGIAPRALPPVQVGDYLVFHDTGAYGASMSSNYNSRPLISEVLFVNGKPQLIRRRQTIEELLALEEVSCASTS

SEQ ID NO: 11790 - protein, 501 aa, Asparagus officinalis
MTVSITAAVQLFLLLLLLLPLLFVHHKTKPKTKCRSPPGPPPLPVIGNLHQLSLLLHQSLYRLSKIHGPIFKLSLGRVPVLVISSPSLAKQVLKTHDLACCSRASTVSFKEYTYDGCDVAGAPYGDSWRNLRKIFVLKLLSSKKLTSFRLVQEEEIEGMISSIRTRSDTNATVNITEFVVRLANNITFRVAFGYRSEGEYGEKSRFQRLLESGNDTVASFYVGDYFPGLGWLDKMTGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 11791 - protein, 358 aa, Aspergillus oryzae
MIAIGLEGSANKLGVGIMLHPDNGNPPQVLANIRHTYVSPPGEGFLPKDTARHHRAWVVKLVKKALKEAHVSVQDVDCICFTKGPGMGAPLQSVAVAARMLSLLWGKELVGVNHCVGHIEMGRLITGSTNPVVLYVSGGNTQVIAYSSQRYRIFGETLDIAVGNCLDRFARTLHISNDPAPGYNIEQLAKKGKQLVDLPYTVKGMDCSFSGILAAVDGLATTYGLGGEGKDDETDTPIPDADGNGKPTRADLCFSLQETIFSMLVETTERAMAHVGSKEVLIVGGVGCNERLQEMMGIMARDRGGSVHATDERFCIDNGIMIAQAGLLAYSTGFRTPLKDSTCTQRFRTDDVFVKWRD

SEQ ID NO: 11792 - protein, 546 aa, Mycobacterium sp. JLS
MYSTMQDVPLTVAAILRYAATVHGDRTVTTATGNGGYRHATYREVGQQAARLAHALRRLGIEGDDRVGTFMWNNQEHLEAYVAVPSMGAVLHTLNIRLFPEQIEFVAYEAEDRVLIADLSLAPVLAPVLRSLETVHTVIAVGEGDLAPFEESGKRVVRYHEVTAAESDEYDWPDIDENSAAAMCYTSGTTGHPKGVVYGHRSSYLHSMAVCGGNGLGMSFSDKALPIVPMFHANAWGLPYAALMAGADLVLPDRFMDATSLVDLIETQRPTVAGAVPTIWNDVMHHLDQNPGHDISSLRLVGCGGSAVPVSLMKAFEEKFGVQIRQLWGMTETSPVATIAWPPPDTPAEKHWQIRSTQGRPLCGVEARIVDDDGAVLPNDGESVGELEVRGPWITGSYYRNTDDSKFQSGWLRTGDVGRIDPQGYITLTDRAKDVIKSGGEWISSVELENHLIAHPAVREAAVVGVPDERWQERPLAAVVVQEGAQVDADELRNFLADKVVRWWLPERWTFVDEIPRTSVGKYDKKVIRARYADNAYQVADLREHT

SEQ ID NO: 11793 - protein, 413 aa, Coprinopsis cinerea okayama7#130
MLAPPTLGIPQRGKKPILGLKIDKNNTSFELYAGGPSGPPESYMSPGDDARTIRPGPATIQPGGDTGTTTVPASKPGASEPITRIQDLLRDLNLTQPPPTVNPSPGDSILSKIEDPSSTQWSDECFEEISRLGEGAGGAVHKVKDKRNGMIMARKTITTREAPMKQLLRELTIMSSTKHVNIITFYGAYMSPSSSEIKIIMEYCEGGSLESVGKRIRERGAIVGEKIAGRLAEGVLQGLSYLHSKKTIHRDIKPSNILLSKEGVVKLCDFGVSGELILSQAGTFTGTSFYMAPERIQGKEYTIRSDVWSTGISLLELVQNRFPFPPDLPPIELMMYITNSEPPRLEDEPGVNWSEEMKDFIKQALTVDPVDRPTPKDMLEHPWIKNMMKYENTMGRWIAQVWGWSRSKKSRDE

SEQ ID NO: 11794 - protein, 490 aa, Oryza sativa
  misc_feature (114)..(114): Xaa can be any naturally occurring amino acid
  misc_feature (196)..(196): Xaa can be any naturally occurring amino acid
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLEXPTAVKDGEPLPEGLLWLLLTGKVPTKEQVDALSKELASRSSVPGHVYEAIDALPVTAHPMTQFTTGVMALQVESEFQKAYDXKGMSKSKFWEPTYEDCLNLIARLPAVASYVYRRIFKGGKTIAADNALDYAANFSHMLGFDDPKMLELMRLYITIHTDHEGGNVSAHTGHLENPGVSVWPFNALGKVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 11795 - protein, 1016 aa, Shigella flexneri 2a str. 301
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNHEYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPKSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 11796 - protein, 331 aa, Arabidopsis thaliana
MGEKDIPRNLKEEEEEEEENQSEETKSLISSLPSDIDCSGTKLYKYQGCWYDKDILQAILNFNKNFQPQETDIIVASFPKSGTTWLKALTFALAQRSKHTSDNHPLLTHNPHELVPYLELDLYLKSSKPDLTKLPSSSPRLFSTHMSFDALKVPLKESPCKIVYVCRNVKDVLVSLWCFENSMSGENNLSLEALFESLCSGVNLCGPLWENVLGYWRGSLEDPKHVLFLRYEELKTEPRVQIKRLAEFLDCPFTKEEEDSGGVDKILELCSLRNLSGLEINKTGSLSEGVSFKSFFRKGEVGDWKSYMTPEMENKIDMIVEEKLQGSGLKL

SEQ ID NO: 11797 - protein, 479 aa, Oryza sativa (japonica cultivar-group)
MSWSGDYEKYMATAAAVAGTAMVVRGVVSELVPDELREMLRSAARGIRARVSSTHTVVIDETEGLSTNQIYDAARTYLAARINTDMQRLRASRVDDAQGIMITMDQGEEMLDVHDGVEYTWRLVSRDTAAAATAHAAPYGIGGGGAANRRGRSRFEVKSFEVSFHKKHKEKALRSYLPFVIDTAKAMNDKHRNLKMHMIEYDAWTAVDLRHPSTFDTLAMDHSLKHSVMYDLERFVKRKDYYRRIGRAWKRGYLLYGPPGTGKSSLIAAMANYLKFDIYDLELTEVKSNSDLRRLLVGMSNRSILVVEDIDCTIDLQQRDEGEIKRAKPTYSGEENEDKVTLSGLLNFVDGLWSTSGEERIIVFTTNYRERLDPALLRPGRMDMHIHMGYCTREAFRVLASNYHNVENHAMYPEIEQLIEEVLTTPAEVAEVLMRNDDVDVALQVLAEFLKAKRNEPGETKAENKNGNQKINKYEQSMV

SEQ ID NO: 11798 - protein, 484 aa, Oryza sativa (japonica cultivar-group)
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 11799 - protein, 396 aa, Propionibacterium acnes KPA171202
MRHPQRVFSSMRKIMFVIGSMPLTHPSQSADGDPGKKYEVTRLDLGHLHPTRSGLVTIATTVDDDVIISSQVNVGTLHRGDEKLFEVRDYRQIPMLASRHDWTAPFIGETGAAHAIEDAMGITIPTRVAWIRTLLAEFSRITSHFTFLSWVGHHCDDAGLENAIATAIENARRIWQRCSGNRIHPMITRIGGLRIHPESEWQPALGEWLDDANALVTRLRTALDATVGVRGVAVIPTNMIDRYGLSGPVSRASGVDLDTRRRTAVYDELKWPEVVIEPRGDAYSRLATLCNDAAVSSSLCRQILDRLPSLDGPLETRLPTAIKAPRGRTWTTIEALWGRAGYLLESRGSTTPWRMALRTPTFANVQVLEAVLPGTRVDDVEATIASLGWTLGDLDK

SEQ ID NO: 11800 - protein, 501 aa, Asparagus officinalis
MTVSITAAVQLFLLLLLLLQLLFVHHKTKPKTKCRSPPGPPPLPVIGNLHQLSLLLHQSLYRLSKIHGPIFKLSLGRVPVLVISSPSLAKQVLKTHDLAFCSRASTVSFKEYTYDGCDVAGAPYGDSWRNLRKIFVLNLLSSKKLTSFRLVQEEEIEGMISSIRTRSDTNATVNITEFVVRLANNITFRVAFGYRSEGEYGEKSRFQRLLESGNDTVASFYVGDYFPGLGWLDKITGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 11801 - protein, 293 aa, Dehalococcoides sp. CBDB1
METGTFKVKSGLAQMLKGGVIMDVTTPEQAKIAEEAGACAVMALERVPSDIRAAGGVARMADPTIIEQIMKVVSIPVMAKCRIGHFVEAQILESMGVDYIDESEVLTPADENFHVWKHDFKVPFVCGCRDLGEALRRIGEGAAMIRTKGEAGTGNIVEAVRHMRSVMGSVRRVQSMSPDELSAYAKEINAPLELVLELHKTGKLPVVNFAAGGVATPADAALMMQLGADGVFVGSGIFKSSNPSAMAKAVVKAVTHYKDAQILAEISKGLGDAMPGLDIKQIDPDKLISQRGW

SEQ ID NO: 11802 - protein, 232 aa, Zea mays
  misc_feature (9)..(9): Xaa can be any naturally occurring amino acid
  misc_feature (22)..(22): Xaa can be any naturally occurring amino acid
YVSDSSHPXPLMIGRVATGGVXAGCVSEAEWSKVMCWDRHRNNFRSPMGSSRLLDQWRLEESLWSGQKDNEDDEKILEVEAWKPHFRESPRKRGSLVVPTSVENSPQLRSRTGSSSGGSRRKTPFTPARSEYEYYSGYHPNYMANTESYKAKVRSQSAPRQRLQDLPSESGYKRSIQGQYYYYTPAAERSFDQRSDNGIAGYRGVSDGLDRNQSDKSKMYTSFFSSNPLFFQ

SEQ ID NO: 11803 - protein, 320 aa, Arabidopsis thaliana
  misc_feature (133)..(133): Xaa can be any naturally occurring amino acid
  misc_feature (200)..(200): Xaa can be any naturally occurring amino acid
  misc_feature (266)..(266): Xaa can be any naturally occurring amino acid
IHSIDCNGGALEVRHGCCAVSKQYMTSLVVILLFISLSSLSPTSTSHSCDPVEEEEEASSFGYVCHSNLQKCHTFAILRAKPPFYSLADLSRHLGLEADDEYVPKGQLLLIPIECRCNGSIYEASLIKNCVKXDTFRSVSQSLQGLTTCLSIREKNPHISEDKLGDNIKLRLAIRCSCPQEGVSNASFLVTYPVGVRDTXSSLAVRFNTTEDAIVSANNKSGVVPLKPALIPLDHKPEKQGSRKRNPSKKKRSKMKLMIAVSSAIXGVCGLVTLMVFGYLHWKKETQIQTQTQKWISNKDPETRHCSLSIRTTRSKQISF

SEQ ID NO: 11804 - protein, 136 aa, Oryza sativa (japonica cultivar-group)
MARKNLLLLGVFLSALLFFFLDVAHARELAEASESEGKNVKPTGRSGVEDQKWGGAHGGGYGYGGGYGGGGYGHPGYGGGYGGGYGHPGYGGGYGGGYGQGYGCGYGHPGHSGGYGGGGGYGGGGGYGGGHGGGWP

SEQ ID NO: 11805 - protein, 451 aa, Mycobacterium sp. JLS
MARDAAEVEVMAKQLKEDGVRFSIAAYTDLHGNIKGKMVPIDHFVQMAGGSELFTGAALDGLPQDVSDEELSAHPDLDRGFVLPWRKDIALFLSDLYVGGEPFEASTRNILGRQMKAAEELGYVFNLGVETEFFVLEDGPVGPSALSERDTLEKPCYAVPMLLDNFGWLQELVDYMNELGWDVYSFDHEDAQGQFEIDFAYADGLSMADRVSFFRLMANEVARRHGAYVSFMPKPFADRTGSGAHFNMSLAGLDDGHNVFESADDPRAAGLSDIGYHFAAGIVRHAAAICAVIAPTVNSYKRLVRQGSMSGSTWAPIFASCGNNNRTNMLRIPLGGGRVECRAVDSAANPHLAAALLLAAGLEGVREQLELEHFHTDNLYEVDAGEYEKRGLSLLPRTLEEAVDAFEADPFTKQVCGEKLWQSFIDYKRSEWTSYATAVTDWERDRYLKFF

SEQ ID NO: 11806 - protein, 270 aa, Debaryomyces hansenii CBS767
MSEVLDDPFQMDEELPSYKENDSVHKDITPRYDDNEMMNDPSIMNSDKRYIRSKLDQLKINEESTNNTGDDEPTYEEDIDDKFDGTFEPKETQESGDFADEIPQLTPPENFAPVINKIYRSSFPQPSNFPFVKKLKLKSILCLIPEDYPEEHEQFLEKENIKLFQLGMSGNKEPFVKISHNLITEAIKIVLNPANQPILIHCNRGKHRTGCLVGVLRRLQKWSLTIIFDEYRKFAAPKERPMDQQFIELYNEVELEEYAKENSLLPIPWD

SEQ ID NO: 11807 - protein, 349 aa, Aspergillus oryzae
MQLKLPNALAKGQPGILHQYAERLVAFEFTRGNQRKPHSLIFIGGLSDGLWTVDYMTDLVAALQHSEWSVFSLVLSSSYNGWGVGRLGKDIDEIAQCVQYVRDYKKQLFGAGKVVIMGHSTGSQDVMHYLSCPNPRPRHPVLDREIDPLTRTPVDGAIMQAPVSDRESILSVLNDGTERDSPEVMQELYRKAVAHAKENTYEDDDTVETVVPLSVTARIGYPSSTAVSSRRFLSLASPDSPRKPDEDDLFSSDLSDEQLQQTFGVVGSRGLLKSKFMVLYSGRDQSVPPWVNKETLLKRWSTAAGPSWHPKSMIIPNASHALSDPDQAEPRRILAERVIAYLDEVAQEV

SEQ ID NO: 11808 - protein, 1536 aa, Aspergillus oryzae
MADDHRQPEASSNTAANPYNHPVASEHTLGSLNTTSTSETDASADADARWGERNQGDPVSRRGAMEEFEEMRREVTKLSLHRTRSAKDARRRSRAEGRDEEKALEDEQASSTDEYRGGFDLNEFLMGGHLERRTTAGEPAKKVGVAFKNVTVKGVETGASFVRTLPDAVVGTFGPDLYKIICRFVPALHFGKRPPVRDLLHDFSGAVREGEMMLVLGRPGAGCSTFLKTIANDREAFAGVEGEVSYGGLSAEEQHKHFRGEVNYNQEDDQHFPNLTVWQTLKFSLINKTKKHDKASIPIIIDALLKMFGITHTKNTLVGNEYVRGVSGGERKRVSIAETLATKSSVVCWDNSTRGLDASTALDYAKSLRIMTDVSKRTTLVTLYQAGESIYELMDKVLVIDAGRMLYQGPANEAKQYFVDLGFYCPEQSTTADFLTSLCDPNARQFQPGREASTPKTAEELEAIFKQSEAYKQIWNEVCAYEKLLQDTNQEDTRRFQKTVAQSKSKTVSKKSPYTVSIVRQVAACVQREFWLLWGDKTSLYTKYFIIVSNGLIVSSLFYGESLDTSGAFSRGGALFFSILFLGWLQLTELMPAVSGRGIVARHKDYAFYRPSAVAIARVVVDFPAIFCMVVPFTIIVYFMTGLDVEASKFFIYFLFVYTTTFCITSLYRMFAALSPTIDDAVRFAGIALNVLILFVGYVIPKQGLIDGSIWFGWLFYVNPLSYSYEAVLTNEFSNRVMSCAPSQLVPQGPGVDPRYQGCALTGSELGKADFAGSRYLQESFQFTRHHLWRNFGVVIAFTVLYLLVTVIAAEVLSFVGGGGGALVFKKSKRSTKLKAQNGKGNDEEQVQNTGDNAALSRGEAKSSSSGEAMQRLSASDRVFTWSNVEYTVPYGNGTRKLLNGVNGYAKPGLMIALMGASGAGKTTLLNTLAQRQKMGVVTGDMLVDGHPLGTEFQRGTGFCEQMDLHDNTATIREALEFSAILRQDRNTPRQEKLDYVDQIIDLLELEDIQDAIIGSLNVEQKKRVTIGVELAAKPSLLLFLDEPTSGLDSQAAFSIVRFLKKLSQAGQAILCTIHQPSSMLIQQFDMVLALNPGGNTFYFGPIGPEGRDVIKYFADRGVVCPPSKNVAEFILETAAKATKKDGRAIDWNEEWRNSEQNRRILDEIQQIREERSKIPIADKGVEYEFAAPTWTQTVLLTERLFRQYWRDPSYYYGKLFVSVIIGIFNGFTFWMLDNSISSMQNRMFSIFLIILIPPIVLNSIVPKFYINRALWEAREYPSRIYGWFAFCTANVVCEIPMAIVSALIYWLLWYYPVGFPTDSSSAGYVFLMSMLFFLFQASWGQWICAFAPSFTVISNVLPFFFVMVNLFNGIVRPYKDYPVFWKYWMYYVNPVTWWLRGVISSVFPSVDIECASKEATHFDPPPGSTCQQYAGNFVSNIAGVGYLVNPDATEDCQYCPFANGTEYMHTLNVHDGDKWRCFGIFLAFVIINWALVYFFIYTVRVRGWSFGMGYLFGGVGVMIEGVKKVFSKKSEKEQN

SEQ ID NO: 11809 - protein, 465 aa, Candidatus Protochlamydia amoebophila UWE25
MVEHYDLAVVGAGPGGYVAAIRAAQMGLKTICIDKRETLGGTCLNVGCIPSKTLLHSTDLYSTLKQHGLEQAIEVSDLKVNFTKLMERKRNVVKGLIEGIALLFKKNGVIYLKGEAQFLDAHTLQVKNGTHIDEIKANYILLATGSESTSLPHLPFDEKNIVSSTGALNLATVPPRLLVIGGGVIGVELASVYNRLGSSVTIIEMSDRLCPAMDIALSKYLFQILKKQGIEIKLSTKMMTAVLQPNETILTIEQNEQLQNISGEVVLVAVGRRPYTQGLALDKVGIQIDKKGFIPVDGFFRTSQPHIFAIGDLIEGVMLAHRASQEGITVVEWLKGERQSINYLAIPNVVYTNPEVASVGLTEQEASESGLTLLTGTTYFRGNSRARCTDEIEGFVKLIGEKKSGRLLGMHIIGAHASELIAVGTLAIQKQINLKDLAETVQAHPTLSETIKEAALQALGKAVHG

SEQ ID NO: 11810 - protein, 487 aa, Ashbya gossypii ATCC 10895
MSKVTKQSKSHKSSELVSLAEKIKQKALENRKQSREESQATEEANTASETEAAVIEETAEPEEGFSSFRELDLVPELIEACDNLNFTKPTPIQSKAIPPALQGKDIIGLAQTGSGKTAAFAIPILNRLWHDQQPYYACILAPTRELAQQIKETFDSLGSLMGVRTTCIVGGMNMMDQARDLMRKPHIIIATPGRLMDHLEVHKRGFALRKQQFLVMDEADRLLNMKFGPVLDRILKNIPTKVRTTYLFSATMTSKIDKLQRASLTNTVKCAVSNKYQTVDTLVQTLIVVPGGLKNTFLIYLLNEFIGKTTIVFTRTKANAERISGLCNLLEFSATALHGDLNQNQRTGALDLFKAGKKSILVATDVAARGLDIPSVDLVINYDIPVDSKSYIHRVGRTARAGRSGKSVSLVSQYDLELILRIEEVLGKKLPKENVDKSIVLSLRDSVDKANGEVIMELNRRNKEKQTRGKGRRSRTATRENMDKEEE

SEQ ID NO: 11811 - protein, 339 aa, Listeria monocytogenes str. 1/2a F6854
MSKDIDWSNLGFSYIKTDKRYISYWKDGEWDRGKLTEDNTLHISEGSTALHYGQQCFEGLKAYRCKDGSINLFRPDRNAARIQKSCERLLMPHIPTEKFIDAVMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQAAKERNFGDCIYLDPATHTKIEEVGSANFFGITKDDKFVTPYSPSILPSITKYSLLYLAEHRLGLEAVEGDVYIDKLDEFKEAGACGTAAVITPIGGIQTKDDFHVFHSETEVGPVTKRLFDELCGIQFGDVEAPEGWIYKVK

SEQ ID NO: 11812 - protein, 262 aa, Populus tremula x Populus alba
MSPTESSREENVYMAKLAEQAERYEEMVEFMEKVAKTVDNEELTMEERNLLSVAYKNVIGARRASWRIISSIEQKEESRGNEDHVTIIKEYRGKIEAELCKICDGILSLLETHLVPSASAAESKVFYLKMKGDYHRYLAEFKTGAERKEAAESTLLSYKSAQDIALSELAPTHPIRLGLALNFSVFYYEILNSPDRACSLAKQAFDEAISELDTLGEESYKDSTLIMQLLRDNLTLWTSDITDDAGDEIKEASKRESGDGPQ

SEQ ID NO: 11813 - protein, 317 aa, Vigna radiata
MANFPVVDMGKLNTEERGAAMEMIKDACENWGFFELVNHGISIELMDTVERLTKEHYKKTMEQRFKEMVANKGLESVQSEINDLDWDSTFFLRHLPVSNVSENTDLDQDYRKIMKQFAEELEKLAEHLLDLLCENLGLEKRYLKQVFYGSKGPNFGTKVSNYPPCPTPDLIKGLRAHTDAGGIILLFQDDKVSGLQLLKDDQWIDVPPMRHSVVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 11814 - protein, 326 aa, Dehalococcoides sp. CBDB1
MVLLKLSSIYAPINEGLKGVEDEFKLVSESRKKSFPEMAEMLDYILVGGKVLRSALSMLSAMCFGAGIKKVLPLATSSEMLHIATLVHDDAIDKADTRRGRRTVNAVWGLEKAILLGDFLFAHAAETAAETGNMGIVTLFSQTLQIIASGELKQAYASFNPDQSYENYLERISGKTAALFVMATKGGAILADASSSDEEIMRSYGYNLGLSFQIVDDILDFVGNAKDMGKPVGSDLNNGTVTLPALLLMDRYPDNNPIKDMLNATDRIPHVAKAVEMINSSDIIDLSYKEAKRYADLACRNLSQLPKTAARESLYQLAEFIVERKN

SEQ ID NO: 11815 - protein, 108 aa, Triticum aestivum
  misc_feature (75)..(75): Xaa can be any naturally occurring amino acid
MAEEAAANAAKKEEEEFSTGPLSLLLMSVKNNTQVLINCRNNKKLLGRVRAFDRHCNMVLENVREMWTEVPKTGXKGKKKALPVNKDRFISKMFLRGDSVIIVLRNPK

SEQ ID NO: 11816 - protein, 142 aa, Dehalococcoides sp. CBDB1
MERTLLLVKPDGVNRGLSGEILGRMEKLGLKLIGLRMLQMDAVLADKHYAPHRARPFFKDLVTYITSGPITAAVFEGENAVEKMRKAMGATDPAKSEKGTVRGDLGINIEQNTVHGSDSAENAKHEISLFFSESELVNYDRR

SEQ ID NO: 11817 - protein, 357 aa, Frankia sp. CcI3
MDAVMLVGGQGTRLRPLTMSAPKPMLPVAGVPVTAHMLARARDAGIDRVVLATSYRAEVFEEYFGDGSAHGLQLEYVTETEPMGTGGAIRNVAERLHGGPGDPVVIFNGDILAGLDIQALVARHTGTGAAVTLHLTRVVDPRAFGVVPVDDDGRVTAFLEKTPDPPTNLINAGCYVFRRSVIDTIPTGRPVSVERETFPGLLAAGTAVMGYPDDTYWLDLGTPAAFVQGSRDLVTGRMASPALPGPVGDCLVLPGAVVAADAKIGGGATVGAGAWVGAGAAIDGAVLFDGAVVEAGAVVRDSVIGRDAVIGSGVALDGVVIGDGVRIERGNELRSGARVFPGVVLSAGAVRFSSDRT

SEQ ID NO: 11818 - protein, 260 aa, Salmonella typhimurium
MSERFQNDVDPIETRDWLQAIESVIREEGVERAQYLIDQLLSEARKGGVKVAAGAGASNYINTIAVEDEPEYPGNLELERRIRSAIRWNAIMTELRASKKDLELGGHMASFQSSATIYDVCFNHFFRARNEQDGGDLVYFQGHISPGIYARAFLEGRLTQEQMDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINC

SEQ ID NO: 11819 - protein, 457 aa, Agrobacterium tumefaciens str. C58
MLSNSLIELDRAHLVHPVSSFRGHEKLGVRVLKSASGATVTDMTGHQLIDGFAGLWCVNAGYGHDSIVEAAAKQMRELPYATAYFDIGSEPAIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAAPARKVFDRAWENGLIVRAFANGILGYAPPLCCTDGEIDAIVERTLKTLDQTLEDPAVRAAMA

SEQ ID NO: 11820 - protein, 641 aa, Oryza sativa (japonica cultivar-group)
MHARCAFRLTRLRREPDAEPGRAGKQGKSVCAAKVHEGGAGAGDAQMGTYKCCIFFTRRFALSDASTPGDVRMLFTRHAGGAPYMGIDELRRYLAASGEAHVDADTAERIIDRVLQERSRTPRFGKPSLTIDDFQYFLFSEDLNPPICHSKEVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 11821 - protein, 198 aa, Zinnia elegans
MAAAATRFIKCVTVGDGAVGKTCMLISYTSNTFPTDYVPTVFDNFSANVVVGDSTVNLGLWDTAGQEDYNRLRPLSYRGADVFLLAFSLISRPSYENISKKWISELRHYAPDVPIVLVGTKLDLREDKQYLSDHPNVTAITTSQGEELKKSIGAAVYIECSSKTQQNVKAVFDAAIRVVLQPPKLKKKRSKQRLCVYL

SEQ ID NO: 11822 - protein, 197 aa, Zinnia elegans
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFVDHPGATPITTAQGEELKKTIGAPEYIECSSKTQLNVKQVFDAAIKVVLAPPKAKKKKGKAQKACSIL

SEQ ID NO: 11823 - protein, 134 aa, Oryza sativa (indica cultivar-group)
MDKGDVAVAVPPSIAGASSSGAKKGKRFEIKKWNAVSLWAWDIVVDNCAICRNHIMDLFSFGRDMALVEYVEFIFHKEFMSGFPSSYDLSKRITGMWVGEGGSLQPCIPLPLHQPLAQDPSSVPSRLVALENAT

SEQ ID NO: 11824 - protein, 98 aa, Arabidopsis thaliana
  misc_feature (56)..(56): Xaa can be any naturally occurring amino acid
NPVFSPKKSKRFEIKKWSPVALWAWEIVVANCAICKNPTMDFCIEGQANQASAPNXKCPVAWGVCNHPFPFPCISKWVKTRQVCPLDNSEWEFQKNGP

SEQ ID NO: 11825 - protein, 275 aa, Zea mays
MALALPLARLVPACQCQAWPHLRFRKRHVSFAAHASSRAAFAACAAAPALQVQAPEAEAEAETVEQVGPKTRLVAQNIPWDCTADEMRALFESHGSVVGVELSMYSANKNRGLAFVTMGSEEEALAALTHLNSTILNDRKIKVDFARPRKKQPKQPAVVSDATEKYVVFVGNLTWRVRNRHLRELFASAPGVVSAEVIFHTTTPRRSAGYAFVSFSSKESAGAAISAFNGKILMGRPINVMFKDENGEKNESSSVPKKAEVEPSDGQSDKLSMNC

SEQ ID NO: 11826 - protein, 462 aa, Trichodesmium erythraeum IMS101
MTLPDGPSLSPLQRRLRTWKFIFSPLSAIEERYSEYGDIFRTNTNSLYPFIYFCNPKAIQQIFTADPDTFTSGSINGILKYFVGLNSLLLQDGDRHKRQRKLLMPPFHGDRMRKYGDLIYNITSNVISQWKIEQPFPIRKSTQEISLKVILAAVFGLDQEGKSYEKLRVLMSDLLDSMSSPLSSTFLFFNFLRKDWGPWSPWGRFLRKKQELHELIIAEIQTAKKEGNHRDDILSLLLEARDEAGNAMSDEEIKDELLTMLFAGHETTASALAWALYWIDMIPSVGEKLMAELATIPSNSDQVAITKLPYLSAICQETLRIYPIAMNAFPRVVQKPIEIMGYQLEPGMVAIVPIYLTHHREDIYPEPKKFKPERFLERQFSPYEYLPFGGGSRRCIGSAFALFEMKLVLATILSQWELKLLPNQRISPVRRGLTMAPPANMRMVVKPKKSWQKVSQPILTSG

SEQ ID NO: 11827 - protein, 175 aa, Triticum aestivum
MATAEAGEKKMIMLKSADGEEFEVEEAVTMESRTIRHMIEDDCADKGIPIPNINSKVLSKVIEYCNKHVLAKTVDVSSGATCATASDTMAPAALAEDLKIWDAEFINVDPDTLFDLIKAASYLNIKGLLDLTCQTAADMISGKPPEEIRNFFNIQNDYLPEEEEKIRRENPWAFQ

SEQ ID NO: 11828 - protein, 604 aa, Glycine max
  misc_feature (251)..(251): Xaa can be any naturally occurring amino acid
  misc_feature (280)..(280): Xaa can be any naturally occurring amino acid
  misc_feature (306)..(306): Xaa can be any naturally occurring amino acid
  misc_feature (329)..(329): Xaa can be any naturally occurring amino acid
MPTVSVGRDRLYAALGKTYTQEEFEDLCFSFGIELDDVTTEKAIVRKEKHLDEEEADEDEEVIYKIEVPANRYDLLCLEGLAQALRVFCEFQEIPTYRLSNISKDAIQKMHVKPETSLIRPYVVCAVLRGITFDKVRYSSFIDLQDKLHQNICRRRTLVAIGTHDLDKLEGPFTYEALPPSSITFTPLKQERNFRADELMEFYKSDLKLKKFLHIIEDSPVFPVIYDSKRTVLSLPPIINGAHSAITLETXNVFIECTATDLTKAKIVLNTMVTAFSEYXENKFVIEPGEVISSDGKIKHIPSFLXQQCGTNISNLVHYRLIGSLEASXVTKYLNRMQLHAKQSASHNKQCNIVVSVPPSRSDVLHPCDVMEDVAIAYGFNAIKDKAVVDNKGSKRLAASLTLLPLNELSDLIRKEVALIGFTEVLTFILCSKKENFAMLNRKDDKSKAVIIGNPRSSDFEAVRTSLMPGILKTVAHNKDHPKPIKIFEVGDIAVLDEQRDVGAKNLRQLAALYCGANAGFEIIHGLVDRVMEKNGVPFVSPGDKSGYYIERSDEPEFLAGRQARIIYKGKHIGTFGIVHPEVLNNFDIPDPCSFVELNIESFL

SEQ ID NO: 11829 - protein, 525 aa, Cucumis melo
MASSMAAVGVLRLPTSSSSSSSSSNGGTNRARRTSLRSLSFGASQISGDKIDFRGFGLGSRRVSGGRVAPSIVSPKAVSDSKNSQTCLDPDASRSVLGIILGGGAGTRLYPLTKKRAKAAVPLGANYRKIDIPVSNCLNSNISKIYVLTQFNSASLNRHLSRAYAVIWWLQNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPVPDFTFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGENVKIVNGDNVQEAARETDGYFIKSGIVTVIKDALIPSGTII

SEQ ID NO: 11830 - protein, 504 aa, Xanthomonas axonopodis pv. citri str. 306
MTQTNGFDALHAHAQRLRGAAIPALLAAEPERPTQYARQVGPLYFNFARQKYDRAALDALFAIARERDLSGAFQRLFRGEQVNVTEQRAALHTALRGDLTDAPVASEAYATAEEVRQRMGSLIQQLEATDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHTALMANVLAQTEALANGQDSSDPHRSYPGGRPSTVILLDALTPQALGALISMYEHSVYVQSVMWGINAFDQFGVELGKQLASQLLPALKGESVDVADPVTRELLNKLRG

SEQ ID NO: 11831 - protein, 505 aa, Vinca major
MAIVDFLAAFLIFILTQKLIQTLFRRTYRRKLPPGPKGWPVIGALPYLGTMPHTSLAYMAKKYGPVMYLKVGTNDMVVVSTPDAARAFLKTLDINFSNRPPNAGATHLAYGAQDMVFAHYGPKWKLLRKLSNLHMRGGKALEDWSNVRISELGHMLETMYESSKKGEAVVVAEMLTYAMANMIGQVILSRRVFVTKGSDSNEFKDMVVELMTSAGLFNIGDFIPSIAWMDLQGIEGGMKRLHKKFDVLLTKLLEEHKESSSKRKGKPDLLDYVLANRDNSEGERLTTTNIKALLLNLFSAGTDTSSSIIEWALSEMLRNPSILKRAQHEMVQVIGRNRRLVESDISRLPYLQAICKETFRKHPSTPLNLPRIATEACEVNGYYIPKGTRLSVNIWAIGRDPDVWENPLEFNPDRFLSGKNAKIDPRGNDFELIPFGAGRRICAGTRMGILLVEYILGTLVHSFDWNLPSSVTKLNMDESFGLALQKVVPLAALVTPRLPINAYSP

SEQ ID NO: 11832 - protein, 525 aa, Cucumis melo
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 11833 - protein, 178 aa, Triticum aestivum
  misc_feature (149)..(149): Xaa can be any naturally occurring amino acid
  misc_feature (161)..(161): Xaa can be any naturally occurring amino acid
MLQTLKVRITNFLDERSAYLTKFTKDADTEFDMIGQNAMKELDQIGDQIMERLDSKMQSYEETADMQRQEIEMNERVLEDFEDWIEEEKNEGMFFKSLGKVKKPPNNEEIKVMARIEAQKVPEITKENAGPKARMNIYLALMAILSLTXANAVFCTPEVEXRKVAAPGLIFIGRVPRS

SEQ ID NO: 11834 - protein, 518 aa, Cucumis melo
MHKISSQEKNQCFGFWGDSSLGRNGRWKQIQRNASSRNNSDSSSSSRARSLHPELLILFSCSEVNEETTTLQAPIFEAPRADPKKVASIILGGGAGTRLFPLTSQRAKPAVPIGGCYRLIDIPMSNCINSGIEKISSNAVNSFSLNRHLARIYNFGNGVNFGDGFVEVLAATQTSGETGKKWFQGTADAVRPFIWLFEDAQTKNVEHTLILSGDHLYRMDYMDFVQRHIDTNADITVSCIPMDDSRASDYGLMKIDDTGRIIHFSEKPKGSDLEEMQVDTAVLGLSDEDARKNPYIASMGVYIFRTDLLLKLLTWSYPACNDFGSEIIPAAVKDYKVQAYLFNDYWEDIGTVKSFFDANLALTEQPPKFEFYDPKTPFYTSPRSCPPSKVEKCRIVDAIISHGCFLRECTVEPLIVGVRSRLEYGVELKDTMMMGAYYYQTESEIASLLAEGKIPIGIGENTKIRNCIIDKNAKIGRNVVIANTDDVQEADRPEEGFYIRSGITVTLKNATIKDGTII

SEQ ID NO: 11835 - protein, 228 aa, Zea mays
MSSSPSPANRRPRGPLALGLESSANKIGIGVVSLSGDILSNPRHTYVTPPGHGFLPRETAQHHLAHLLPLLRAALAESGVAPADLACVCYTKGPGMGGPLQVAAAAARALSLLWRKPLVAVNHCVAHIEMGRAVTGAVDPVVLYVSGGNTQVIAYSEGRYRIFGETIDIAVGNCLDRFARVLELSNDPSPGYNIEQGMDVSFSGILSFIEAAAIGKLKNNECTPADLC

SEQ ID NO: 11836 - protein, 436 aa, Propionibacterium acnes KPA171202
MTSNAELFSAAQAVIPGGVDSPVRAYGSVGGVPRFIEKAQGPWIWDAEGTRYVDLVCTWGPALLGHARPEVVSAVQVAASKGLSFGAPTRTETELADAIIERMAPVEKVRFVSTGTEATMTAVRLARGATGRDVIVKFAGNYHGHSDVLLAAAGSGVATAGLPGSAGVPAASTADTIVVDYNDVAALDAVFSERGDQIAAVIVESCPANMGVVPPEPGFNAAIRRLTTEHGALMITDEVLTGFRCSPSGFWGLQQQAGEDFAPDIFTFGKVVGGGMPLAALGGHADVMDLLAPTGPVYQAGTLSGNPLATVAGVKTLQLADAEVYQRLDVRSEKWRNELESALDAAGVTYRLQNAGNLFSVFLGVDSPVRNYDNAKSQNAEAYTAFFHAMLDAGVNLPPSCFEAWFLSDAHDDEAFEVFRAALPRAAQAAAQVISA

SEQ ID NO: 11837 - protein, 412 aa, Rubrobacter xylanophilus DSM 9941
MPQTLAIVGAGPAGGSAAAALRREGFEGRVILIGAEPHPPYERPPLSKEYLRGETSFEQALLQPSGFYRENGIEAWFGVRATRVDAARREVELENGERLAYDGLLIATGARNRRPAIPGLGLGGVHQLRTVADCDRIRQEIAPGRRAVVVGMGFIGSEVAASLRQSGVEVTVVDRNEVPLRRALGREVGRVIEELHRDHGAELILEDAVAAFEGRERVERVTTRGGRRIGCDFVVVGLGAEPVTDLLAETGAKIQNGIVVDEHCRTSVEGVYAAGDVANHYHPTFGRHIRTEHWQNALRQGSVAARSMLGKKSAPYEEIPWFWSDQYGHNLQYAGLHTEWDELVVRGSMRERDFLAFYRKDGRVLAAVAIGRGRELRRSIPLIKARERVEAAKLRDPDVDLRALAGAAGSRR

SEQ ID NO: 11838 - protein, 145 aa, Arabidopsis thaliana
MQENLYANLLVQQSRYFHATHKYRCHLASTQKVELTCLADLEFDRINPYDVSSRINRMVLPEFGLQGLLCLYYILTGHWFMAVLSLPHLFYNIRLYMKREHLADVTELYNTNKWEQKKRVYKIGHIALSIFITTYWLIHSALGDI

SEQ ID NO: 11839 - protein, 135 aa, Brassica napus
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPGAC

SEQ ID NO: 11840 - protein, 486 aa, Agrobacterium tumefaciens str. C58
MMQGLKDKELFRQTGLIGGAWKAAASGKVVDVIDPATQAVIGTVPDMGGAETRAAIEAANAAFGPWKKKTHAERAALLEKWFALMIENIDDLRLILTIEQGKPLDEAKGEIRYGASFVKWFAEEARRIGGGTIPSPTPDRRIVVLKEPVGVCGIITPWNFPNAMITRKVAPALATGCTVVIKPSEFTPYSALALGVLAERAGIPAGVINIVTGMPTEIGNEIMANETVRKISFTGSTRVGSLLMRGAADSVKRLSLELGGNAPFIVFDDADLDLAIEGAIVSKFRNGGQTCVCANRILVQSSVYDAFAKKLADRVDAMRVGPGTEAGVSIGPMINKPAIAKIRAHIDDAVAKGATIITRPRDLPEGPQYTAPVVLTGATTAMQLASEETFGPVAPLFRFETEEEALAIANGTPFGLAAYFYTESLKRAWRVGEALEFGMVGLNTGAISTEVAPFGGVKQSGLGREGAQVGIEEYLETKTFHIGGLA

SEQ ID NO: 11841 - protein, 371 aa, Agrobacterium tumefaciens str. C58
MDGTPISPTARAKASSSDCNRGILLKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVLAALA

SEQ ID NO: 11842 - protein, 629 aa, Aspergillus nidulans FGSC A4
MSAAKIEPGSFNIPVGTFPATCKTPQESINAHALATSILSRLNTALSTSKISDIAALFLEQGSFWRDHLCLSWNFHTAKGREGIASLLSQVEKEKLNHLKLEIDISTPFRSPQISAIDAFGEVIGVQFFITVSTAIGSGRGVVRLAEGDEGEWYIYTLYTVLQELTGHEEQVSSRRPFGAVHGEISGRPRLNWQDRRKAETNLDENKEPAVLIVGAGQAGLSVAARLRMLGVDALIIDQEDRVGDNWRRRYHQLVLHDPVWFDHMPYLPFPSNWPVFTPKDKLAEFFECYVKLLELNVWTRTTVKEAKWHADGKEWSVEVIRRTDSGEVKRVLHPRHIIQATGHSGEKNLPEFKGIESFKGSRICHSSEFEGATDADPRKGQQKAVVVGSCNSAHDIAQDYYEKGYDVTMVQRSSTCVISSDAIVNIGLKGLYEENGPPVHDSDVFLYSIPSEQFKAQQVRITAVQNEHDKVLLEGLEKAGFKVDKGPDDAGLLMKYWQRGGGYTIEVGAGRLIADGKIKVKQGEEIAEILPQGLRFADGSELEADEIVFATGYKNMREQTRLIFGDMVANSVNSVWGLDSEGEMRTIWRKTGHPGFWFMGGNLAMCRYYSLLLALQILGIERGLNEVQ

SEQ ID NO: 11843 - protein, 436 aa, Oryza sativa (japonica cultivar-group)
MSAAAASSAAGDSAKQPLLHHQRGNPPHVASVSSPSLPSAPPGALAGGRRFPGGLDVPNLKKRGGGTRSWIRVEAATASVQTLEVDKATMMRRCELPARDLRLLDPLFVYPSTILGRERAIVVNLEQIRCVITADEVLLLNSLDSYVLQYAAELQRRLLQRAEGDELPFEFRALELALEAACSFLDAQAAELEIEAYPLLDELTSKISTLNLERVRRLKSRLVALTRRVQKVRDEIEQLMDDDGDMAEMYLSEKKLRTEASFYGDQSMLGYNSVGDGTSFSAPVSPVSSPTESRKLEKAFSLCRSRHDSVKSSDNTATEHIQELEMLLEAYFVVIDSTLNKLTSLKEYIDDTEDFINIQLDNVRNQLIQFELLLTTATFVVAIFGVVAGIFGMNFETSVFSIQNAFQWVLIITGVIGAFIFCGFLWFFKYKRLMPL

SEQ ID NO: 11844 - protein, 559 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIASGGGRMNVTMDRYENDWSVVKRGWDAQVLGEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 11845 - protein, 686 aa, Prochlorococcus marinus str. NATL2A
MGKVKVGSAWPLGSSVTLDGVNFSIAAPHATNLELLIFQNEDDEYAKETISLDQKNRSGDYWHVEIEGLAEGTLYGYKVSIDGQKAAEDHLVLDPCARAITGWKNYIRNHKEKVNRGYAHCLKGVVTKRDYFDFKSHPRPKHSWNKTIIYELHVGGFTKSNDSSVSERKKGTFLGLIEKIPYLKSLGITTIELLPVFAFDSNDAPEGLVNYWGYSPINWFTPHQDFVDSCNPLEARRQFKKLVEVCHDNELEVLIDVVYNHTTEGNQNGPNISWKNFGPKTYYHQDDKENYQDVSGCGNSIAANRPLVRKLILESLRCWAIELGVDGFRFDLGIALSRGENLIPLDKPPLFEEIEADPKLSDVKLISEPWDCGGLYKLGDFPAKQFRTWNGHFRDDIRRFWKGDKGTIWPLKDRLIGSKSLYKDNNLANIFSINFITSHDGFTLKDLVSFNKKHNLANGENNRDGENNNNSYNYGVEGPTTDKEINNLRQKQQRNLLATLLLSPGVPMILMGDELGRSQGGNNNTWCQDNPLGWMDWNHNNWDHDLKEFVLKLISLRKQLSEFFSPDSIYDCQKDNTKVKTSYFWIQWHGIKVNKPDWGDWSHTLGFSINKNNDGSAIWLGFNAYKESMLFDLPTPISPWKKYIDTSILKTKNVSKKTLANQSNVRIESNSLVLMVSSEYSKKIKL

SEQ ID NO: 11846 - protein, 473 aa, Citrus sinensis
MAGLTLVYDLVLYISISTVIFFIIKRSRSRRLRLPPGSLGLPFLGETLQLIAAYKTENPEPFIDVRVKRFGSIFTTHIFGEPTVFSADPETNRFILQNEGKSFECSYPGSVSNLLGKHSLLLMKGSLHKRMHSLTMTFANSSIIRDHLLVVIDRLVRLHMDSWTDRVLLMEEAKKITFELTVKQLMSFDPNEWTESLRKEYVLVIEGFFTVPLPIFSTTYRRAIQARTKVAEALSLVVRQRRKESEPGERKNDMLEALLAGDDGFSDEEIVDFLVALLVAGYETTSTIMTLAVKFLTETPLALAQLKEEHDEIRAKKSKQEPLEWNDYKSMPFTQCVVNETLRVANIISGVFRRAMTDINIKGYTIPKGWRVFASFRAVHLDHDHFKDARSFNPWRWQNNSGATSPVNVSTSFGGGPRLCPGYELARVELSVFLHHLVTRFSWVPAEQDKLVFFPTTRTQKRNPIIVQRRNEN

SEQ ID NO: 11847 - protein, 895 aa, Candida glabrata CBS 138
MEQQGVLAPPSINERNRSLSFSKLLSRSWRKNSTSAVASDNSTDTENNAANPNMIALQKKILSSKTDSWSEAVDDEPVPSGGSQSRFTKLKNIFNNNNSNHNTSNSTRSGSSCASTVSGKSSFEKLPKDISQVRSNSIPSPQKSPYSDKKGHNATSDVEIGLVSPVSDKMNIDLPQVPTSVHASTLTGEHLKELHEYEIAKPKQEAYALNSGKNANRRRSPSTPIKPSPSLVSSQSANGQFSSTNPFNTGTGYANYKERGTVQTTNSYFNYQGLPPHARNENDSNLNAFQNGSKYAAVQEMLSLPTTPSSMNTSLTTHNKEGRNLSNVSLNEIKENEEVSEFYGMDEVPNLDSMGNKKMASSSPLRARSGSPKASNVMDSAQPFPSIVVGYDDADAETDEQSANPSRGSHISSEQKGKPELNPPKNAKFPLRRAASETDAIDLNILKSVKAASGDLSDTTDQHTKLEEIKEPRRSSRLRNKSFSNKFQDITVGPQSFEKIRLLGQGDVGKVYLVKEKRTNRLYALKIFSKSEMIKRKKIKRILAEQEILATSNHPFVVTLYHSFQSEDYLYLCMEYCMGGEFFRALQTRKSKCISEEDAKFYASEVTAALEYLHLLGFIYRDLKPENILLHQSGHIMLSDFDLSIQAKDAKVPVVKGNAQSTVVDTKICSDGFRTNSFVGTEEYIAPEVIRGNGHTAAVDWWTLGILIYEMLFGFTPFKGENTNETFSNILKKDVTFPNNNEVSRNCKDLIKKLLIKNESKRLGSKMGAADIKKHPFFKKVNWTLLRNQEPPLIPVLTENGYDFTKLSSNKNKNRANGTEKDSIDEQERIMFEERVEYDDEVSEDDPFHDFNSMSLMKQDNNSLIYGDNNSYGKIAYTPNANRSRSNSHRAFFKR

SEQ ID NO: 11848 - protein, 572 aa, Oryza sativa (indica cultivar-group)
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKDMSKFWSVCWNLRDALSSECHGLMIETLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPELVFFLCSEDVFLCFRLVSTQKLIDLSMQVVGAWCKHMCVS

SEQ ID NO: 11849 - protein, 285 aa, Oryza sativa (japonica cultivar-group)
MAGHIICMKKGPGFNDSQVIKDGMTRSFLDFLPRKPAHAHRLIRSTLPFASAPSAAQPRAPKIPNQPGKAVPTAEIHHGAKLAKLAPRIVQTAKISLSHHEIPKFPRAVSTLHSPKPTSPIRASLNPTAHAALLTTHADRSPSDGSPLPTPPPKSYITSPSPISQYRSTKNRHQKSPIPSSSMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 11850 - protein, 291 aa, Oryza sativa (indica cultivar-group)
MAGTNPKSSTSSSSSAARAFPRFCMIAHLVVCLCAPAYGGGGGAGEDYEQEQEMEVEALQAILMDDIKEIDPSESGLSTTARCFQIVLSPQDDDFDESAYVPVQLALIFAHTEKYPDEPPLLNVKSVRGMKSEDLASLKEKLEQEATENLGMAMVYTLVTSAQDWLSEKYGQNAGDGESEENEAEEEEVIVPHGEAVTVESFLAWRDRFEAELALQRAKLMPESALTAPKEKKLSGRQYFESGRHTMKGASTTADEEEEEEEDIDFDEDFDDDEEDMLEHYLAEQSGKSAA

SEQ ID NO: 11851 - protein, 557 aa, Streptococcus pyogenes MGAS8232
MVLSDIEIANSVTMEPISKVANQLGIDEEALCLYGKYKAKIDARQLVALKDKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGVPREDGYDITVASEIMAILCLSENISDLKARLEKIIIGYNYQGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGGRELAEKVVALAEQDNQFCFVYEEDDSIETKLTKIVTKVYGGKGIRLTPAAKRELADLERLSFGNYPICMAKTQYSFSDDAKKLGAPTDFTVTISNLKVSAGAGFIVALTGAIMTMPGLPKVPASETIDIDEEGNITGLF

SEQ ID NO: 11852 - protein, 670 aa, Candidatus Protochlamydia amoebophila UWE25
MNIQITPGSPFPFGANIQEGKVNFALYAKNIEKISLCLFNENDPLNPFKEIELEPSLNKTGNVWHIAIESLPPYTLYAFRVPVENSNYLLIDPYAKSIYSSPDWGNAKPYSPLGRIIPLTTFDWEGIPSPKLPSKDLIIYEMHIRGLTQDQSSQVSHPGTYLGVIEKIPYLKELGINAVELMPIYEFNESEALQINPKTQQKLVNYFGYSTVNFFSPMNRYASEIQENKTLVEFKTMVKELHRHGIEVILDVVYNHTFEGNQMGPIQSFRGLDKHAYYMIDEQGNYLNFSGCGNTFNANHPIVKEFIIQSLRYWVTEMRVDGFRFDLASILCRSENGTPLNPSPLIEAISHDPILSQTKLIAEAWDAGGLYQVGGFYPGQRWAEWNGHYRDIVRRFIKGTSGHKTAFATALSGSQDLYGWRGTPCCSINFITAHDGFSLADLVTYNDKHNLDNGEENRDGFDHNDSWNCGIEGHSNNKKIVALRERQIRNFLLALLVSQGIPMILMGDEYAHTRDGNNNTWCQDNKLNWFLWDKLLEKQSVFRFFKSLITFRKNYPLLKRDTFLEETDVTWHGQVPFNPDWENDNKFIAFSLNIPHEGPDLYVAFNASHVVLTVTIPPARQGMHWVWLVNTHNVAPGDFFEESCRKRVNSNTLKIPSYTSIALKAEVDRS

SEQ ID NO: 11853 - protein, 174 aa, Oryza sativa (japonica cultivar-group)
MLPSRQRSIFHLGEEGGGAADAEHLGADHGDGHGDHGIISIHQQRLRVVGLQIVLAQTRHHHRQQHGHVVLKQMQMVSPPPAARHRRRRRPCGDFLSACSLCRLELGPDKDVYMYRGEQGFCSEECRWQQIMTDEARERDAMAKKERLGLHHRTPRPQPAAIRGGSPRRLLAVA

SEQ ID NO: 11854 - protein, 83 aa, Brassica napus
MAGTGRSMLLSLLLFAVTLSLLEMYRGWFAASELKTIAGGFVSSFLFLLLLTFIGNYQEASGVRTGWGAVVVAQLVALIVAGT

SEQ ID NO: 11855 - protein, 574 aa, Oryza sativa (japonica cultivar-group)
VFFKAAEREAFLGAPEMQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVAKANANANANAADAGVKVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 11856 - protein, 194 aa, Triticum aestivum
LRAKLPFVLRGVAPLCPACEKFTDEALSYLSQKQSQDKMMEVLHEACSQTFSLEKKCVELVDSYATLLFAKIAEIKPEEFCKRNGLCRDNALLSGVRSESTCVFCHHLMDEVLSKLKDPDAEFEIIQILLKECKKIEGHEQQCKRLVLQYIPLILVNGEKFLEKNDICTIVQACDAGKKTVVGSFSEEGLLRDA

SEQ ID NO: 11857 - protein, 759 aa, Bacillus cereus G9241
MNIPTQTPSLSETMKEWHYALAYEIKHWKTIGGSKISIMNGRFLYTDYESTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHIEKMKNPKNELAYRAFYNPTTYVWGPPGTGKSYNLSRIISAHYQKGKSVLVLAHSNAAVDVLMSEVTKQIEKKKKWTPGEIVRYGYSQHEHIRNHETLLASKLVETTNGSWGEERLYLEETRQDLREKILSYKATSADKKRIQEIESDLRKQKAKIKEVEKEYIENAKVIGATLSKCAIDSLIYERTFDLVVVDEVSMAYVPQIALAASLGKRIVVCGDFLQLPPIAMANHELVRKWLGEDMFYHAGIVESVNKSEAHPNLFMLQEQRRMHADISKFTNSFIYKNRVYDHPSVSERKELARLQPFANEASVLFDTSLMGAFSLKDAASGSRFNIMSGLVAMQMMLIGLLDGVQSIGVVTPYRAQSRFLSTCIREMLQRTKYQNIPVLAATVHKFQGSERDMMIFDTVDSYPQERPGVLFFDHKNHRLVNVAVTRARGKFIQLSDCHYMRKNLSRKQALSQLTAHIERHGDVYDRTTSRQLWERKISKRLRWFMEMNLEEPKWLLKDILAAKRKIIISLPSTKQVDRRVWQALMRTNAQVTVYSDGPVPLKNVKLQRQNKAFPFIIIDDEIFWAGAPLTSQMMFEGSTEFPYVCARLQAPETIGVLKGFLDIR

SEQ ID NO: 11858 - protein, 312 aa, Magnetospirillum magnetotacticum MS-1
MERVNATILSRTGSDVAMIPEVANHLIASGGKRLRPILTLACADLCGYGDGDGAVKLAAAVEFMHTATLLHDDVVDESDMRRGRVAARIKWGNEASVLVGDFLLGQAFRMMVEVGSLRALDILSAAATVIAEGEVMQLTAAKNTETSEDEYLAVIRGKTAELFAAACEVGPVLAGRPEAEQVACRAYGMNLGIAFQLIDDVLDYGGTSAALGKNVGDDFREGKITLPIVLALRRGTDEERAFWRRTLEREELEDGDLEQALAILRRNRALEDTITRAHHYGTMAREALAPLPNGAMKSALLQVVDFCIARAH

SEQ ID NO: 11859 - protein, 449 aa, Oryza sativa (indica cultivar-group)
MKVDDGPGVNGSRWAKMMSTDSWRWCLGLIYIVAVASIWIAASYIVQSVVDEGVSPFLITYICNSLFVIYIPIVEAARYFEDSINNFWTKLKGKDVADLEQSADLESINLLHGSEEGNTASPTRLPEDILASEAVFPVQAELNVADGSKGLDAKGRWTRARVARVSMVVCPFWFLAQLTFNLSLRYTTVTSNTILSSTSSLFTFLVALVFLGETFTWLKLISVLLCMGGTIIVSLADSGSTANTIATNPLLGDVLSIVSAGLYAVYITLIRKKLPDEKEGQGEVSMAQFLGFLGLFNMLFFFPFALFLNFTKLEPFHRLTWEQVGLIVGKGLLDNVLSDYLWAKAILLTTTTVATAGLTIQVPIAAIVDTLTGHAPHLLDYIGAAAVLVGFAGINIPVGTPQGSQQEQETPIVSMVDDPVHLPSDRNATSMVDDPVYLPSDRNATGAVQ

SEQ ID NO: 11860 - protein, 199 aa, Oryza sativa (japonica cultivar-group)
MQLEISPRQRSQQQKEEEGEHQQRAGEEAVGAVFSIEPWVDAAAVLVPPLNFAEVNDGIFRSGFPAADNFAFLLSLKLRSIVYLCPEPYPEENTRFLEQNGIKLHQFGIDGSKHPPQVCNNENIFHCQFWVHEGMNCHGKWSKLELLVNIPEEKIREALKVILAPDWLRRWVPEKVAEMVPNFSFRRVPAFCSGEGEKY

SEQ ID NO: 11861 - protein, 445 aa, Photorhabdus luminescens subsp. laumondii TTO1
MLSIQNQMLQPNYDVVIIGGGQAGLCISHYLQKAGIDHVVLEKESELTHSWCHKRWNNFTLVTPNWQCLLPEHPYQGNDPDGFMKKHEIVAYLDEFIEKTNPPAILNIQVEHVKKVAAHEFVIETNHGTTTAKQLVVAAGGYHTPIYPKLSDTLPNHVKVMHSEEYLNVEQLPKGAVLVVGSGQSGAQIAEDLHLAGKKVYLSTGNAPRCARFYRGKDVVKWLFDMGYYETTVKHHRYSEEVRNSTNHYVTGRDGGRDIDLRKFALEGMQLFGHFDDFKEGQFWFKPNLSENLDLADATYNRINASIDEYLEKNNIATDEPASVYQPVWQPEQEITHIDLAKENMTSVIWCIGFKPDYSWLDLDIFQTNGYPKHDRGITIDPNVTFIGLPWLYTWGSGRFLGIDQDAAYVVQHIEQQISQQNIHMPPTLIKGAKSKIKDKRISQM

SEQ ID NO: 11862 - protein, 209 aa, Zea mays
AGNTAFGLPVTFIAYIYTLIFVTVPSMASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKVKDDKPADLIELEDTQNHRSSESSFVNMTAGAAVDASHRIGTDERQPLLPT

SEQ ID NO: 11863 - protein, 188 aa, Triticum aestivum
  misc_feature (114)..(114): Xaa can be any naturally occurring amino acid
MESSSSSLLLPSSYAGNNKRARDAGLEAEAEAAKRMRPEDLLDLLDDDTDAAAAGDLASVMRSLEEEICADDLTPPQPELGFLLEASDDELGLPPAAGASSSSDDAGGWEPEEXARVFGEQIWSFEDEIEGAYAFGGVAYSPEAAVPAAAAAAEWGDDGFDACLFGFGDESFGPSDLAVLRQETMPSV

SEQ ID NO: 11864 - protein, 557 aa, Oryza sativa (japonica cultivar-group)
MERGDGASSLRTAGGGDAGMTPEESMVRGKQSAIVPFRRSLRLRHNQNSQNAFSMDQNHESSSRRSQKNTVVKLSMRMVSHKDSQKIFCQDSQGIPPRIRVPDLSCKKTQKEELNSNCCEKLARKRKRGTEERMSSSKRQSHKDPKSLSLKCQESTPTNKPRNTSHKKGENNSSSMPQPKFCDGRLMNAERNNKELNGSERRETQCGLNNWTEEQDMALRKAYFTARPSPNFWKKVSKMFSLLTETAVRQTSNKRVPGKSAEECLSRVHADLSTPTPIAPRPRTSKMKFSPLGHFTLSDPKHPNVLEPSFRRRTAKQKSLAAQKTVRHLLKKQCLTDQTQEADHFSIFETSPTVLPVEFSFEDSPGTPNSSGKKLLARLETVKNVGINPAEPSPAVLKPIKNVILHEKYVDRLSRREGTTRPRKKAAGSKALDSVKTQQAGGVKAARNALITEATDFISHFKKMQANPLAHVVEDDEDDEIDAVLYALDQNRVSLLQQESYFSWRLTGHLFGSIQRLLIKRWLRGKLGGWVHGDYTGRFPLEKYTEMIQHMHDCTVP

SEQ ID NO: 11865 - protein, 100 aa, Synechococcus sp. WH 7805
MIFVGGIIGLEPNGKTLVTGGIKEEAEAAFRHVITMLERAGGKRSDIAKCVVLLSDINYFPEMNKVFTSYFPTSPPTRSTIVVPAIPMNAAIEVECTAIL

SEQ ID NO: 11866 - protein, 664 aa, Arabidopsis thaliana
MAACTLHALSVTLFLLLFFAVSPAKAQQPYVNNHQLACEVRVYDNITNGFTCNGPPSCRSYLTFWSQPPYNTADSIAKLLNVSAAEIQSINNLPTATTRIPTRELVVIPANCSCSSSSGGFYQHNATYNLSGNRGDETYFSVANDTYQALSTCQAMMSQNRYGERQLTPGLNLLVPLRCACPTAKQTTAGFKYLLTYLVAMGDSISGIAEMFNSTSAAITEGNELTSDNIFFFTPVLVPLTTEPTKIVISPSPPPPPVVATPPQTPVDPPGSSSSHKWIYIGIGIGAGLLLLLSILALCFYKRRSKKKSLPSSLPEENKLFDSSTKQSIPTTTTTQWSIDLSNSSEAFGLKSAIESLTLYRFNDLQSATSNFSDENRIKGSVYRATINGDDAAVKVIKGDVSSSEINLLKKLNHSNIIRLSGFCIREGTSYLVFEYSENGSISDWLHSSGKKSLTWKQRVEIARDVAEALDYLHNYITPPHIHKNLESTNILLDSNFRAKIANFGVARILDEGDLDLQLTRHVEGTQGYLAPEYVENGVITSKLDVFAFGVAVLELLSGREAVTIHKKKEGEEEVEMLCKVINSVLGGENVREKLKEFMDPSLGNEYPLELAYTMAQLAKSCVATDLNSRPSVTQVLTTLSMIVSSSIDWEPSDDLLRSGSLGN

SEQ ID NO: 11867 - protein, 321 aa, Candidatus Protochlamydia amoebophila UWE25
MKDLNCLSQSMKVFEINLLKQIKEFLYVNQFSKTLMAYMNYFLSIIFLFFINTCEGYIYDLSVCAIFKNEAPYLREWIEYHRLIGVKHFYLYNHDSTDHYDCILEPYIQLGIVELENAINYPDFNGTQVDCYNRCLIKSRGVSTWVAFIDIDEFILPALNVDLAWLLSHYINYAGVALNWRCFGTSQIANLKEDELMISQLVMCSLPDYSANVHVKSIVRPELVVQFCCPHNPVYVPGYYAVDVDKFPQEGPLSQTVKLNQIRINHYWTRDEHFFTQYKKPRRLAWGDSEAQIYLFLKDLNVDRDETILRYISRLKIAIEK

SEQ ID NO: 11868 - protein, 226 aa, Gymnadenia conopsea
MAGILARRSLEVLRARQAAIQAGAAAPALCANIHSFTSHSRHTRLMIKADEEREQIAREISKDWSSVFERSMNTLFLTELVRGLMLTLKYFFEPKVTINYPFEKGPLSPRFRGEHALRRYPSGEERCIACKLCEAICPAQAITIEAEEREDGSRRTTRYDIDMTKCIYCGFCQEACPVDAIVEGPNFEFTTETHEELLYDKEKLLENGDRWETEIAENLRSESLYR

SEQ ID NO: 11869 - protein, 510 aa, Xanthomonas axonopodis pv. citri str. 306
MSADLLKALDLAASNSGTYLGEATWSQATGAGVLQPLNPTTNAVIAEVQATTPEDYELIVQRAQAAFKVWRTTPAPRRGEAVRLCGEALRAHKDALGSLVALEMGKSKPEGDGEVQEMIDIADFAVGQSRMLYGYTMHSERPGHRMYEQYQPLGLVGIISAFNFPVAVWAWNAFLAAICGDICIWKPSNKTPLTAIATMKICNAALKDAGFPDIFFLINDAGTALSEKLVEDTRVPLISFTGSTQIGRVVAEKVARRLGRCLLELGGNNAIILDETADLKLAIPGIVFGAVGTAGQRCTTTRRLIVHASIYDTVLATLVKAYKQLDSKIGDPTDPANLMGPLNSQGAVAQFLDSIAKAKAAGGTVEVGGTAIDRPGNFVLPAIVTGLQNSDAVVQHETFAPILYVMKYSTLDEAIELQNGVPQGLSSSIFTQNLKAAEKFLSAAGSDCGIANVNIGTSGAEIGGAFGGEKETGGGRESGSDAWKVYMRRQTNTINYSDSLPLAQGIKFDL

SEQ ID NO: 11870 - protein, 312 aa, Escherichia coli
FGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNK

SEQ ID NO: 11871 - protein, 496 aa, Streptomyces clavuligerus
MVTAAISGTDEIRARADEALTRCGVDLTAVKATPHGPHPLTGADLFGLRAHTPEDVDRAVEAAHTAFLTWRTTPAPVRGALVKRFGELLTEHKQDLADLVTIEAGKIRSEALGEVQEMIDICDFAVGLSRQLYGRTMPSERPGHRLMETWHPLGVVGVISAFNFPVAVWAWNAAVALVCGDTVVWKPSELTPLNRAACAALLDLAIADAGAPKGLNQVVVGAADVGERLVDSPRVPLVSATGSTRMGRAVGPRVAARFGRTILELGGNNAAVVTPSADLDLTVNAAVFAAAGTAGQRCTTLRRLIVHEDIADTVVERLTAAFERLPIGDPFQDTTLVGPLVNEAAFGRMREAVERATAEGGTLCAGGERQFPDAAPGAYYVRPALVRMPAQTAVVREETFAPILYVLTYRDLDEAIRLNNEVPQACRQGSRTDGAPADDPRCRARRRAGGANCPAVPGRSGTGAGAGGTADRVRTGGTSHRLVRHRRVPDPAVRTS

SEQ ID NO: 11872 - protein, 666 aa, uncultured bacterium 583
MEFDANLIAPALGVLGLLIVFFIYQWIKKQPGGSGAVQKIGEQIHIGSIVFMKREYKMLSMFALVLLVLLYIFLGPASALCFLVGAVASATAGYIGMNTATIANVRTAQAAHEEGSAAALTVAFFGGSVMGLSVAALGLLGLGGLYYFFGEAHSEALHGFAMGASVVALFSRVGGGIFTKSADVGADLVGKLEAGIPEDDPRNPAVIADNVGDNVGDIAGMGSDIFESYCGSMIATIAIASTLSVVALDKLGNQSELMFLPLALASLGLVCSVIGIVFVKMSSNKSPESALRMGTIGSALLFIITSYFLINQLEVSNSIWAAVLMGSVGGIIIGLVTEYYTAGKPIRDIAESGKTGAATVMIKGLAIGMQSVVIPVLMICLIIYVANLFVGLYGVGIAAIGMLATVGMTMAIDAYGPIADNAGGIAEMSGLGEETRKITDSLDELGNTTAAIGKGFAIGAAALAALAIITAYTETVSANSTDFILKLNSAEVLIGLFIGGTIPFLIAALTMTAVGDAAFEMIEEVRRQFKEIKGLLEGTAEPDTAKCIDIATTAALKKMILPGVIAVSAPVLVGFLISPEALGGMLAGALLGCVLMALMMANAGGAWDNAKKHVEKGNFGGKGTDVHTATVVGDTVGDPFKDTSGPSMNILINVMAIVSLVIAPLL

SEQ ID NO: 11873 - protein, 458 aa, Rubrobacter xylanophilus DSM 9941
MAEQTRREGGVHPVDRVLPPGRMIAYGLQHVLAMYAGIVAVPLILATAIGLPQEQVVYIINASFFMCGVATLLQAVGVWKFGARLPIVQGTTFASVTPMILIGEAHGLQGIYGSIIVAGLLTVLAAPYFSKLLKLFPPVVAGSVITVIGISLMPVAINWAAGGAGSEGFGSPGNIGMAFAVLLVILAITRIFRGFVGRIAVLLGLVIGTAAAAALGMADFGTVGEAAWVRANLPFHFGPPEFYLIPIISMTLVMLIVMVETTADILAIGEITEKRIRPDDVARGLRADGLSTAVAGAFNAFPFTAFAQNVGLVRFSGVKSRFVVATGGVILLLMGFFPKLAALVASIPLPVLGGAGLVLFGTVAAAGIQTLSRVDLTDNRNLIIVAVSVAFGIIPAAVPDFYDGFPEAVRMIFESGITAASVAAIVLNLAFNILGRREPEPASTADAATHAPEPEEVL

SEQ ID NO: 11874 - protein, 125 aa, Oryza sativa (indica cultivar-group)
MAAGQRQQQQMMQEGFEDYLPVMAERLGEEGLMQELASGFRLLMDPASGLITFDSLRRNAPLLGLGGMSDDDLRGMLAEGDFDGDGALSEMEFCVLMVRLSPDLMDEPRRWLDDAVAQASQFLFH

SEQ ID NO: 11875 - protein, 198 aa, Triticum aestivum
PTRPAAATSSSAVAVSTPQGVAERRGIPAASFVEDVETYLRQAGLEVNSALAFLQERLQQYKMVEMKLLAQQRELQAKIPDIEKCLDIVATLKAKKALGEALIADFELSEGIYSRAKIEDSDSVCLWLGANVMLEYSCDEANELLKSNLENARASLEVLVGDLHFLRDQQTITQVTIARIFNWDVHQRRSKQSVMKET

SEQ ID NO: 11876 - protein, 512 aa, Dehalococcoides sp. CBDB1
MEIISSVQMRQIEDACLKQGISTETLMENAGRAVAVFARHLLEEQNGCRVLILAGAGNNGGDGLVAGRYLRSWGEKVSIFVPFIDTPKGTTVQGCLEASGDIFAGLAELEEHLADADLVIDALLGTGVNRPLEGIYKEALQMTANVRNTRPEMQVLAVDLPSGLNADTGQADDACLKADFTLSLGIAKQGLFTHRGLELSGAVSVADIGIPPELTTDIQAVLIEKDWAKSVLPVRSPHANKGSFGRVMIVAGSDRYIGAAILAGSAAMRVGAGLVTLALPKSLTGAVASRIPEATYLPLPEVSSGTADNSAARLVLSELGKYDVLLIGPGLGQTGYSARLVTEVLSNLPVGLKVIIDADALNILSAIPDWWLEYKFDAVLTPHLGEMARLAKATTEAVQSDRFGLCQKFACKWGKTLILKGAGTIVTSPQGETLCNPAANPVLASAGTGDVLAGIIGGLLGQGVSLFEAAGLGVYLHSLAAEALRSEIGDAGVLASDLLLKLPVVIKGLKQD

SEQ ID NO: 11877 - protein, 620 aa, Glycine max
  misc_feature (279)..(279): Xaa can be any naturally occurring amino acid
  misc_feature (534)..(534): Xaa can be any naturally occurring amino acid
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQVXSQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKXAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 11878 - protein, 120 aa, Zea mays
  misc_feature (70)..(70): Xaa can be any naturally occurring amino acid
LEFSSTKFKVTAVKLSAISLPPKVCKGLGKGSSKLHRKVLRDNIYGITKPSIRRLARRGGVKRISGLIYXETRGVLNIFLENVIRYAVTYTEHSRLKTVTAMDVVYSFKRQGRTLYCFCG

SEQ ID NO: 11879 - protein, 155 aa, Zea mays
MDFHQMVVAHIASGRSATVAAIRQPIGLADQFGVIQVAEDDPTRIDAFLEKPKDAVGLADSPGEILASMGNYVFNADALVDAVLRDGQVETSNHDMGGDIVPDFVNRGDAGVYDLQRNDVPGSNERDRYYWRDVGTIDSFYDAHMDLIGPVPVFN

SEQ ID NO: 11880 - protein, 169 aa, Zea mays
MAAALWTLLVAVALSAALASNRPVAATATAAAEAANEVLRAHQLPGGLLPAGITAFRHDAATGAFEARLDAPCTARFEVGLRYNATVSGVISPGQIADISGVAAQDLFMWFPVHDIKVDIPSSGVIYFNVGVVKKHLPLAVFDAPPACTPDPLLQVINPSLDPRSFFFF

SEQ ID NO: 11881 - protein, 488 aa, Oryza sativa (japonica cultivar-group)
MAAAAATAAAHLLSTPPSASPVHPPPHARILCAHRTKGVATLSCRASLGPDGSLAGLAAAAAAAPRVEPRGRPYLREHSCLIFPPLRAAAARSPSSSSSAAPSSAPSPRVTYSHFLKLLAQEGFLVVSVPYNVTFDHEAAAREVYERFHGCYGALLSSGLPAAGLSAMDIAELPLYSVGHSNGALLQLLVGSYFSEKIPKANAIVSFNNRPASEAVPYFEQLQGYNFENGEENKPFLVYASAFRSPKGDAWKALFDLAGGLIQVYDQEAMLSLSKFVDQLPSVMNQVTEGVSEFKPTPPENREFCKNSYNVPNTLLVKFSIDAIDDTEIVEDVLKPRVESIGGQIKKVILSGTHLTPCIQALTKTILQDVKWQVGSEYTPADALAQGLKSLALNETRAVPKISDQDWGAWARVFPLGLLSQHLLYNAFNPWSKETYPVSAPSSIKVSVRYQLSSPKPTKPQRTGQAQDLLRLAPVKSDILGTNQDANQ

SEQ ID NO: 11882 - protein, 524 aa, Oryza sativa (indica cultivar-group)
MEKSSELWLLWAVFSSSLVFLYLTIRRRSGAGAGGKPPLPPGPTPLPLIGNLLDLRGGVIHDKLAALARVYGPVMMIKLGLNDAVIISSRDAAREAFTRYDRHLAARAIPDTFRANGFHERSAVFLPSSDERWKALRGIQGTHIFTPRGLAAVRPVRERKVRDIIAYFRDHAGEELVIRQAIHTGVLNLVSSSFFSMDIAGMGSETARELREHVDEIMTVFAQPNVSDYFPFLRRLDLQGLRRSTKRRFDRIFSILDDIVERRLVDRGERGGEGGASSNSSKSKHQYDGGDFLDALLELMVTGKMERDDVTAMLFEAFVAGGDTVAFTLEWVMADLLRNPPVMAKLRAELDDVLGGKDQSAIEEHDTARLPYLQAVLKESMRLHSVGPLLHHFAAEDGVVVGGYAVPRGATVLFNTRAIMRDPAAWERPEEFAPERFLAREGKAPVDFRGKEADFIPFGSGRRLCPGIPLAERVMPYILALMLREFEWRLPDGVSPEELDVSEKFMSVNVLAVPLKAVPVKVIN

SEQ ID NO: 11883 - protein, 387 aa, Oryza sativa (japonica cultivar-group)
MPPPPPSKNRGHVPAPRPPPGKPPGRRMASRDAAERAAFFARREAAAVLRRVLRGDASRRAAGSIKSLVYSPSVRNKRATFALVCQTLKYLPILKEVLASTGVLTSKWKKQEELVFVTAYDILFGQETAASGSVEQLIMLHKDTIMAALEKMCIRRKVRSVEDLVSKKRTVKPKPRFLRVNTLRTSTDSVIEELNKIHKGKASCMVAVALCPEPGWKVIDACAAPGNKTVHLAALMNGEGNIETINGDFLDIDSNDPSYAEVRAILLDPSCSGSGISTERLDHLLPSHSRGNQDDASTSSRIRKLSAFQRKALSHALSFPSVERVVYSTCSIHQAENEDVVSSVLPLASSLGFELATPFPQWRRRGLPVFEGCRCSIPQISTMISPG

SEQ ID NO: 11884 - protein, 448 aa, Corynebacterium glutamicum ATCC 13032
MRFAIIGAGLAGLTAAYEIHKADPTAQIDVLEAGERIGGKLFTVPFASGPTDIGAEAFLAARSDAVEFFTELGLADSLVSPSAAKSQYFAGGALHAFPAGGVMGIPSNPPAGAQDTAFDWTPGQDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQYGADIHLDSFVSAITKDGEGFAIKGGGEGTYDKVILAVPAPTAAVLLRDLAPAAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIATVSAARAEIAAVPGVEAIGAWAGGVGVPAVIADAQAAVHRLLG

SEQ ID NO: 11885 - protein, 358 aa, Triticum aestivum
  misc_feature (61)..(61): Xaa can be any naturally occurring amino acid
FLVAGCFLPATECQSSEKKRRGRWRASPGSGVADDGSYEYEEESVQTARGMKLFTCRWLPXKGQIVKALVFLCHGYAVECSVTMRGTGVRLAQAGYAVYGVDYEGHGKSEGLQGYIPSFDLLVSDTDAFFTAVVASTANTDLPRFILGESMGGAVALLLHRMRPAYWTGAVLVAPMCKIADEMRPHPVVVSVLKLMTNIIPTWKIVPTTDVIDAAYRMQEKRDEIRNNPHCYQGKPRLKTAYELLKVSLNLENNILSKVSLPFLIVHGGDDKVTDPSVSDLLYRSAVSQDKKLNLYPGMWHALTSGESPENIHTVFQDIIAWLDQRSSPKSSSSAAALDLSSEMEQKAKHDEQNFDKQ

SEQ ID NO: 11886 - protein, 437 aa, Corynebacterium glutamicum ATCC 13032
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 11887 - protein, 120 aa, Methanosarcina mazei Go1
MIDFGNLKYENGLIIGIVQDRASKEVLMCAYMNREALEKTVETGIAHFWSRSRQKLWKKGETSGHLQKVKEIRIDCDMDSVLLLVEQVGGACHMGYRSCFYRNLDGEVVGEKVFEPEDVY

SEQ ID NO: 11888 - protein, 130 aa, Oryza sativa (japonica cultivar-group)
MAAVSLRKSNARLPPEVNRVLYVRNLPFNISSEEMYDIFGKYGAIRQIRLGNAKDTRGTAFVVYEDIYDAKNAVDHLSGFNVANRYLIVLYYQPAKMSKKSDVKKKEEEITRLQEKYGLGSKTPSSAPDA

SEQ ID NO: 11889 - protein, 472 aa, Gymnadenia conopsea
MSSPKCFSCAMAIPRFVSSIAFMVIGLAIFVIVASVLLVSSPIFSSFQDYFLSVDHARESQPPILSSFADNRPEMFVSEPRSPKGEPTDLIFKDDSTKEPVSGSDAVNYDVNSTASDANLCDLYHGKWVYDPRGPLYTNISCPLITQMQNCQGNGRPDKDYESWRWKPDQCDLPRFDARKFLELMRGKTLAFVGDSVSRNQMESLLCILCHVDMPKNRGNRRMHRWYFKSTSTTIVRIGSSWLVHKTSEPMAFAPEGVAKVHLDLPDEYFMEFLPEFDVVVLSSGHWFAKPSVYVLNGTIVGVQLWKPPQNALVDTRITNIEAFEMSVETAVEAIAAHPNFTGVAIFRSYSPDHYEGGAWNAGGSCTGKVSPVGELVRNEYTEVMHEKQVSGFGRAVEKAGKKSNLVFMDITEAFGYRPDGHPGPYRSPDPNKKTKRGPHGEPPPQDCLHWCMPGPIDTWNELLPEIISKRF

SEQ ID NO: 11890 - protein, 311 aa, Glycine max
  misc_feature (100)..(100): Xaa can be any naturally occurring amino acid
  misc_feature (286)..(286): Xaa can be any naturally occurring amino acid
  misc_feature (290)..(290): Xaa can be any naturally occurring amino acid
PRRPSVRLFACTASDHVNLTRPEPYGAGVGGLSRDIPETANVKLPCNTTHCQNSSKSKQARPITVGIVLLTIAVSAIGILTFTVYRRRKQKLGSTFDISXDSHLSTDEAIGAYRKNGSPLVSLEYSTGWDPLADSRNFNGYSQEMFQSLRFNLEEVESATQYFSELNLLGKNSFSATYRGVLRDGSVVAVKSISKTSCKSDEAEFMKGLNMLTSLRSDNVVRLRGFCCSRGRGECFLIYDFVPNGNLSRFLDVKEGDGEVLEWSTRVSIVKGIAKGMAYLHAYKAXKPAXLVHQSISAEKVLIDQRYNPLL

SEQ ID NO: 11891 - protein, 145 aa, Pseudomonas putida KT2440
MKTVEQILKTKSQHQTVYTIGPDDSVLDALKLLAEKNIGALPVVEGGQVVGIVSERDYARKLVLKGRSSAATPVREIMSAPVVTVEPKQKLDFCMNLMTDRHLRHLPVVDNGRLLGLLSIGDLVKETIDEQASLIKQMEQYIRGE

SEQ ID NO: 11892 - protein, 434 aa, Oryza sativa (japonica cultivar-group)
MACSFHFVPLLLLLTLLLLISSASRTAALPSMRSSSEDTASNATAAARLRPGKELLKYKRIRALLKKLNKPSLKTIQSPDGDLIDCVPSHLQPAFDHPKLKGQKLLDPPERPKNYNLTIAVSSSSSSRVGEVVVQAWHAAGEECPEGTVAIRRTTEKDLLRASSLRRYGRKPARRNIRRDSTSNGHEHAVGYVNNDNYYGAKASVNVWSPRIGDPSEFSLSQIWVISGSFGNDLNTIEAGWQVSPELYGDSNPRFFTYWTTDAYQETGCYNHNCRGFVQTTNKIAIGAAITPESVYNGRQFDITLMLWKDPKHGHWWLELGPGMVVGYWPSYLFTHLAHHGNMVQFGGEVVNTRPSGSHTATQMGSGHFPGEGFDRAAYFRNLQVVDWDNSLIPAANLKLLADHPACYDIQGGSNSYWGSYFYYGGPGRNVKCP

SEQ ID NO: 11893 - protein, 294 aa, Rubrobacter xylanophilus DSM 9941
MTDTASKTSGRRIVLGHTNYGKSDIRLVKVFRNPGRHEIKELRVDVSQEGDFAAAHVEGDNTGLMATDTMRNTVYALARDRLTGSAEAFGVELVRHFLEAAPRANRVRVSMVEHLWERIEAGGKPHEHSFVRAAGERTAEVVGDEEGNFSVEAGIDDLLVLKTTNSGWAGFLRDRFTTLPETDDRILSTVVTSRWSYGGATDLDFDRLWEGIRRRILETFTDHYSPSVQFTLHRMGRAVLESFPEVERIHFSLPNRHHLLYDLERFGMENPGEVFHADAEPYGLIEGTVERSAS

SEQ ID NO: 11894 - protein, 511 aa, Oryza sativa (indica cultivar-group)
MRITNGLAMVSLVLSSCDLLRLCSDRERPLGGREFATVVCQLASVVYLLSLFAHPDAPATTTGDDDDGQGGSRRARPAAAEPAPMHGHGGGMMEADDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRGCRAISASGGAFSVLLRDAMSRAPAVKLPSAMRAAELKAFAEAPANFELLAAVFNRSSRFGRLQDIRCALAGRNLYMRFSCITGDAMGMNMVSKGVENVLGYLQNVFPDMDVISVSGNYCSDKKPTAVNWIEGRGKSVVCEAIIKGDVVQKVLKTTVEKLVELNIIKNLAGSAVAGALGGFNAHASNIVTALFIATGQDPAQNVESSQCITMLEEVDDGDDLHISVTMPSIEVGTIGGGTCLASQAACLNLLGVKGSNHGSPGANAKRLATIVAGSVLAGELSLLAALASGHLVKSHMMYNRSSKDVAKAAS

SEQ ID NO: 11895 - protein, 111 aa, Rubrobacter xylanophilus DSM 9941
MSGYLTTHVLDTARGRPAAGLEVELFRLADGERRLLKATKTNADGRTDEPLLEGERFARGTYELVFHLGGHFGEAGFLDEVPVRFTVERPEEHYHVPLLVSPYSYTTYRGS

SEQ ID NO: 11896 - protein, 545 aa, Solanum lycopersicum
MELVVDSGVKKMEGEAMRKNQTLICAPIMADSVDQMLILMQKAKISGADLVEVRVDSLKSFNPRPDIDTLIKQCPLPTLFTYSYVLGVGQGILLIRYYKGIGPTWEGGQYAGDEKSRLDALRLAMELGADYIDVELKAIGEFNNALHGNKSAKCKLIVSSHNYESTPSAEDLGNLVARIQASGADIVKFATTAQDITDVARVFQITVHSQVPIIAMVMGEKGLMSRILCPKFGGYLTFGTLEVGKVSAPGQPTVEDLLNLYNFRQLGPDTKIFGIIGKPVSHSKSPLLYNESFRSVGFNGVFMHLLVDDIANFFRTYSSLDFAGFSCTIPHKEAALDCCAEIDPTAKAIGAVNCIIRRPDGKLFGCNTDYIGAISAIEEGLQGSQPSISGSPLAGKLFVVIGAGGAGKAIAYGAKEKGARVVIANRTYERARELAIVVGAEALSLDELSNFHPENDMILANTTSIGMQPKVDDTPISKEALKHYSLVFDAVYTPKITRLLREAQESGAKIVTGVEMFIGQAYEQYERFTGLPAPKELFKNIMSTY

SEQ ID NO: 11897 - protein, 181 aa, Mangifera indica
MAVSSYSASEKLSRAAMLLLFGLLMSHIQTSGAIGVCYGRNGNNLPPQAEVVTLYKDNNIGQMRIYDPDQATLQALRGSNIELILDVPKDKLQDLTDSAKAGDWVQTNVLAYSADVKFRYIAVGNEIRPGDAEAQYVLPAMRNVYNAIAAANLQGQIKVSTAIDTTLLGSSPPPVRGGFQF

SEQ ID NO: 11898 - protein, 122 aa, Brassica napus
MNPRREPRGGRSSLFDGIEEGGIRAASSYSHEINEHENERALEGLQDRVILLKRLSGDINEEVDTHNRMLDRMGNDMDSSRGILSGTMDRFKTVFETKSSRRMLTLVAAFVGVFLVIYYLTR

SEQ ID NO: 11899 - protein, 1210 aa, Oryza sativa (indica cultivar-group)
MGFFFFASRAAARFLGEARIIHPGVSTAALLVAAASGGGLVAYADSAGENASSETSQEAPRKKKVVVLGTGWAGTSFLKDLDCSKYEVKVISPRNYFAFTPLLPSVTCGTVEARSIVEPIRKMLEKKRKDVAFYEAECFKIDASKKAVHCRSAVGTNFDGNGDFMVDYDYLVVALGATVNTFNTPGVMENCYFLKEVEDAQKIRRNVIDCFEKASLPNISEEEKRKILHFVIIGGGPTGVEFAAEMHDFLVEDLVKLYPAIQDFVKITIIQSGEHILNMFDQRIATFAEMKFQRDGIEVNTGFRVVKVSDDLITMKSKSLGETNRRVLATNEWLRVHECDNIYAIGDCASITQRKIMDDISTVFKMADKDNSGTLTLKEINDVLEDICIRYPQVELYMKSMHMLDIRDLIKDAIGDSHKESMVVNIEEFKKALSHVDSQVKSIPATAQVAAQQGHYLAECFNKMDQCKEHPEGTSILGNLHPWVESKLLQSSQATGFPWAIALSGSGTLYMQEDEQYHALESLWTVGSRVKGPNSALQCFNPVATCSSALRQTIRIRDVFHTEIRLRLGAQQQEELLFQMPGHGIHACKIPMEEESIKSGGVTRGQIKGDEMGEAAEEGAVDGSCHGEAAAEALEVLRSMAMASSSLTCSIPQFPAKWQSIKDKLRQLCSGLDSLCGSVGFGVDVGGDEERHGVLVQLVASASATVRSIQAMASQCGDGTYKGGRLRLRSDLDNLSSKLEAHMKQLREMASSGMPSPSQAIVAVRPSADAGAGEKMFYMRDLFSRVRIGGSVQRSQSLATIGELLAEDEVCVKIVAVDIDDGVALLTGFLESSDARLQEEAAGAVAMVASFDSYRGMLVKAGVIAPLVQLLDDAAATAAVAAGGGATAVAKERAAQALRELTENSDNVWAVCAHGGLTTLLHACGDAGSSGKLVASSFAVLRNLSRVEEVKVFMAEQGVVTELVKLSQKKEEARKLGAVELLHAMALDDADVREEAVSMGVIQSLLQLIYPDLPYSYKAREVALAAIWFFCFSSVNSIDDLISSDVLGWLLFYLNNGDYAVLECTLKILRHLSEVSEEYNRMMGRAGYLSALSSLLGAKSCRVREMAAQVLSSLLLLHPNRVIFIQDGDNLNRLLQLLDPAEGKLVAKDLILSAILSLADTNSGRKKIISSEHFSSLKELADTGDFDAKKVVKKLGTNRFQTIFSKIWSV

SEQ ID NO: 11900 - protein, 357 aa, Medicago truncatula
MNDLGCIAQHPRCLSYLCNRHIERPYSEIIFGVGALPSYYTAQVPQFSSPVGLNNITLGEEQQSTQKRKRTRFTPGEDKVLIQAWLIVPKNAAAEANQRVDSFWLRIKNTYNEHRGHFKPRGVSQIKSRWHKLNSIVHKFVGCYKVAFEKKKSGSSESDIMGEAYTLYYQDEGEQFKLEYAWRLLKDEPKWSNTSFEVGGKRTKISASGAYSTTSNLDTPSSCEYNAASPTLLCLTGTEVEERKGKSKSEETSSVVCLCQTGTEVEKGKEKSKSEETSSVNVELIEVKEIPKTKVLVMAEMARVQDEQNKLKEKELNLREREFELEFLFKDISGMKARQQRDHEMLCNVIREKYGIM

SEQ ID NO: 11901 - protein, 367 aa, uncultured bacterium 583
MAQRDYYEVLGVKKGANEAEIKKAYKRLAMKYHPDRNAGDKASAEKKFKEVRKAYDVISDPQKRSAYDQFGHAGVEQQGAGGFGGGNPFGAGGFGDIFGDIFGGGNTKPDNRGPDLRYDLEIDLRQAAEGDTVKIRVPKNDTCDTCSGTGAKPGTSVKTCGNCHGSGQVQMQQGFFAIQRPCNQCHGTGEKIDSPCRTCSGQGIVRKQKTLSVKIPAGVDTGNRIRLSNEGEAGLRSGPSGDLYVQIHVKDHQIFQREGNDLYCEVPIDFATATLGGSIEVPTLDGKLKINIPSGTQTSKLFRLRGKGMPAMRYNGSGDLLCQVKLETPVNLNSKQKQLLKDFSSSCNAKQYPESNSFFGKMKSFFE

SEQ ID NO: 11902 - protein, 425 aa, uncultured bacterium 583
MQIKQIKAREVLDSRGNPTVEADVILNNGVFGRAMVPSGASTGQREALELRDGDKNRYLGKGVTQSVININHEINDALVDMKISNQQDIDQKMIDMDGTETKSRLGANSILAVSLACAHANANNNKQSLFRSFNFSETYQLPVPMMNIINGGEHANNSIDIQEFMIIPAGAPSFKEALRYGAEVFHHLKKLLDQGGFNTAVGDEGGFAPDLSSNEEALKVILKAIESAGYEAGKDIFIGIDAASSEFYNNGTYNLTSEGLKLSNEEFTSYLASWVEKYPIISIEDGMDENDWVGWEMLTKKLSDKVQLVGDDLFVTNSKILAKGIENNIANSILIKVNQIGTLTETFNAMKMASNAGYTCVMSHRSGETEDTTIADLSVATSCGQIKTGSLSRSDRLAKYNRLLRIEEELGDDAYYPGLSTFKHL

SEQ ID NO: 11903 - protein, 688 aa, Methylobacillus flagellatus KT
MSTLKEGRPYPRGAHFDGKGTNFALFSDHASSVTLCLFDAQGESETERVTLKECTNGVWHGYLEGIKPGQLYGYRVDGVWAPAEGLRFNHNKLLLDPYARKLSGQIKWDNALFGYTISDDPDADLHMDERDSAKFMPKAIVVKPDVLTKSPKPDIRWPKTIIYEAHVRGLTMQHPLIPNDIRGTFAALSDSAIISHLQRIGVTAIELMPIHAFAQDRHLLDRNLSNYWGYNTLAYFAPEPSYLGSGALEEIAKTVDALHDAGIEVILDVVYNHTCEGNHLGPTLCWKGIDNLSYYKELPGNPRYYDNLTGCGNALNTSHPKVMQMIMDSLRLWASVYGVDGFRFDLALTLGRNENGFNRDHALFHAMLQDPILTRCKLIAEPWDVGPGGFQLGSFPPGFSEWNGDYRDVTRQFWAGKEGMLSRFASRFAASSDLFNDQHRRPWSSVNFITAHDGFTLHDLVSYNEKHNEANGENNQDGANDNHSWNCGHEGETDQEDILALRAQQKRNFLTTLFLSQGIPMLLAGDELNNSQQGNNNAYCQDNEIGWVNWENADDALIDFVGELARLRKEHNAISRAEFVTGKLNEHGNSDVAWFNVNGEPMSNEDWNDPCNKAMAVKFVPPDKTGHAILVMLNASHVTVPARIPYCDSYDWKLLLDTPLKPIPNQQGEELVLEPRSIYVYEGRLISR

SEQ ID NO: 11904 - protein, 377 aa, Streptococcus mutans UA159
MKIDKYSAILGSAIGFPEMEGLTDTRPLANLPFDGKYRLIDFQLSNLANAGIRSVYGIFRGQNIRSIFDHIRSGREWGLNTLLSHYFLGFYNTPEDSIYADKDYYDQILTYLKRSGSDQTIYMSCDILCNIDLQQVIHLHNANKRNITVVYKKLPINAISAANDILEIDETDTVTGRRDSQSGNETEKMSAGIYIVNTSWLIEQMEKENQKEEPINLRFLLRDLTVAEKALAFEYTGYLANISSIQSYYNANMDMLESQKFYSLLYSNQKVYTKVKNEEATYFAVDSTVKNAQFASGSIIKGTVDHSIISRNCHIANHSRVVNSVVFPKVSIGDGAVVENAILDKNVKIAPGVIIRGTGDKPIVIAKASEVVEDIIQ

SEQ ID NO: 11905 - protein, 406 aa, Pseudomonas syringae pv. tomato str. DC3000
MLFVAFGALVLMPLITGLDPNVALFTAGLGTLLFQIVTGRQVPVFLASSFAFITPIILAKGQFGLAATMGGVMAAGFVYTFLGLAVKIKGTGFIDRLLPPVVIGPVIISIGLAMAPIAANMAMGKTGDGAVLIPYQTAMLISMPALLTTLIVAVFGKGIFRLVPIISGVLVGFALSFYFGVVDTKKIADAAWLAIPHFTAPEFNWQAILFIVPVALAPAIEHIGGVIAVGSVTGRDYLKKPGLHRTLFGDGIATTAAGLFGGPPNTTYAEVTGAVMLTKNYNPQIMIWASFFAITLAFIGKFGALLQSIPVPVMGGILCLLFGSIAAVGMNTLIRHKIDLAEARNLVIVSVTLVFGIGGVLIGTGNGPNDFGLKGIALCAITAIILNLILPGHDSWKHNRPDDQLL

SEQ ID NO: 11906 - protein, 381 aa, Streptococcus mutans UA159
MHMKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 11907 - protein, 391 aa, Oryza sativa
CLAAPRARRRREQRGARRDGRKENAAAAQPRLTRAAAKRAAAVTAVAVAAKRKRVALSELPTLSNNNAVVLKPQPAPRGGKRTASHAAEPKKPAPAPAPAVVVVVDDDEEGEGDPQLCAPYASDINSYLRSMEVQPKRRPAADYIETGRVDVTANMRAILVDWLVEVAEEYKLVSDTLYLTVSYIDRFLSAKAINRQRLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDPDTNPWSKKLQEVTGYRASELKDCITCIHDLQLNRKGSSLMAIRDKYKQHRFKGVSTLLPPVEIPASYFEDLNE

SEQ ID NO: 11908 - protein, 424 aa, Medicago truncatula
MVKGLHSQNLPTDVSQLIDQLERHCLAPDGSLISKPLYNDLQLAREEMCRERLRYLEATAIYSEAIAMVEEYHQAISGSSIGGIRDTGGLYPQFGLRNSPQVYQTLEHQMIVAEAAQRLRLPMISKDGEVHDDEIEKLSVVSRSSLDSASTSGVVNSSINSFNYTTPSSSVSGVNSLASMDPVEPGVGGVPNRFLGITPAYLWQTQRQQTPLSVDMTEYRMSLAREVDGRLKLKCDKLSDAFVLDDNDSFSSGSQSSSSRLPERVKLLIEDIEREEAALRDDLYSADRKFAEYYNVLEQILGVLIKLVKDLKLDHQHKYDELQKTWLCKRCDTMSLKLRALEYQLLHGTYTNESIPALHKIRRYLVEATEEASIAYNKAATRLREYQGVDPHFDDIARQYHDVVKKLENMQWTINQVEDDLKRM

SEQ ID NO: 11909 - protein, 743 aa, Streptococcus mutans UA159
MGRDASFSRFDNFGIVGNLVYESDTFQSQVYLIVKNADWSVRTPDFSINCNPGLSKSEVWIVQGDDTLYYSWQAAVASHAYNQRQPHAFDMAVNSKRFDYEWGFQGWLGFSYQEDKTEFRLWAPTARRVELIIYSSTGEKSSVLKVLKMKRGENRTPDDHTKNTHGVWKRTVEGDLNYHAYRYRVYYRRRIFRDTRDPYSIAVTADGKRSVVIADTDLIPEGFKVKHRQEASWRLSNPNQAVIAEMHIRDFSKSETSGVRHENRGKFLGAFETGTKNLYGDQTSFDYLKSLGINYVQLQPVFDHHQTFNEDGSYAYNWGYDPENYNVPEASFASNPHAPTARILELKQLVQAYHDAGIGVIMDVVYNHTYSSTDSAFQLAVPDYYYRMNHDGSLQNGSGCGNETASEKEMFRKYMIDSILYWIQAYNIDGFRFDLMGLHDVETMNAIRQAVDAIDPNILLYGEGWDMGIGLMPEDKAKKDNAYQMPRIGFFNDDVRNAIKGAEVYGDFKRGFVSGEPTENKIAKGMLGSDELSSYLVPNQVLNYVEAHDNYNLNDLLMELHPEDDKTTHIKRVELANSLGILMQGMAFIELGQEFLRTKLFPTGPDGELTHADKERAMNSYNAPDEVNQIDWNNVTLYKSTVNFVKELIRLKTQEEAFSYQTYEDIRKHVYVESAEYGSGLVIVSISSHDKIFKLIFNVSEKNAKIDMTQDEKYDIILTNIKRFHKLSGQLENLTATVFELKK

SEQ ID NO: 11910 - protein, 88 aa, Oryza sativa (japonica cultivar-group)
MSGRGKGGKGLGKGGAKRHRKVLRDNIQGITKPAIRRLARRGGVKRISGLIYEETRGVLKIFLENVIRDAVTYTEHARRKTVTAMDVV

SEQ ID NO: 11911 - protein, 349 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEIWTNDKYWSAEHRVVVNTTRERYSIPFFLLPSHDVEVKPLEELVSPENPPRYKGYKWGKFYVSRNRSDFRKLEIENIQIDDFKVKT

SEQ ID NO: 11912 - protein, 394 aa, Lactobacillus acidophilus NCFM
MPNLSNDLQSIINNRLNNLSASKIRAFDQKVSSIPGIIKLTIGEPDLATPDHVKDAAINDIQANDSHYAPQAGKPELLDAISNYLDRSIGVHYDPESEICVTVGATGALNDVFMTLLNPGDKILVPTPVWALYFQLIKMTGAIPIQIDTKKDGFVLTPEHLRHVLNGRGKGAKAIILTDPSNPTGRVYPEEILKELAKIIKEYKIYSITDEIYAELVYGDAKHHSLSEYIPEHNILISGLSKAYAMTGWRLGYIAGPKQIMKAIRKVNSFLITSVTDNVQMAAVEALNNGQNDPKEARKIYESRLRFMQTGLEKLGFEMATPQGAFYIFAKIPEKYGTDDENFAFELAQKAKVGVTPGRYFGKGGEGYVRLSYASSTEQLRESLQRITNFVDNL

SEQ ID NO: 11913 - protein, 356 aa, Schizosaccharomyces pombe
MIQYVYLKHMRKLWSLGKVRSTVLRFSTTNRNASHLIKNELEQISPGIRQMLNSNSEFLEECSKYYTIAQGKQMRPSLVLLMSKATSLFHGIDRSVVGDKYTDDDDLRSFSTGQILPSQLRLAQITEMIHIASLLHDDVIDHANVRRGSPSSNVAFGNRRSILAGNFILARASTVMARLRNPQVTELLATVIADLVRGEFLQLKNTMDPSSLEIKQSNFDYYIEKSFLKTASLISKSCKASTILGQCSPTVATAAGEYGRCIGTAFQLMDDVLDYTSKDDTLGKAAGADLKLGLATAPVLFAWKKYPELGAMIVNRFNHPSDIQRARSLVECSDAIEQPITWAIEYIKKRFPSVSP

SEQ ID NO: 11914 - protein, 520 aa, Oryza sativa (japonica cultivar-group)
MAAVSAAAARLHHLLSLCVAVAGLLLMLLGGGEASVHEYRGLGFLNKGNAFILHAGSEGLYAPSSPANATTAEDDEDAAAAAVADAFIRCRFAGIAWAIEDASDLCDERFDKITFRRPKDAAKETGSAMVQILVFEIEDREMIGGSAYGGQKAICCTSDLAKLGACTEGSVIYRPSQVNPGWPQLLFSSFDGSDTIATLPSRIIPITKTGMYNMYFIHCDPSLAGLEIEGQTVWKNPTGYLPGRMAPLKNFFGIMSFAFVVLGIYWFYQYMKFWREVLPLQNCITLVITLGMLEMSLWYFEYAEFNETGVRPKGITFWAVTFGTVKRTVARVIILIVSMGYGVVRPSLGGLTSKVVMLGGTFFLATEILELVENLGAVNDLSGKARLFLVYPVAILDAAFVVWIFISLAKTLDKLQARRSMAKLDIYRKFTIALAVTVLVSIGWIGYEIYFKSTDVFNERWQFTYDASENFDREDSLSLIRPGPIASKNGWSLSSSPDTKATKNVTVTSFDGDDEENKRE

SEQ ID NO: 11915 - protein, 480 aa, Pseudomonas putida KT2440
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAEKLAAAVAKLKIGNGLEEGTTTGPLIDGKAVAKVQEHIEDAVSKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 11916 - protein, 425 aa, Pseudomonas putida KT2440
MSKTNESLMQRRVAAVPRGVGQIHPIFVDTAKNSTVIDVEGRELIDFAGGIAVLNTGHLHPKVVAAVQEQLTKVSHTCFQVLAYEPYVELCEKINKLVPGDFDKKTLLVTTGSEAVENAVKIARAATGRAGVIAFTGGYHGRTMMTLGLTGKVVPYSAGMGLMPGGIFRALFPSELHGISVDDAIASVERIFKNDAEPRDIAAIILEPVQGEGGFLPAPKELMKRLRALCDQHGILLIADEVQTGAGRTGTFFAMEQMGVAPDLTTFAKSIAGGFPLAGVCGKAEYMDAIAPGGLGGTYAGSPIACAAALAVIEVFEEEKLLDRSKAVGERLTAGLREIQKKYPIIGDVRGLGSMIAVEVFEKGTHTPNAAAVGQVVAKAREKGLILLSCGTYGNVLRILVPLTAEDALLDKGLAIIEECFAEIA

SEQ ID NO: 11917 - protein, 375 aa, Xanthomonas axonopodis pv. citri str. 306
MTPILFVDRDGTLIVEPADYQIDAYEKLRLVDHVIPAMLKLRDAGYQFVIVSNQDGLGSESYPRASFDGPNNLMLQIFASQGIEFREVLIDCSWPADNAPTRKPGIGLMVPYLQDRTIDWARSAMVGDRITDIQFAQNLNIRGFQLRTDEFGGEWDWSGIAHELADAPRRALVQRNTKETRIRVELDLDRVAEPKTATGLPFFDHMLEQIGKHGGFALEIRAEGDLHIDEHHTIEDTGLALGQALREALGDKRGIGRYGFDPESSPWRVAGDTPQHGFTLPMDETIASAALDFSGRPYFVFEGEFKRERVGDMPTELVPHFFRSICDASGLNLHLTVRGENDHHKVEACFKALARALRQAIRREGTALPTTKGTL

SEQ ID NO: 11918 - protein, 473 aa, Magnetococcus sp. MC-1
MSAFRAQWVKGRSGNVTQLHYARKGEITPEMEYVAMAEGISPETVRDEVARGRMVIPANVNHPEVKPMAIGIASRCKINANIGNSQISSGLDEEVKKLTDSIKYGADTVMDLSTGKNIKTIRNAILRHSSVPIGTVPIYEVIERVSDVKDLTPEIILQVIEEQAKEGVDYMTVHCGVLMHVLPMVASRITKIVSRGGALMAQWMLHHQQENPLYTHFDQLLEICKRYDVTLSLGDGLRPGCLHDASDEAQFAELKVLGELTKRAWAQDVQVMIEGPGHVPMDQIAMNMQKERELCHEAPFYVLGPLVTDIAAGYDHIASAIGGAIAAWEGASMLCYVTPKEHLGLPNAEDVRAGIIAYKIAAHAADIARHRPGARDRDDEMSRARFGFDWNRQFELALDPERAREYHDETLPEDAHKSAEFCSMCGPRFCAYKLSQEVDAKSKEIAAKFVPGFCPSDKAAGEQGQALPQSVGK

SEQ ID NO: 11919 - protein, 206 aa, Xanthomonas axonopodis pv. citri str. 306
MGSNEVATGDPLATLDWNKGEGLLPVIVQDADNLRVLMLGYMNAQALAVTQQRGEVTFFSRSKQRLWTKGESSGNVLRVVSIQTDCDADTLLVQARPHGPTCHLGRTSCFPSAPGQFLGSLDALVAERERERPHGSYTTKLFEQGIRRIAQKVGEEGVETALAGVVQDDDALLGESADLLYHLIVLLRARGLGLGDAAALLESRHQ

SEQ ID NO: 11920 - protein, 952 aa, Vibrio angustum S14
MKLTKRSDKVSKVENQLGISRRSFIRNTSLAAAGGVAGASMFAPGMMKKAEAASEDVYDAPKVVKRTICSHCSVGCGIYAETQDGVWTHQEPAFDHPFNAGGHCAKGAALREHGHGARRVKYPMKLVNGKWKKLSWEQALDEVSQQVLKIREESGPDSVYFLGSAKHNNEQAYMFRKMVSMWGSNNVDHQARICHSTTVAGVANTWGYGAMTNSLNDMHNCKSMLFIGSNPAEAHPVAMQHILIAKETNSCKIVVVDPRRTRTAAKADHYVSLRPGTDVAFVWGVLYHIFNNGWEDKEFIRQRVYGMDEVREEVAKWNPKEVERVTGVPEDQVYQTAKMLSENRPGCVVWCMGGTQHTTGNNNTRAYCILELALGNMGKSGGGANIFRGHDNVQGATDFGVLSDNLPGYYGLSEGAWKHWAQVWDVDYSWLQGRFDQNTYNGKKPMNSAGIPVSRWIDGVLENKDKIEQRDNIRAMFYWGHAVNSQTRGPEMKTAMEKLDMMVIVDPYPGVAAVMNGRTDNVYLFPATTQFETYGSVTATNRSIQWRDQVIEPLFEAKPDHEIMYLLSKRLGFADQLFKNIKVENNRPHIEDITREFNKGMWTIGYTGQSPERLKEHQQNWHTFNRTSLEAIGGPANGETYGLPWPCWGTPEMKHPGTHILYDTSKTVAQGGGNFRARFGVEHNGVSLLADDSYSLGCELEDGYPEFTAKMLKQLGWWDDLTAEEKVAAEGKNWKTDLSGGIQRVAIKHGCIPYGNAKARTVVWTFPDAVPIHREPLYTPRRDLLPEYQTWDDKAHLFRLPTLYKSIQDKDMSKEYPIILTSGRLVEYEGGGEETRSNPWLAELQQEMFVELNLKDANDRGIKDGEMVWVEGAEKGRIKVKAMVTPRVREGLAFLPFHFGGEFEGESLRSHYPEGCAPYVSGEAANTATTYGYDPVTQMQETKVTLCNITKA

SEQ ID NO: 11921 - protein, 398 aa, Lactobacillus acidophilus NCFM
MLAAIVCALAGMCYAEFASAIPVAGSAYSYGNIVYGEFTGWIIGWALILEYMLSVATVAAGWSSYFSSFISPFGLKIPNAVSGPMNLSKGVYFDLVSVLVILIISILLSRGMKNSIKINIIAVFIKIAIILIFIFVGVQFIKPANYHPFLPYHFSGVIKGATTVFFAFLGFDVVSSSAAEVKNPKKNMPLGIIGTLAIAALLYFGVSIVLTGMVNYKQLNVSNPVAFALQYVHQDWVAELLSFGAMLGMATMMLTMIYSSSRLIYAMARDGLLPSTFSKLDKKHNSPQNALIAVTIIISLGAAFFSVDQLANLVNFGTLFAFTLVSFGILKLRKRTDITNDGFKVPGYPFLPIISGLICIFMICHLSSEVYLMAFIWLVLGAIIYFAYGYHHSQLDHE

SEQ ID NO: 11922 - protein, 237 aa, Vibrio angustum S14
MLFPYKNIVVLTGAGISAESGIRTFRAADGLWEEHRVEDVATPEGYLRDPELVQRFYNARRAQIENGSVAPNAAHIALAKLEQELDGNVTIVTQNIDNLHERAGSKNVIHMHGELLKARCCESGQTVEWQGDLTTSDHCHCCQIPAPMRPDIVWFGEMPIGMDRIHDAIVKADLFISIGTSGNVYPAAGFVHEAALQGAHTIELNLEPSNVENEFEEKRYGKASELVPAYVDEILSA

SEQ ID NO: 11923 - protein, 161 aa, Zea mays
  misc_feature (144)..(144): Xaa can be any naturally occurring amino acid
MCSSMQSSYLPATTESVAKAQEAKDASESISILYRVLEDPSSSADALRVKELAITNLTNYLTKENRAEDLRNLLTQLRPFFALIPKAKTAKIVRGIIDAVAKVPGTSQLQTSLCKEMVEWTRAEKRTFLRQRVEARLAALLVEXQEYTEALTLLSGLIKEV

SEQ ID NO: 11924 - protein, 1227 aa, Brucella suis 1330
MTDNIPVSKVAVFQNFAPPIREQSALRQAITAAYRRPEAECVSALAEQATLPEETRQQIRSTARKLIEALRAKHKGTGVEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPFVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 11925 - protein, 762 aa, Agrobacterium tumefaciens str. C58
MSDTTKTASTRTSVTDQEALDFHAQGRPGKLEITPTKPMATQRDLSLAYSPGVAVPVKAIAENPATAYDYTTRGNMVAVISNGTAILGLGNLGALASKPVMEGKSVLFKRFADVDSIDLEVDTEDADEFINCVRYLGPSFGGINLEDIKAPECFIIESRLRELMDIPVFHDDQHGTAIIAAAGLINAIELTGRDFKTTKLVCNGAGAAAIACMDLIKAMGFNPENITLCDTKGVIYQGRTEGMNQWKSAHAVKTDRRTLTEAMNGADVVFGLSQKGAFTEEMIRSMAPKPIIFAMANPDPEITPEEVSRIRDDAIMATGRSDYPNQVNNVLGFPYIFRGALDVRARQINDAMKIAAAQALADLAREDVPDDVAAAYQGNRPRFGSQYIIPVPFDPRLISAIPVAVAKAAIETGVAQREIPDLDAYARELSARRDPMASTTQRLYERVRRSPKRVVFAEAEEEQVMRAAISFTAQGLGTAILLGRDDIIKANAERAGIDLDRANIEITNARLSSRVDAYVDYLYARLQRGGFLLRDVQRLIHNDRNHFAACMVAMGDADAVVTGVTRNYSTALEDIRRCINTKPGHRVIGVSLVVSRNRTVFVADTAVHDMPNAEDLADIAEEAAHLARRFGYEPRVAMLAYSTFGQPVGERSDKVREAVKILDKRNVNFEVDGEMSADVALNHQRMQSQYPFARLSGAANVLVMPAIHSASISTKMLQELGGATVIGPLLVGLDKSVQITSMGAKDSDIVNMAAIAAYNAGR

SEQ ID NO: 11926 - protein, 264 aa, Lactobacillus acidophilus NCFM
MKDSLRNKVVVITGASSGIGRSIALESAGRGATVILIARRKDRLEEITAEAKELSGAEAYVFPTDMGKPESIEKTFDEITKQVKHIDFLVNCAGFGKFEEFMEQKMQDVTNMFQVNVLGLMYFTRLIGRVMMDQKTGQIINFGSIAGKVPTTKSAAYSASKAAVIQFSNVLRLELKPFGVKVMTVNPGPVYTNFFNVADKTGNYVKNVQEFMLDPDDVAWQVVHFFGSDKRELNLPLSLAVLAKLYNLFPTIGDKISLEFASRK

SEQ ID NO: 11927 - protein, 517 aa, Oryza sativa (japonica cultivar-group)
MGSFARKEHQFLAELGLAPRNPGSFACGAWGGSGPVVTSTNPTNNQARLPPHDPLGSRRSIWFGPPWHFWGVIAEVVEASAREYEEGMRACYDAAKTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRIPLVSFTGSTKVGLMVQQQVNARFGKCLLELSGNNAIIVMDDADIQLAVRSVLFAAVGTAGQRCTTCRRLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATW

SEQ ID NO: 11928 - protein, 394 aa, Pseudomonas putida KT2440
MWYNGLLDLSAWQLVGITLLMTHVTIVSVTVYLHRYSAHRALELNGALKHFFRFWLWLTTAQNTREWTAVHRKHHAKCETPDDPHSPVYKGLGTVLRKGAELYREEARNPETLRIYGKNCPDDWIERNLYSRYKLGGIALMAVIDLLLFGTIGITIWAVQMMWIPFWAAGVVNGLGHALGYRNFECRDAATNLVPWGIVIGGEELHNNHHTYPNSAKLSVKRWEFDMGWAWIRLFCLLRLAKVQRVAPIAHRVAGKASLDMDTAMAILNNRFQIMAQYRKLVIGPLVKQELARVDASVRHRFRRAKRLLSRETSLLEDRHHVRIESMLAHSQALKTIYEKRLALQQIWARTSANGHDMLAAMKDWVHEAETSGIQALRDFAAQLKTYSLRPTGA

SEQ ID NO: 11929 - protein, 398 aa, Hyphomonas neptunium ATCC 15444
MPSFKRIPDAGNLTGKVALVRVDFNVPMENGLVTDDTRLRAAVDTVQSLRTAGAKVALLAHFGRPKGERVAEMSLAPIAGAFAKVLGANVSFVADCKGDHVKSAIADLLPAGVILLENTRFYKGEEKGDMELAKEIAALGDLYVNDAFSAAHRRHVSTAVLADLLPAYAGVTMEAELDALDKALGAPERPVMAIVGGAKVSSKIDLLKNLVSKVDMLAIGGGMANTFLAADGVNVGKSLCEHDLAPTVREIQAAAKAAGCEILLPKDVVVAKEFKANAENRTCGLNEIGADEMVLDAGAATITYLSEALGRAKTVIWNGPLGAFEMTPFDTATVKVAETAAKLAKSGALVAVAGGGDTVAALNHAGVAQDFTFISTAGGAFLEWMEGKELPGVEALLK

SEQ ID NO: 11930 - protein, 989 aa, Bordetella bronchiseptica RB50
MLLTKKTSGAAAGASESHFIQSLRRGMAQALPTMDRRTFLRRSGLGVGAGLAATQLALVKRAEAAEGDGKVAIGNTKIEVRRTVCTHCSVGCAVDAVVENGVWVRQEPVFDSPINLGAHCAKGASVREHGHGEHRLRYPMKLVNGKYQRISWDTAYEEITAKLMQLRKESGPDSVYWIGSSKHNNEQSYLLRKFVSFWGSNNCDHQARICHSTTVAGVANTWGYGAMTNSYNDMQNSKVALYIGSNAAEAHPVSMLHMLHAKETGCKMIVVDPRFTRTAAKADQYVRIRSGTDIPFLFGLLYHIFKNGWEDQAYIDARVYGMDEVKADILAKWSPDKVEEACGVDEATMYSVAKTMHENRPGTLVWCMGQTQHSIGNAMVRASCIVQLALGNVGKSGGGANIFRGHDNVQGATDVGPNPDSLPGYYGLAEGSWKHFANTWGVDYEWIKGRYASPAMMTKPGITVSRWIDGVLENPDLIDQDTNLRAVFYWGHAPNSQTRGLEMKRAMDKLDLLVVVDPYPSATAAMAAMPGKAEDLNPNRAVYLLPAATQFETNGSCTASNRSLQWREKVIDPLWESRTDHMIMHQLAEKLGFGKELSKNYKMQKVKGMDEPVVEDILREINASVWTIGYTGQSPERLKAHMRNMHVFDVKTLRAKGGKDAETGYDLTGDYFGLPWPCWGNPSLKHPGTANLYDTSLHVMDGGGNFRANFGVERNGVNLLAADGSHSKGADLTTGYPEFDHVLLKKLGWWEDLTPEEQKAAEGKNWKTDPSGGIIRVTMKVHGCHPFGNARARAVVWNFPDAIPQHREPIYGTRPDLVAKYPTHNDLKTFWRLPTLYTSLQQKNVAEKLYEKFPIILTSGRLVEYEGGGEETRSNPWLAELQQESFVELNPKAAADRGIRNGDRVWVLTPTGARLNVQALVTERVGPDTAFMPFHFSGHWQGVDMLASYPEGAAPIVRGEAVNTGTTYGYDSVTMMQETKTTICNIEKA

SEQ ID NO: 11931 - protein, 136 aa, Zea mays
  misc_feature (67)..(67): Xaa can be any naturally occurring amino acid
  misc_feature (78)..(78): Xaa can be any naturally occurring amino acid
FGSSEPFVKTPCFKTRKALIVGWDPRYQPLVIHCKRGQHRTACMIPCLRMLPIRCLSSVFDEYHQLXCVKARITDQTXSELCYVLSLRHLPPSHVQPQGACILDAPILMRHLQGYHPQLLHRLSREQSWNPLESMR

SEQ ID NO: 11932 - protein, 232 aa, Zea mays
MMTSCRNIDLGTMMMACGCGRRQFPSLAKTVCKFSSSNRSYGGLVGSCKAVPTKSKEISLLNGIGQSQTVSFDLKQESKQPISLVTLFELVAVDLQTLNDNLLSIVGAENPVLISAAEQIFGAGGKRMRPGLVFLVSHATAELAGLKELTTEHRRLAEIIEMIHTASLIHDDVLDESDMRRGKETVHELFGTRVAVLAGDFMFAQASWYLANLEGGPGTPRTPFPPLGGPFT

SEQ ID NO: 11933 - protein, 419 aa, Magnetococcus sp. MC-1
MDYFHYQDDQLFCEEVALEQIAQAVGTPFYCYSERTLLHHLQVFQQAFASQDSLICYSVKANSNLAVLDALAKQGAGFDIVSGGELERVRRVGCPGERVVFSGVGKSRAEIQAALAYGVRMFNVESIPELQRIQEVALAMDVAAPVTLRINPDVDPKTHPYISTGLKRNKFGIPFGEAVAVYQQAAQMSHVQVVGLDCHIGSQLTQLSPFVDALKRVMVLIQALKGHGIEIKNLDLGGGLGIPYEDGDTPPSPAELAAALLEQLDGMPVTVILEPGRAIVGNAGVLVTRVEYVKKGEQRHFVITDAGMNDLLRPAIYNAYHGVIPLQRKFDREEQVVDVVGPICETGDFFARDRYLSEVYQGELLAVRSAGAYGFVMSSNYNTRPRVAEVLVRGDRYAVVRKRESVAQLLENESLFEDA

SEQ ID NO: 11934 - protein, 476 aa, Xanthomonas axonopodis pv. citri str. 306
MFKQLWATKHPHASHEAADGLGLQRALGPWGLTALGIGAVIGGGIFVITGQAAADHAGPAIMLSFVLAAVCCAFCAMAYAEFAAMVPVSGSAYTYTYATFGELAAWFIGWMLVLEYGVSASAVAVSWTGYFLSLLEHFDIHLPAAFVSAPLDGKLQPTGAIANLPAAGIVLLLTWLCYVGIRKSSAMNMAMVILKTGLILLVIAVGWKYVDTSNWHPFIPANEGPGKYGMEGVLRGAAMVFFAYIGFEAVSVAAQESHRPQRDLPIGMILSLVICTVLYIAMAAVMTGLVPYTLLGTDEPVVTAVAAHPQLAWLRVVVEVGALIGLSSVVLVMIIGQPRIFMIIARDGLLPSIFTRIHPKYRTPHVNTVITGVGIALLAAVFPLDVLGELTSMGTLIAFAAVCAGVLILRRTHPELPRPFRMPAAWLICTAGVLSCLALLSAMTLHNWMLMGLWTLVGLVIYFGYGYRHSRLRDGR

SEQ ID NO: 11935 - protein, 493 aa, Xanthomonas axonopodis pv. citri str. 306
MYRMLKSLLRVKPIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGIAYIDPANWHPFIPENTGPGQFGWDGVFRAASIVFFSYIGFDAVSTSAGETKDPQKNMPIGILVSLAICTIIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLARPFRVPLAMVICPLGALACLFLFFQAFQEHWKVFVGWTVIGLAIYFGYGIHHSRLAKRA

SEQ ID NO: 11936 - protein, 359 aa, Dehalococcoides sp. CBDB1
MYHNVTLIPGDGIGPEISEATRRVLEATGVKFNWEVVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSAEALRLIEFIKENKKVEIRTDSGISIKPISVFGTERIFRWAFKYAKDNNRKKVTAVHKANIMKYSDGLFLAVGRKVAEEYPEIEFEDRIVDNMTMQLVKTPTQFDILVCPNLYGDILSDLCAGLVGGLGVAPGANIGDEYALFEPTHGSAPKYKGLNKVNPMAMMLSGVLMLRYLKEEKAADKLENAIAAVIAEGKSVTYDMLSPDKQAVAVGTSQVADAIIAKMK

SEQ ID NO: 11937 - protein, 443 aa, Arabidopsis thaliana
MEFTEAYKQTGPCCFSPNSRYVAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPKHGSKGVSFNQDGKFAAICTRRDCKDYVNLLSCQSWEIMGSFAVDTLDLADLEWSPDDSSIVVWDSPLEYKAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMRLLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 11938 - protein, 113 aa, Dehalococcoides sp. CBDB1
MGCLFCAIAKGEIPAQIVYKDEDLVAFKDINPQSPVHILIIPRRHIANLTDLDEADTELAGKMILLAGKLAREMDIAESGYRLVINSGREGGQVVQHLHLHLLGGRQLGGQLG

SEQ ID NO: 11939 - protein, 339 aa, Salmonella typhimurium LT2
MKSIVIEKPNTLTIETRALPQPAPGEVRIKVKLAGICGSDSHIYRGHNPFAKYPRVIGHEFFGVIDAVGDNVNHDRIGERVSVDPVISCGHCYPCSVGKPNVCTSLVVLGVHRDGGFSEYAVAPARNAHRIPDNIADHHAVMVEPFTIAANVTGQVNPTEQDVALIYGAGPMGLTTVQALKGVYQVKTVIVVDRIEERLAMAKQSGADWTLNNGQHSLAEFLQQKALKPTLIVDAACHPAILQEAITLASPAARIVLMGFSSDPCEIVQQGITGKELAIYSSRLNANKFPVVIDWLNKGLIDPDKLITHTFDYQHVTDAIELFEKDQRQCCKVLLTFAK

SEQ ID NO: 11940 - protein, 560 aa, Pseudomonas syringae pv. tomato str. DC3000
MLQTRVLPPADGAYQYPLLIKSLLLSGSRYEKTREIIYRDSVRYSYPTLKERICRLANVLTAAGVKAGDTVAVMDWDSHRYLECMFAIPMIGAVIHTVNVRLSPEQIAYTINHADDRLVLVNSDFTGLYQAMAGHLTTVEKTLLLTDLPDKTADLPNLVGEYETLLAAASPEYEFEDFDENSVATMFYTTGTTGNPKGVYFTHRQLVLHTLGLSAIMGCIDSTRLLGTNDVYMPITPMFHVHAWGIPYAATMLGLKQVYPGRYEPELLVELWRREKVTFSHCVPTILQMLLNAKSAQDVDFGGWKIVIGGSALNRSLYQAAKAKGIQLTAAYGMSETGPLISVAHINEELKAGSEDEQITYRIKAGVPGMLVDAAIIDQQGNFLPADGETQGELVLRAPWLTESYYREPEKGAELWAGGWLRTGDVATLDDMGFIDIRDRIKDVIKTGGEWISSLELEDLCSRHPAVREVAVVGIADPQWGERPFALLVIREGHPFDAKELKEHLKPFVEQGHINKWAIPSQIALVTEIPKTSVGKLDKKRMRLDIVEWQNSNSTFLSTL

SEQ ID NO: 11941 - protein, 320 aa, Lactobacillus acidophilus NCFM
MKRIGILTSGGDAPGMNAAIRAVTKTAIHHGLEVFGIRYGFAGLVAGDFIPLTTENVDHKISEGGTFLYSARFPEFAQEEVQQKGVEQLKKHGIDAVIVIGGDGSYHGALALTRHGVNSVGLPGTIDNDIPYTDYTIGFDSACRTAMDAIDKIRDTASSHHRVFVVNVMGRECGDIAMRVGVASGADAIVIPERPYDVKEIAETIKRGFADGKDHGIIVLAEGVMDAEEFKDELLKYGDFDARANVLAHMQRGGSPTVEDRVNATKMGNYAVNLLLDGKGGLAVGMENGKLNTHDILDLFDSKHQGDFSLLDVNEEMTKD

SEQ ID NO: 11942 - protein, 152 aa, Synechococcus sp. WH 7805
MASERTFIAIKPDGVQRGLIGEILGRFERKGFKLVGLKQLTPSRELAEQHYGVHKERPFFAGLVDFITSGPVVAMVWEGDGVIASARKLIGATKPLEAEPGTIRGDLAINIGRNVIHGSDAPETAQFEIGLWFQASELSDWTPSDQGWRTEG

SEQ ID NO: 11943 - protein, 103 aa, Candida glabrata CBS 138
MSGRGKGGKGLGKGGAKRHRKILRDNIQGITKPAIRRLARRGGVKRISGLIYEEVRAVLKSFLESVIRDAVTYTEHAKRKTVTSLDVVYALKRQGRTLYGFGG

SEQ ID NO: 11944 - protein, 720 aa, Petunia integrifolia subsp. inflata
MMTEVHDAGRPRVVIFNGSQLQREAIIPFASRSSCFHHQLCSRGHLLIIFLLLVSPFNDAAVDVDGDDNDNLIIDHVPDAKSSSEALLNFKSSLSTSSPRGHEVLGSWIPSNSPCSGNNGNWLGVLCYEGDVWGLQLENLDLSGVIDIDSLLPLHFLRTLSFMNNSFKGQCLIGISLEPSSHCTCPIIASPVRSRMMLPGYDLSQEALFGKQPIQRQHPHLPGYLLPQVFELSLENNRFTGSIPHFPPNVLKVLNLSNNQLEGPIPPALSLMDPTTFSGNKGLCGKPLESACNSPSQEANNPDSRNSSTISGQSSTDVIRKSPTRLSKVMLIVAVCLVVLCLLIVLILIIRRRSHSSSQNPQPVESNYSNNDRDQNAFTSSAPDDHVTLSGNSTYSNNQHSNSNKAEAPTAAVVGKLSFVRDDRPRFDLQDLLRASAEVLGSGNLGSSYKALLMDGQAVVVKRFKQMNHVAKEDFHEHMRRLGRLTHPNLLPLVAYYYRKEEKLLVYDYASNGSLASHLHGNQSRLDWSSRLKIVKGVAKALAYLHNELPSLALPHGHLKSSNVLLDKYLNPVLMDYTLVPLVNLAQVQHLLVAYKAPEYAQQGRITRKTDVWSLGILILETLTGKFPTNYLALSTGYGTELATWVDTIIRDNESAFDKEMNTTKDSQGQIRKLFDIGVACCQEDLDTRWDLKEVVQSIQSLNDKDHGHSNSDQMHDAGV

SEQ ID NO: 11945 - protein, 218 aa, Triticum aestivum
MKGPSGSSGGRDPWAPPPGSGGGGGGGSSQPAKKQQRTASSGQADEASTSSSSSQPPPQQQQPAPDGGDVPYLGEDLMFEVLRRAEARTLASAACVSRGWRALAQDERLWEAACVREWADLGFSEQQLRAVVLSLGGFRRLHAVSIRPIQRRRAGVPAAPAQGRGRRQQPPARLGRDQVQLSLSLFSIGFFQNMPNQPPPKKKDEGDGSDKGGGGRCG

SEQ ID NO: 11946 - protein, 491 aa, Candida glabrata CBS 138
MKPELKNPDLIKGLGYINGEWVKDSNEFFEVDDPSTGEIIAKLPEHDIAVVDRAVDAAYDAFQKYKNTLPRQRATWLRNLFNLMTENAEDLAKIITWENGKSLPDSRAEIKYAASYYEWYAEEAPRIYGATIQPSIPNNRVITKRQPVGVCGIICPWNFPSAMITRKVGAALAAGCTVVVKPDSHTPLSALAMTVLVEKAGFPKGVFNVVLSQHNTPKLGKRLCEHPKVKKVTFTGSTRIGKTLMEQASSTLKKCSFELGGNAPFIVFDDADLDLAVDQAIASKFRGMGQTCVCTNRFYVQDTIADEFAEKLVTKVKQFKIGDGMKEGVTHGCLTNAKQADKVDEHKKDAIEKGAKVLLEGGRMPDLGKNFYAPVVLKNVPQSAMVAKEETFGPLCPIFTFKTVEEVLGYANDTELGLASYVFTKNVNTLFTVSEALEAGMVSCNTGLFSDSSVPFGGVKESGFGREGSLYGIDDYTTVKSIIIGNLPDSL

SEQ ID NO: 11947 - protein, 1130 aa, Oryza sativa (japonica cultivar-group)
MRRHAGTIILLLILACLWLCPGRSSGFSWNIFSSSSSSSPPTAGESRAAPMLELDGAVADFLMDGADDPRAVKLLENARSKLAGPSNCWQEAYRRLFASCGDIMADKEMQSRLAWHLSSCFQEDSGRPPFPRCGEVSDMVHCRKRLGVSEDQVFLEFFLETNTLCHQLQAEAFKHNTERLVNDLTRTSKSAEEKLEVIEERSDQIIQESRKVQETISSIEMQADHLAEASKNVGDQIDDVLAHSKAIFEQSKEIADSQAKLREGQTEMRETIDAGMTHIQESYESLGNGMDKLKEEAVDIQREIKTVGDSMSTKMQDLQSTANDIGSVAGKSLENQMQLLDGQSKAMDGLNNLYSFQAQALEESRETVQKLAQFGQRQQEELLSRQEEIRQAHEHLIHNSHSILEAQEEFRAKQANIFAALDKLYILHNAILAESRFIKAFFFYCCIVFLIYMLTSAKQTFSIRGHLYFGLCITLLLEIGLIKLGADDIDKQFWVISKVFLVRSVFLALATVQMLHAIFTFRDYELLNHHLLQTLVEKGPSSSPAASRSPPASWLAGRDRDRERLFAGFVRNALGSCVDYAPALSPRSEVGGGELAFELDENLAEASPACEPCARELLAGAQARHRIFHEELVVKTFFEAEKAHRGQTRASGDPYLQHCVETAVLLANIGANSTVVSAGLLHDTIDDSFIDYDHIFHMFGAGVADLVEGVSKLSHLSKLARDNNTASRIVEADRLHTMLLAMADARAVLIKLADRVHNMKTLEALPLGKQQRFAKETMEIFVPLANRLGIASWKDQLENLCFKHLNPEEHKDLSSKLTKSFDEVLITSAVDKLDRGLRDAGLSYHNLSGRHKSLYSIHNKMLKKNLTMDEIHDIHGLRLVFEKEEDCYRALDVVHELWPQVPGRFKDYISRPKLNGYRSLHTVVMSENVHPFEVQIRTKEMHLQAEYGFAAHWRYKEGTCRHSFVLQMVEWARWVLTWQCEAMNKERPASLGDSDAIRPPCPFPMHSEDCPYSYTRQCDHDGPIFVILLEHDKMSVQEFQANSTVMNLMDRVGTNTPRWSPYRIPMKEDLRPKVNHEPISDLNRKLSMGDVVELTPALPHESLPNYREEIQRMYDRGGFALATRGGSSRR

SEQ ID NO: 11948 - protein, 358 aa, Bordetella bronchiseptica RB50
MTHQIAVLPGDGIGPEIVEQAERVLKALDLPLELRQAPVGGAAFDQFEHPLPPATLELAQGSHAVLFGAVGDWKYDTLPREFRPEQAILGLRKALGLFANLRPAILYPELASASSLKPEIVSGLDILIIRELTGDIYFGTPRGVRTAADGAFAGEREGYDTMRYAESEVRRIARIGFESARKRNKKLCSVDKANVLETSQFWRDLVIEVSRDYPDVELSHMYVDNAAMQLVRNPRQFDVIVTGNLFGDILSDEAAMLTGSIGMLPSASLNAAGQGLYEPSHGSAPDIAGQGIANPLATILSAAMLLRYSLNLAPQADRVEAAVRKVLADGLRTADIHEAGTTKVSTSQMGDAVLKALG

SEQ ID NO: 11949 - protein, 1053 aa, Methylobacillus flagellatus KT
MSHWLLDAIADKRSLALHEADRVQFYREMSPEVPVFDTQAMQDVVAALELAVLDMELDRFADEEASLKVMRQAAEDAFRLLRVLPLPEAPMDAATQLLRASALAVIGDRGADAARWLRAMEGDQTAPALPLESEDWGERCRAVLTDIWLRLVRKKGWSDRDAVLERVAALRAAQQEFERDYLGTFEPLAAKRSALELIAIYHLAKAAEVLAHYITDGVVDDSYQIQPLLDSHFDRAIAACDTGQLLELGPLTRLLARAAAQMVENSLWTVTRAVNSRVTRFVRELVSRGRGDRALFEVLPPQRRTLAEQGLLGSSRRAVVVSLPTSSGKTLIAQFRMLQALNQFDDQKGWVVYLAPSRALVNQITRQLRRDFQPLGVVVERVSPALEVNGIEAGLLAESQDDTQFRVLVATPEKFDLMLRQGWEEKIGRPLTLVVVDEAHTIQDKERGLRLELLLATINRECREAQFLLLTPFIENAREVARWLGGQNSDDISLGVDWQPNDRAIGIVSPVDAGAIDGRSRDYQLNFQTVHTSRPSIRLDEDFSLGKEEALAASLSKAKDIGTLAAMTARKLSARGPVIAMHSRPDYVWKLAEKLKGNRCDTLPDDVRFVQNYVAAELGAAFPLVDLLAHKVGVHHGGLPEEVRMLMEWLFEQGHLDALAATTTLAQGVNFPVSGVVMAAIQYPFGQDMPPEDFWNIAGRAGRVSQGQLGVVALVAKNESEVAQRREFINRNTGDLNSALIQIARAAADGLEDLGLIVYHHPEWSSFLQYLAHTYRQMGQPSNFADQIEQVLRGTFGFEKLRVSDSQIARRLLNGIHRYVDYLASPSQPLKLVDSTGFSLQSIRTVLTHKGDLGPDSWNRERLFRSGDNTLQNMMGVLLRVPELRDNLNSVLGGRSPDGDKLARILKDWVNGADIAHIATQYFSEGGADAVTALTKCGQNLFGKLTHTTSWGLNALLAITTAELDDDERSQLSNLPSQVYYGVSTDEAVSLRLLGVPRRAAPRLAEALRLTRQDSLPSIRQRLENLPEQVWSEALGSQGAIYRKAWMILDGAQ

SEQ ID NO: 11950 - protein, 599 aa, Oryza sativa (japonica cultivar-group)
MQGSVVTARRAVHGILVAVVVVQRLLAAGASPPADPVHCASGTARCTVTNAYAAFPDRSTCRAAAAAYPASEEELLRVVAAAAASGTKMKAATRYGHSVPKLSCPGAGDGRGLAISTSALNRVVAVDAAGMAITVESGVTLAELIDAAAGAGLALPHSPYWLGVTVGGLLSTGAHGSSVWGNGSAVHEYVNGMRIVTPAPAREGYAKVRVLAAGDPELDAAKVSLGVLGVISQVTLKLQPMFKRSVAFQHCGDGDLAERVVAFAGEHEFADILWYPGHGKAVYRIDDRVPSNTPGDGVYDFVGFRATPTLAIQAKRLVEDGLEATGNAAGKCLAASTTNSILAARNYGLTRNGQLLGAFPGTAVVGYQNRIQSSGSCLAGADDGLLTACPWDPRVEHGTFFFQSGISVPLSRAAAFIRDVQRLRDLNPDALCGVELYDGVLMRYVRASAAHLGKPEDSVDFDLTYYRSRDPATPLLHEDVVEEVEQMALRKYGGVPHWGKNQNAAFEGAAAKYGGARAAAFMRVKRAYDPEGLFSSEWSDKVLGVAGAGGVSVVRDGCALEGLCVCSEDAHCSPEKGYLCRPGRVYKEARVCRRVADDL

SEQ ID NO: 11951 - protein, 213 aa, Triticum aestivum
MADAAALVAVPPQAQPQQRHPLSQIAASGTHRLLLKQWLKEEDLLARRVALREARLDGARKEIAFLYCAFFAFHAASVLLLFLSASVAPLTTSPSSACRRSWIPCLVSLLASLAMLWALRYKADTEAVLERVLAREQEDAALLGRCVAELKRKGLEFDLLKEVDALRRAKALRVEAKAGTDGPRRWPARDLPVFALFGAACGVLVLTRFLLCN

SEQ ID NO: 11952 - protein, 718 aa, Sulfolobus shibatae
MSIFFRTRDRPLRPGDPYPLGSNWIEDEDGVNFSLFSENAEKVELFLYSQTNQKYPKEIIEVKNKTGDIWHVFIPGLRPGQLYAYRVYGPYKPELGLRFNPNKVLIDPYAKAINGNVIWNDAVFGYKIGDQNQDLSYDERDSSEYVPKSVVINPYFEWDDENFIKGKKVPLKDTVIYEVHVKGFTKLRLDLPENLRGTYEGLASEQMISYLKDLGITTVELMPVFHFIDQRFLIDKGLTNYWGYDPINFFSPECRYSSSGCLGEQVISFKRMVNKLHNAGIEVIIDVVYNHTAEGNHLGPTLSFRGIDNTAYYMLQPDNKRYYLDFTGTGNTLNLSHPRVIQMVLDSLRYWVTEMHVDGFRFDLAAALARELYSVNMLNTFFIALQQDPILSQVKLIAEPWDVGQGGYQVGNFPYQWAEWNGKYRDSIRRFWRGEALPYSEIANRLLGSPDIYLGNNKTPFASINYVTSHDGFTLEDLVSYNQKHNEANGFNNQDGMNENYSWNCGTEGTTNDQNVIMCREKQKRNFMITLLVSQGTPMILGGDELSRTQRGNNNAFCQDNEITWFDWNLDERKSKFLEFVKKMIQFYKAHPVFRRERYFQGKKLFGMPLKDVTFYTSDGKEVDEKTWNSPTQTVIFVLEGSVMDEINIYGERIADDSFLIILNANPNNVKVKFPKGKWELVVGSYLREIKPEERIVDGEKELEIEGRTALVYRRTEL

SEQ ID NO: 11953 - protein, 619 aa, Emericella nidulans
MRSIDQPLLTRLPSSGRAQTSQLPLTMYNAHRGMVPAPNSRLNELLDQLRQEFENQSRSTGEFEHQLTGQLQEMEMIRQKVYQLEQAQLKMKQDYEAEIRMLRHELESRGVQPVASHVAVPAQHGGPSQAPPPALGHGPSNLFGGIMANQGGSGPGLAPPPPQDQQPSQHTLQQPAAAAQPGAPQPPQSSFGGYQPWRCCYGPPPPPTASPGPGKRPRAPPGPATPQQAHQLAYPESRVSPQLARPTPPNQPVVRDRPGNMLANWNPEDLPPSQKKEGVDWYAVFNPEVQRVLDVELVHHLVHDSVVCCVRFSRDGKYLATGCNRSAQIFDVTLGQNVAVLQDESVDKSGDLYIRSVCFSPDGKYLATGAEDKQIRVWDIATRTIKHIFSGHEQDIYSLDFAGNGRYIASGSGDKTVRLWDIAEGKLVYTLSIEDGVTTVAMSPDGLYVAAGSLDKTVRVWDTTTGYLVERLENPDGHKDSVYSVAFAPNGKELVSGSLDKTIKLWELNLPRQQYNSAGKGGKCHRTFEGHKDFVLSVCLTPDGHWVMSGSKDRGVQFWDPITGNAQMMLQGHKNSVISVAPSPTGNLFATGSGDMRARIWRYASFPNPISLPKIWMLG

SEQ ID NO: 11954 - protein, 582 aa, Aspergillus nidulans FGSC A4
MTTELAAAPVLSTPDDRILEETDPVVPQTNRILSEEELAITYDIERTLKEIRQARYKRIALQFPDEMLPDAPRVFQLLSRGLEARDIVDGGSKANTETEPTDGLVDSASRLDLKDADEWSPKLYILADTSYGTCCVDEVAAEHVDADVVVHYGRSCLSPTARLPVIYVFTHKELPLDPVLKAFKETYPDPETKVILAADVTYSDHIPEVYSRLVQEGYSSLFATALVHDPSSVIPNRTVPDSVKEAPESLGNWQLFHISEPPTALLLTLASRVAAIHIYPTDGPAGTDVKPLPASTAMVLRRRYAILTRLSTVPIFGILVNTLSVKNYLHIVDHVRDKIAAAGKKSYMFVVGKLNAAKVANFSEIGGWVVIGCWESSLVDSKDFWKPVITPFELEVALKGDEERVWTGAWQSDFQSILDQPPPSSNSPGNSQEANEGPEFGDHARDEDEDAMSEPESAPPEFDLRTGRYVSYSRPMRDSAPRVSASQGATAAISAQTGAADGPSAARALARRAKGDLAMVGNTFSPGAEFLRSQRTWTGLGSDFNSAANVEYDDEENDSTLVVQGRKGIARGYTVGDSIDRH

SEQ ID NO: 11955 - protein, 430 aa, Synechococcus sp. WH 7805
MFDSLDLVIDTIVAREVLDSRGNPTVEAEVLLEGGASGRAIVPSGASTGAHEAHELRDGGDRYMGKGVIQAVNHIEERIAPALCGLSALDQAAVDAAMLELDGSDNKSSLGANAILAVSMANARAAANGLGLPLYRYLGGPMATLLPVPLMNVINGGAHAANSLDFQEFMLVPHGAPSFREALRMGTEVFHTLKGLLNDKGMSTSVGDEGGFAPDLGNVEAGEILVEAIEKAGYKPGEQISLALDVASTEFFADGRYAFDGGSFNSEEMVGQLEQLVEKFPIVSIEDGLAEDDWEGWKLLTERLGAKVQLVGDDLFVTNTKRLQQGIDSSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 11956 - protein, 471 aa, Candida glabrata CBS 138
MFASTTRCVTLKCRTVRYKSSFAVALETASKLVSPRLLWNNPISLVSNEMNTLAKNIMALIGSGHPTLNRVTSYYFETEGKKVRPLLVLLLSRALSEIPLKERDNIPIDTTDVPEDPMYSKLSSNSSLFDVPVKSISPLHILHGIKPLNPLTKGPEPITQPEFDQERGILPKQRRLAEIVEMIHTASLLHDDVIDYSDTRRGRPSGNVAFSNKMAVLAGDFLLGRATVAISRLKNPEVVELMSNSIANLVEGEFMQLKNMAVEDQPLVGSKNDKILPPPSKKLELKEHDYRVATPEATGSFSHEEVINIAFEYYLHKTYLKTAALISKSSRAAAILSGARDPVIEECYSFGRNIGICFQLVDDLLDFSVSAKDLGKPAGADLKLGIATAPVLFAWKEDPSLGPLIKRNFSEPGDVEKTVKSVQDHDGVGKTMEFAKEYRNKALQNLKNALPESDCRSALEFLTNSIVTRKK

SEQ ID NO: 11957 - protein, 489 aa, Oryza sativa (indica cultivar-group)
MLLFITLTTFYRKEWAFSQVGRGVTSMDSFLIKFFPSVYAKEKEMVETNQYCKFDSELLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILAANLINYFTDKIAGGWGWRVSLGLAAVPAVIMAGGSLFLPDTPNSLLSRGKENEARAMLRRIRGTDDVGPEYDDLVAASEASKAIENPWRTLLERRYRPQLVMSVLIPTLQQLTGINVVMFYAPVLFKTIGFGGTASLMSAVITGLVNMFATFVSIATVDRLGRRKLLLQGGVQMIFAQFILGTLIAVKFGTAGVANISRGYAIVVVLCICVFVSAFAWSWGPLGWLVPSEIFPLEIRSAAQSVVVVFNMAFTFIIAQIFLMMLCHLKFGLFYFFGAMELIMTGFVFFFLPETKGIPIEEMDRIWGKHWYWRRFVGAGAGGKVEITSTV

SEQ ID NO: 11958 - protein, 448 aa, Zymomonas mobilis subsp. mobilis ZM4
MTDYDFDLFVIGAGSGGVRASRIAASHGASVAIAEEYRIGGTCVIRGCVPKKMLYYAADFAADLKKAQRFGWTLPEKKFDWATLRDVVLSDVTRLEGLYTQTLDNNHITHYKEHAVIDSANQIRLASGKKITARYILVAVGAEPAKLDILGAEYAVTSNEMFLLPSLPKRALVVGGGYIANEFAGILNSFGVETTIATHGDRILRGYDEEIAARLVEIGQGHGIDYRFNADIARIDKDSSGRLTTHFKDGSQIESDLVLFAIGRVAKSRDLGLDKADVKTNDRGAILVDEENRTSCPSIYAVGDVTDRVQLTPVAIREGQAFADRVFGHKAASVDYDTIPTAVFSHPPLASAGLTEEEAKKRYKNIKIYKSNFRPMRNALIDSPDRALYKMVVDGDSDKVLGLHLIGQDSPEIIQLAAVAIKAGLTKQAFNDTVALHPSSAEELVLMR

SEQ ID NO: 11959 - protein, 507 aa, Zymomonas mobilis subsp. mobilis ZM4
MARIANKAAIDAAWKQVSACSEKTLKQLFEEDSNRLSGLVVETAKLRFDFSKNHLDSQKLTAFKKLLEACDFDARRKALFAGEKINITEDRAVEHMAERGQGAPASVARAKEYHARMRTLIEAIDAGAFGEVKHLLHIGIGGSALGPKLLIDALTRESGRYDVAVVSNVDGQALEEVFKKFNPHKTLIAVASKTFTTAETMLNAESAMEWMKKHGVEDPQGRMIALTANPAKASEMGIDDTRILPFAESIGGRYSLWSSIGFPAALALGWEGFQQLLEGGAAMDRHFLEAAPEKNAPILAAFADQYYSAVRGAQTHGIFAYDERLQLLPFYLQQLEMESNGKRVDLDGNLIDHPSAFITWGGVGTDAQHAVFQLLHQGTRLVPIEFIAAIKADDTLNPVHHKTLLTNAFAQGAALMSGRDNKDPARSYPGDRPSTTILMEELRPAQLGALIAFYEHRTFTNGVLLGINSFDQFGVELGKEMAHAIADHPENSDFDPSTKALIAAALK

SEQ ID NO: 11960 - protein, 512 aa, Oryza sativa (indica cultivar-group)
MENAGAGDGAPKHYPAKMTVFVFIACLVASSGGLIFGYDIGISGGVTSMDPFLSRFFPSVYAKEKEVVDTNQYCKFDSEPLTLFTSSLYLAALIASLFASVITRKLGRKMTMLGGGFIFLIGAVLNGAAVNVAMLIIGRILLGIGVGFSIQAVPLYLSEMAPAKMRGMLNIIFQLMITVGILAANLINYFTDKIAGGWGWRVSLGLAAVPAVIMTVGSILLPDTPNSLLSRGKENEARTMLRRIRGTEDIGPEYDDLVAASEATKAIENPWRTLLERRYRPQLVMSVLIPTLQQLTGINVVMFYAPVLFKTIGFGGTASLMSAVITGLVNMFATFVSIATVDRFGRRVLFIQGGIQMIIAQFILGTLIAVKFGTAGVANISQGYAIVVVLFICLFVSAFAWSWGPLGWLVPSEIFPLEIRSAAQSVVVVFNMAFTFFIAQIFLMMLCRLKFGLFFFFGAMELIMTGFVFVFLPETKGIPIEEMDRIWGEHWYWSRFVGAGRNRVMQMASTNV

SEQ ID NO: 11961 - protein, 167 aa, Oryza sativa
  misc_feature (129)..(129): Xaa can be any naturally occurring amino acid
  misc_feature (142)..(142): Xaa can be any naturally occurring amino acid
  misc_feature (144)..(144): Xaa can be any naturally occurring amino acid
MAAEGEKKMITLKSSDGEEFEVEEAVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDXTCQTVADMIKGKXPXEIRRLHIRPLREERSQVALIKQA

SEQ ID NO: 11962 - protein, 231 aa, Zea mays
FSTWIPRAAGIFHELVPPPPPPIVSSFLFVLVKNKKNNKKNLNRRKFRQEFSSYNELSMGFFGRLFGSKKQEKATPNRRRWSFATRSSHPENDSSSHPSKRRGDEDVLNADKHAIAVAAATAAVAEAALAAARAAAEVVRLTNGGRNSSVKQISRSNRRWSQEYKAAMKIQSAFRGYLARRALRALKALVKLQALVKGHIVRKQTADMLRRMQTLVRLPARARAFAFFSRF

SEQ ID NO: 11963 - protein, 150 aa, Brassica napus
  misc_feature (69)..(69): Xaa can be any naturally occurring amino acid
  misc_feature (119)..(119): Xaa can be any naturally occurring amino acid
  misc_feature (137)..(137): Xaa can be any naturally occurring amino acid
MIKQIFGKLPRKPSKSLNNDSNGEGAVNSYYAPNPSASGSRLPNGTLAPNSNKNIQAGLFPPSGVVYEXLPSFRDVPISEKPNLFLQKLTMCCVVFDFRDPSKNLKEKEIKRQTLLGLXDYVASVGVKFNEAAIQEXTKKVAGNLFRTFL

SEQ ID NO: 11964 - protein, 257 aa, Oryza sativa
ELKLAVKGALDVRLGSPAVGIHEQQLLHRGTSGSDEAGAINEISPVEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDP

SEQ ID NO: 11965 - protein, 403 aa, Cenarchaeum symbiosum
MHDINSIAFPLRYTTAGRGHRFVPLHSDAELTVDEILEKTEVGTKYGPLLKGSKKVPVILDAKGRTVSFPPVINAARTTVNTKTLGLFVDVTGTDKRVIEDVLSVIALTLQGAGFTLYSVRVSGAGNSTPLFRPRKMRLDAQLVNSTLGLDLKPTAIVNALRKSRLDAIAKGKIIECTIPRHRFDILGEMDLVEDAALGYGMDKLGPRLPTSSTLGMAHPIQVMLQSARGIMTGLGYTEILNSSLTSKRILYENTDRDPSKMISVSDSKSLEHTILRDSLLPGVIDSLAANIHHEYPQRLFEIGTVFGRGSPVSEQGSLCAASSHGSAGFTEIKSTLQSAARHILGGTCKTRPAPHDIFEEGHSAEVLVGGKVIGIAGELSGTVRERFRLREPVSAFEIKLPG

SEQ ID NO: 11966 - protein, 130 aa, Gibberella zeae PH-1
MVRTSVLHDALNAMNNAEKAGKRQVLIRPSSKVIIKFLTVMQRHGYIGEFEEIDDHRSGKIVVQLNGRLNKVGVISPRYNVRLAELEKWVVKLLPARQFGYVILTTSAGIMDHEEARRKHVSGKIIGFFY

SEQ ID NO: 11967 - protein, 268 aa, Zea mays
MRRRLLLGVGTPAVAALAAAAPPAVLQDGAVTVLITAGAYSLVRVFDELTERRLIEKSLSRKVVHVLSGVLFMSSWPLVSNSTEARYFAAVVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 11968 - protein, 549 aa, Oceanospirillum sp. MED92
MNTPISAFETDLDQNQANYSALTPITFIERAASVYPNRIATVHGDVRRTWAETYTRCKQFASALRAKGVNPGDAVSIMAPNLAEHFEAHFAVPMCGAVLNSINIRLDSEAVAFILKHAESKVLITDREFSSVVKGALELLDEKPFVIDIDDPYWSEGEFIGETKYDDFLATGDEHFVPHKVADEWNAITLNYTSGTTGNPKGVVYHHRGAYLNAISNSISWGMDQHAVYLWTLPMFHCNGWCFPWTIAAMAGVNVCLRHVRADDIFNAIKREKVGYFCGAPIVLNMLNSADDELKTGIEHQVKVMTAGAAPPAAVIAGMESLGFSVTHVYGLTETYGPSVVCAWHDEWDEKSLDDKARLKARQGVRAPMLDGLMVADPVTMKPVPKDGETMGEIFMQGNLVMKGYLKNPDTTEKSFEGGWFHSGDLAVWHEDGYIEIKDRSKDIIISGGENISSIEVEDVLYRHPLVQEAAVVAKNHEKWGETPCAFVALKEGSDRDITEKEIIDFCREHMAHFKAPKDIVFGDLPKTSTGKIQKFLLRDRANGVEQDA

SEQ ID NO: 11969 - protein, 512 aa, Arabidopsis thaliana
MEISVASVTISVVLAVVSWWIWRTLQWVWFKPKMLEHYLRRQGLAGTPYTPLVGDLKKNFTMLSEARSKPLKLTDDISPRVVPYPLQMFKTYGRTYFTWFGPIPTITIMDPEQIKEVFNKVYDFQKPHTFPLATIIAKGLANYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPVTQLTRAIHKELKLGDLTLPGGVQISLPILLVQHDIELWGNDAAEFNPDRFKDGLSKATKSQVSFFPFAWGPRICIGQNFALLEAKMAMALILRRFSFEISPSYVHAPYTVITIHPQFGAQLIMHKL

SEQ ID NO: 11970 - protein, 285 aa, Emericella nidulans
MLYLVGLGLADERDITVRGLEVVKKAERVYLEAYTAILLVDKAKLEAFYGRPVIEADRELVETGSDDILANADKVDVAFLVVGDPFGATTHTDLVLRARELGIESKVIPNASIMSGIGCTGLQLYNFGQTVSMVFFTETWKPSSYYDRVKENVQIGLHTLVLLDIKVKEQSLENMARGRLIYEPPRFMTVAQCAAQMLETEEERQEGVWGPDSLAVGAARVGAEDQKLVAGTLQELTQVDMGRPLHSLVLLGRRAHDLEKDYIRRFAVDEATFDAAWQNGKYGSS

SEQ ID NO: 11971 - protein, 308 aa, Salmonella typhimurium LT2
MARAMDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRSVY

SEQ ID NO: 11972 - protein, 542 aa, Nicotiana tabacum
MAARVFTSRLSRSLTSSSHLLSRGLIIVDKQKSHLGRIAAYQYSTAAAIEEPIKPAVNVEHTKLFINGQFVDAASGKTFPTLDPRTGEVIAHVAEGDAEDINRAVAAARKAFDEGPWPKMNAYERSKIFVRLADLIEKHNDQIATLETWDTGKPYEQAAKIEVPMVVRLLRYYAGWADKIHGMTIPADGPYHVQTLHEPIGVAGQIIPWNFPLLMFSWKIGPALACGNTVVLKTAEQTPLSAFYVAHLLQEAGLPEGVLNIISGFGPTAGAPLCSHMDVDKLAFTGSTDTGKAILSLAAKSNLKPVTLELGGKSPFIVCEDADIDTAVEQAHFALFFNQGQCCCAGSRTFVHEKVYDEFLEKAKARALKRTVGDPFKSGTEQGPQIDSKQFDKIMNYIRSGIDSGATLETGGERLGERGYYIKPTVFSNVKDDMLIAQDEIFGPVQSILKFKDVDDVIRRANNSRYGLAAGVFTQNIDTANTLTRALRVGTVWVNCFDTFDATIPFGGYKMSGHGREKGEYSLKNYLQVKAVVTPLKNPAWL

SEQ ID NO: 11973 - protein, 564 aa, Bordetella bronchiseptica RB50
MARGYAIGRAVVMGAAALEVAHYRIAPEDVAAESQRLTEALAKAQADLLQMADTLPEDAPRELGAMLNVHRLLLGDPLLAEQALALIAERHYNAEWALTAQGQILGQQFEAMEDEYLRERGGDVRQVIERALHVLAGTSAMLPDGAQLDGDDPLVVVAHDISPADMLRLRGGRFAAFVTDLGGPTSHTAIVARSMGVPAVVALGNVRELVRDGDMLIVDGADGVVVLNPSARILAEYQARQRVYADERAELALLRDEPAVTLDGIDIVLHANIELPEEASLSLACGAHGIGLFRSEFLFMGRPDLPGEEEQYEAYASVVKVMAGRPVTIRTLDIGADKTLDDEATVATNPALGQRAIRYCLARPEMFATQLRAILRASAHGPVRVLIPMIAHMHEVHATYAALESARRELDARGQPYAARVEVGAMVEIPAIAIAIEPFVQALDFLSIGTNDLIQYTLAIDRGDHDVAGLYDPLHPAVLRLVANTINAGERAGKPVAVCGEMAGDARLTRLLLGLGLTEFSMHPQQLLDVKREVRRAHSNALRVKVAAALNRALPIDPDTLDAL

SEQ ID NO: 11974 - protein, 506 aa, Vibrio parahaemolyticus RIMD 2210633
MIYAQPGSENAIVNFKSHYDNFIGGEWVKPTGGEYFDNISPINGQAYCKVARSGEADINLALDAAHNIKAKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDIFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESISQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSIDPLGFF

SEQ ID NO: 11975 - protein, 223 aa, Streptococcus agalactiae NEM316
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNSMVNKVIVAGKNGLDILEK

SEQ ID NO: 11976 - protein, 475 aa, Oceanospirillum sp. MED92
MHIWQFCLELETLMNQSMHEVIDQLHQDDKTHVWHHLTPGAAAEAGLPMFVEGEGLVIRDSQGKEYLDASAGGVWVTNVGYGRKEIADAMHAQLTKLNFFASSMAGVPATKFAKRLLEKMPGLSRVYYSNSGSEANEKAFKMVRQISAKHHGGKKSKILYRERDYHGTTIAALSATGQTQRRAQYGPFVPGFVEFPHCHEYQSQYELSEDKSYGVRAAQAMEEVILKEGPDTVGAVILEPITAGGGVILPPEGYWQEIQRTCKKYEILLIMDEVVCGIGRTGNWFGYQHFDIQPDIVTMAKGVASGYAAISCTVTTEAVFDLLQEEAGDELGYFRDISTYGGCQAGPAAALANLEIIEREGLIDNCRIQGERLLAGLEKLKAKYPIIGDVRGKGLFVGIELVTDPVNKAPVADAITVGIAARCKALGLLIGRTNRSFTAANNILNMSPALIATDADIDKILSILDKAFELETTNE

SEQ ID NO: 11977 - protein, 253 aa, Oryza sativa (japonica cultivar-group)
MERTTTRRTSSKGAAAAPAPKVVAVLAGLLERAAARGDADADARGGSAAAAAATAFRGRTRPEISVRRYAERIYRYAGCSPACFVVARVYLDRLAGRSPEEESSPSPSPPATAAAAVCVDSYSVHRLLITSVMVAAKFMDDIHYNNAYFARVGGVEVAEMNGLELELLFALRFRLNVTPATFATYCAALEGEMAADDGPLPSPSPSPEEEGNDRRQPPPRRKDGITNKVAAAVDRSALLTAAHHRVVVVEITQ

SEQ ID NO: 11978 - protein, 438 aa, Rubrobacter xylanophilus DSM 9941
MLRAARIRTEIPGPRSRALTERRRRAISAGLGTALPIWVAEAHGALVTDVDGNTFIDFGGGIGVLNAGHTHPRVVEAVREQVGRLTHACYYVSQYEPYLELAEKLNELVPGNFEKRSIFVNSGAEAVENAIKISRSYTRRPAILAFENAFHGRTMLGMSLTGKADPYRRGFGPFVPEVYRVPAPYAYRMPKEESWFDAFRRSLVSVDVSSVAAVIVEPVLGEGGFIPFPPEDLRRLREWCTENGAVMVVDEVQTGFGRTGKMFAIEHSGVEPDIVTTAKSLGGGMPIAGVTGRAEIMDSVHAGGLGTTYGGNPAACAAALAVIRAFEEENLLERSVRVGERVMEELRAIQRRHPDFVGDVRGLGAMAAMELVTDARSKTPDPARTKGVVEHALQEGLMLLTAGAYGNVIRTLMPLVITDSELEEGLSILSRAVDAAAA

SEQ ID NO: 11979 - protein, 164 aa, Oryza sativa
  misc_feature (110)..(110): Xaa can be any naturally occurring amino acid
  misc_feature (130)..(130): Xaa can be any naturally occurring amino acid
ARRAYNCPFCGEDFDFVAFCCHVDDEHAVEAKSGVCPICATRVGVDLIGHLTMQHGSYFKMQRRRRVRKISSGSHSLLSLLRKDLRDGSLQSFLGGSSYMTRLQRGMSPXLCSFCRLTPLPLCHNTTVSXAEPSLSEKDQKERAQRSKFVRGLVLSTIFEDDNL

SEQ ID NO: 11980 - protein, 194 aa, Brassica napus
  misc_feature (19)..(19): Xaa can be any naturally occurring amino acid
  misc_feature (71)..(71): Xaa can be any naturally occurring amino acid
  misc_feature (93)..(93): Xaa can be any naturally occurring amino acid
  misc_feature (111)..(111): Xaa can be any naturally occurring amino acid
  misc_feature (142)..(142): Xaa can be any naturally occurring amino acid
STHASEKLEGAPSMLSSAXVATSPAQAPWMLPFTGCEVHHVAIPQRTPRIATLMLLLSQAAGGRVSCMKAXHPLGKRKLETLSYLPDLTGAEXGIEADYLVRNKRMTCVEXQLEHGFVYREHGSTPAILRWPVIDTMRKLPXCGCTDYAQVLNEVQESMTEDPSPSIKIIGYDNNRQEQRISLIDYKPPSLTAA

SEQ ID NO: 11981 - protein, 341 aa, Salmonella typhimurium LT2
MKVKAVFINKPGEVETRWVDYPHKKENEVLIKVDAAGICGSDIGAFRGTNPLVTYPRIIGHEVTGIVLQEGAGMPDNIKEGDRVIVDPYIYCGHCYPCSVGRTNCCENLNVIGVHVDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 11982 - protein, 847 aa, Oryza sativa (indica cultivar-group)
MGGQTALNLAVSLADSGALDRLGVRLIGASLPAIRAAEDRQLFKQAMDRIGLKTPPSGIGTTLEECISIAEDIGEFPLIVRPAFTLGGTGGGIAYNRAEFEDICRAGLAASHTQQVLVEKSLLGWKEYELEVMRDMADNVVIICSIENIDPMGVHTGDSITVAPAQTLTDKEYQRLRDYSVAIIREIGVECGGSNVQFAVNPADGEVMVIEMNPRVSRSSALASKATGFPIAKMAAKLSVGYTLDQIPNDITKKTPASFEPSIDYVVTKIPRFAFEKFPGSEPVLTTQMKSVGEAMALGRTFQESFQKAVRSLETGFAGWGCAPIKELDWDWEKLKYSLRVPNPDRIHAIYAAFKKGMRIQDIHEISFIDKWFLTELKELVDVEQFLISRGLDQLSKDDFYQVKRRGFSDTQIAFATSSSETDVRLRRLALEVAPTYKRVDTCAAEFEANTPYMYSSYEYECESVPTNKKKVLILGGGPNRIGQGIEFDYCCCHASFALREAGYETIMMNSNPETVSTDYDTSDRLYFEPLTVEDVTNVIDLERPDGIIVQFGGQTPLKLALPIQQYLEDKKLLAKRLNVCGLMNCQYAITTSGEVFLLEANPRASRTVPFVSKAIGHPLAKYASLVMSGVTLPELGYTQEVVPKHVSVKEAVLPFEKFQGCDILLGPEMRSTGEVMGIDYEFSGAFAKAQIAAGQKLPLNGTVFLSLNDLTKRHLAEIGRGFRELGFNIIATSGTAKVLQLEGIPVEPVLKIHEGRPNARDMLKNGQIQVMVITSSGDALDSKDGLQLRRLALAYKVPIITTVDGARATIDAIKSLKNKSIETLALQDYFQTTDASQNLQAAQSAS

SEQ ID NO: 11983 - protein, 276 aa, Candida glabrata CBS 138
MEEAAADAYKLSYKVGVAENKNAKFRRTMEDVHTYVKNFASRLDWGYFAIFDGHAGIQASKWCGSNLHTIIENKLMADETKDVRDVLNESFVMIDKQINKDLQGNSGCTAAVCVLRWELPDGCTEQEEMDLTKHKRKLYTANVGDSRIVLFRNGQSIRLTYDHKASDPLEMQRVEKAGGLIMKSRVNGMLAVTRSLGDKFFDSLVVGSPFTTSVEITPADQFLIIACDGLWDVIDDQEACEMIQDIEDPHEAARALVRNALERGTTDNVTVMVVTL

SEQ ID NO: 11984 - protein, 226 aa, Petroselinum crispum
MVKIAIGSIGDSFTHGSLKCYLAEFIATLLFVFAGVGSAIAFNNLTADAGLDPAGLVAIAVAHAFALFVGVSIAANISGGHLNPAVTFGLAVGGHITLITGFFYWIAQLLGATVASFLLIFVNGGKAVPIHGVGAGLGAAEGVVFEIIITFALVYTFYATAADPKKGSLGTIAPIAIGFIVGANILAAGPFSGGSMNPARHSGQLLLAETFLDTGSTGLVLSLEEA

SEQ ID NO: 11985 - protein, 197 aa, Triticum turgidum subsp. dicoccoides
NQRSKSAFVPSVSILNMKNFASCSLRPLYLTWLDDPHTSELKPRRQLLDFRCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 11986 - protein, 494 aa, Rubrobacter xylanophilus DSM 9941
MNVEREGRVETRMIERLFVGGEWVGEASTGRTFEVENPASGRVIAVLPDGGGGEMRRAVEAAVAAQPGWEEATAYERASVLWRAAGLMRERAEHLARVMTLEQGKPLAESRGEISYAASFVEWFAEEGKRVYGESVPSSFRDKRILVLKRPVGVAAAITPWNFPAAMITRKLAPALAAGCAMVVKPSELTPLSALELAKIFEEAGLPRGLLSVVVGTDPGDITAPLMEDGRVRKLSFTGSTEVGKHLMRQAAKTMKRLSLELGGHAPFIVFEDADLEAAVEGALVSKMRNMGQTCVCANRIFVQKSVLEPFAERLVERMGRMKVGDGLQEGVSVGPLIEERALRKVERHVEDARQKGARVLLGGSRLSSGGGYFFAPTVLCGADESMLVFREETFGPVAALASFESEQEVVERANATPYGLAGYYYTRDVGRVMRLAEKLRYGILGANDGLPSTAQAPFGGLKESGFGREGGHWGIEEYLDVKYLSLGGLGSSS

SEQ ID NO: 11987 - protein, 197 aa, Triticum turgidum subsp. dicoccoides
NQRSKSALVPSVSILNMKQIASCSLRPLYLTRLDDPHTSELKPRRQLLDFRCAASAADDKESKAEVVPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 11988 - protein, 454 aa, Rubrobacter xylanophilus DSM 9941
MDVMRGLGEGGRRTPLPGVENLMLHFTPFSEDWGRLPVIVSGEGCYVTDAEGNRYIDGLAGLFTTQVGHGRSELAEAASRQMRELGFFPNWSFQHPRSLELAARLAELAPGDLSTSFFVSSGSEAVETVIKLARQYHKANGEPTRYKIISRKIAYHGTTLGALSVTGLPSFKAPFEPLLQGFMHVPNTQQDPEGAAEAIEEAIEFGPPETVAAVVLEPVQNAGGCLVPPEGYWRRVREICDRHGVLLVSDAVICAFGRLGEWFGIERFGVVPDMTSFAKGITSGYLPMGGVVVSEKVRDTLRENAPMFFHGSTFGGHPVSAAVALENINIIERERLLENVHDLEGHFQSELRRMAEGHPIVKDVRGMGFFWAVEVRPERADGTPLAGDEYERYFKGVVSRKLLEGGLICRFDDKDEPVIQYSPALVADREVISRIAEITDEALTELERELGYRS

SEQ ID NO: 11989 - protein, 530 aa, Glycine max
MNNGVSQESSVLLDLASHVNRFAFDSFRSDNNKTLLSNFLHFNGNTRTGAAAAKRGVSLGGKVGGASVRFGNILNDFNRAVRFHCEKIPIGFASLRVGDGGDGADGNGNGEGNGVRVDECGGVENEGFRGNGVEGEKPKKVLILMSDTGGGHRASAEAIKAAFYQEFGDDYQVFVTDLWADHTPWPFNQLPRSYSFLVKHGPLWKMTYYGTAPRVVHQSNFAATGTFIAREVAKGLMKYQPDIIISVHPLMQHVPLRILRSKGLLKKIVFTTVITDLSTCHPTWFHKLVTRCYCPTTDVAQRALKAGLQQSQIKIFGLPVRPSFVKPVQPKDELRRELGMDEDLPAVLLMGGGEGMGPIEATARALGDSLYDENIGAPVGQILVICGRNKKLANKLSSINWKVPVQVKGFVTKMEECMGACDCIITKAGPGTIAEAQIRGLPIILNDYIAGQEAGNVPYVVENGCGKFSKSPKDIAKIVAEWFGPKAYELQQMSQNALRLARPDAVFKIVHDLHELVRQRSYLPEYSCTA

SEQ ID NO: 11990 - protein, 406 aa, Coprinopsis cinerea okayama7#130
MRDRLKSAPSQPDPSKIPFRRTYSSNSIKVGRVEVGPSSFLKVKMLGKGDVGRVYLVREKKTNKLYAMKVLSKKEMIERKKIKRALTEQEILATANHPFIVTLYHSFQSEGYLYFCMEYCMGGEFFRALQTRPGKCLPEDGSRFYAAEVVAALEYLHLMGFIYRDLKPENILLHQSGHIMLSDFDLAKQSAEYGGLPSMVHSEQNGVPLVDTMSCTANFRTNSFVGTEAIPEYIAPEVIAAQGHTAAVDWWTLGILIYEMIYATTPFKGQERNETFNNIRHQPVTFRDSPKISSAGKDCMTRLLDKNERTRLGSRSGASEVKQHKWFSKINWGLLRNTRPPIVPSSSNGLDAAHFRHMRESTSLHLDLEDQSKAQPSADLLADDGQPADVLFKAFNSITLHHDGDT

SEQ ID NO: 11991 - protein, 358 aa, Oryza sativa
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 11992 - protein, 70 aa, Brassica napus
  misc_feature (2)..(2): Xaa can be any naturally occurring amino acid
  misc_feature (17)..(17): Xaa can be any naturally occurring amino acid
MXATPTIIGALLGLGTXMYSNALRKLPYMRHPWEHLLGMGLGAVFVNQLVKFDEKLKEDLDKMLERARLA

SEQ ID NO: 11993 - protein, 681 aa, Mesorhizobium sp. BNC1
MSFYSIYQQGFIRVAACTPKCEVADPGYNVAETVALARDGARQGVALMVFPELGLCAYAIDDILGQAALLQRVEQAIEEIAAASAELSPVLLIGAPLAREGRLYNCAVVIHRGRILGVVPKGHLPNYREFYEKRWFASGRNLKRATIGIAGQPVPFGMDLIFAAEDLPGFVFHVELCEDLWGPAPPSDFAALAGALILANLSASSITVGKAETRRLLCATQSARCWAAYIYSAAGPGESTTDLAWDGQACIYELGLLLAETERFPLDSQMAIADVDVERLTLERLRTGTFNEAAIAQNMPEDRFRRIGFQFEPPMTDLGLRRIVARFPYAPADSARLDQDCYEAYSIQVQGLMKRLQATGIRRVCIGVSGGLDSTHALIVAAKAFDRLGWQRSDILGFTMPGFATGDATKDNAWALMRSLGVTAEEIDIKPLAQQMLAGLRHPFAKGEMVYDVTFENVQAGLRTDILFRAANQRGAIVLGTGDLSEIALGWSTYGVGDQMSHYNVNASVPKTLIQHLIRWVAQSNAFDAGTNATLLSILDTVISPELIPADEGGPSQSTEEKIGPYELQDFTLFYLTRYGLKPSKIAFLAFHAWRDIAAGAWPPQYPDDRRRAYDLPTIKSWMEVFLYRFFTISQFKRSASPNGPKVTAGGSLSPRGDWRAPSDGNARLWLEELRANTPSE

SEQ ID NO: 11994 - protein, 337 aa, Zymomonas mobilis subsp. mobilis ZM4
MKAAVITKDHTIEVKDTKLRPLKYGEALLEMEYCGVCHTDLHVKNGDFGDETGRITGHEGIGIVKQVGEGVTSLKVGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 11995 - protein, 399 aa, Populus tomentosa
FARESDVKVMRVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGETCIRGDQIMKGYLNDPEATSRTIDKEGWLHTGDIGYIDDDDELFIVDRLKELIKYKGSQVAPAELEALLIAHPEISDAAVVGLKDENAGEVPVAFVVKSEKPQATEDEIKQYISKQVIFYKRIKRVFFIEAIPKAPSGKILRKNLKEKLPGI

SEQ ID NO: 11996 - protein, 228 aa, Zymomonas mobilis subsp. mobilis ZM4
MPTLVLSRHGQSEWNLENRFTGWWDVNLTEQGVQEATAGGKALAEKGFEFDIAFTSVLTRAIKTTNLILEAGKTLWVPTEKDWRLNERHYGGLTGLNKAETAAKHGEEQVHIWRRSYDVPPPPMEKGSKFDLSGDRRYDGVKIPETESLKDTVARVLPYWEERIAPELKAGKRVLIGAHGNSLRALVKHLSKLSDEEIVKFELPTGQPLVYELNDDLTPKDRYFLNER

SEQ ID NO: 11997 - protein, 307 aa, Pseudomonas aeruginosa PAO1
MTSKLEQLKQYTTVVADTGDFDAIARLKPVDATTNPSLLLKAAALPRYAEHLRQATAGSGGDAGLACDRFAVAVGKDILGVIPGRISTEVDARLSFDSEATLARAHRLIELYDEQGIDRERVLIKIASTWEGIRAAEILEREGIQTNLTLLFSFAQAVACADAGVFLISPFVGRIYDWYKKSENRDYAGAEDPGVQSVSRIYRYYKANGYKTVVMGASFRNLGQIEQLAGCDRLTISPDLLQQLADAQGELPRLLLPGEGEPRQVLDESAFRWQMNEDAMATEKLAEGIRLFARDQEKLEYQLATRH

SEQ ID NO: 11998 - protein, 777 aa, Schizophyllum commune
MATEDALPKLPHRPEPAREKTDGSLDEKIDEKLNNNKGEGFQDEPFELETQAQLDRQHVVTTGQDVSRYVVNLRDDEDPALTFRSLVLGTVIAGLGAALCQIYIFKPVLVSVSTVFLLLLIYCIGNAWAVFLPKRSLVKGTRFERYGGIIEFINPGPFMIKEHVVSTLVASTAAYGATSVNNFAVQRLYYDTHVGPLTAVFATFSTLTFGMGLVGILRPLTVYPAEMVYWSNLPQVTVFQALHFNRHESTKRVRVFWWGFTIMFIYELFPAYIFPLLNSVSIFCLASQKAKPSTRDVFTNIFGGGNANEGLGLLNFSFDWQYIGSNYMSYPLLQQANSWIGLGACYVIMAAIYYSNAWDSKNYKMLSTSIFNHNGTVYDQAAVFGKNGILNETALEEYGLPAMTGSNAWANFAQNLAIGALIAHVTLFWSGDMRDAVLHFRNGKKTNDDPHYLAMQKYKEAPWWWYFILLFLAFIAGLIVCIKGETSLPWWSYIVSLAVGAFITPFSTILYGRMGNGIATNNLMKMIPGALNPGRPVANLYFSMWSHDVVSTSIGLAGDLKVGQYTKVPPRVMFLTQLWGCILGAIVNYVVMISIVDAQREVLLDASGTNVWSGQTIQSLNSQAVTWSLAKELYSASGPYVIVPIGLAIGLVPPFIQWLISKRWPTIKGIKVESIILPIIFNYAQTMSKGITSYVSTSIVIGLVSQLWLRQHHPVWYRKYNYILGGAFDGGAQVMVFILSFAVFGASGVERPFPSWAGNPAKGNIDYCNGNGALDAS

SEQ ID NO: 11999 - protein, 552 aa, Solanum tuberosum
  misc_feature (1)..(1): Xaa can be any naturally occurring amino acid
XQVSGHRRYAAVYSEVQNSRLDHPLPLPSVLGSPFKVVDGPPSSAAGHPEEIAKLFPSLYGQPHVSLVPDDSGDVAMNQILKIGVVLSGGQAPGGHNVISGIFDYLQTHCKGSTMYGFRGGPAGVMKGKYVVLTPEFIYPYRNQGGFDMICSGRDKIETPEQFKQAEETAKKLDLDGLVVIGGDDSNTNACLLAENFRSKNLKTRVIGCPKTIDGDLKSKEVPTSFGFDTACKIYAEMIGNVMIDARSTGKYYHFVRLMGRAASHITLECALQTHPNVTLIGEEVFAKKLTLKNVTDYIADVVCKRAESGYNYGVILIPEGLIDFIPEVQQLIAELNEILAHDVVDEAGVWKKKLTPQCLELFELLPLAIQEQLLLERDPHGNVQVAKIETEKMLIQMVETELDQRKQKGAYNAQFKGQFHFFGYEGRCGLPSNFDSTYCYALGYGAGSLLQSGKTGLISSVGNLAAPVEELTVGGTALTALMDVERRHGKFKPVIKKAMVELEGAPFKKFASKREEWALNNRYINPGPIQFVGPVANKVNHTLLLELGVDA

SEQ ID NO: 12000 - protein, 445 aa, Clostridium cellulovorans
MEKLRFPKDFIFGTATAAYQIEGAYKEDEKGESIWDRFSHIPGNVAKMHNGDIACDHYHRYKEDVQLLKSLGIKSYRFSIAWPRIFPKGFGEINQKGIQFYRDLIDELIKNDIEPAITIYHWDLPQKLQDIGGWANPQVADYYVDYANLLFREFGDRVKTWITHNEPWVASYLGYALGVHAPGIKDMKMALLAAHNILLSHFKAVKAYRELEQDGQIGITLNLSTCYSNSADEEDIAAAHRSDGWNNRWFLDAALKGTYPEDMIKIFSDTNIMPELPKELFTEVFETSDFLGINYYTRQVVKNNSEAFIGAESVAMDNPKTEMGWEIYPQGLYDLLTRIHRDYGNIDLYITENGAAFNDMVNRDGKVEDENRLDYLYTHFAAALSAIEAGVPLKGYYIWSFMDNFEWAEGYEKRFGIVHVNYKTQERTIKKSAYWYKELIERSNK

SEQ ID NO: 12001 - protein, 237 aa, Triticum aestivum
MEGATNQDHVIGIPVNSTAYGIEEPDFPAEEETTITPPDHGGFVSGSFQSINNNDGDSNGSTVTDREQTSQVRRKRGKIAQGIKEHVTLGPKLSETVKGKLTLGARILQAGGVEKVFRQWFSVDKNERLVRASQCYLSTTAGPIAGMLFVSTERVAFRSDRSLAVAAPDGAKLRVPYKVTIPLRKVRRAVPTQNKHKPEQRYIEVLTNDGFEFWFMGFVSYHRSLQHLEQAIAQARR

SEQ ID NO: 12002 - protein, 226 aa, Oryza sativa (japonica cultivar-group)
MDCQRLDVAKDCIGVLSKQFPGSMRVGRLEALLFEAKGEWTDAERAYALILENNPFDQIVHKRKIAIAKAQGDMALAVEYLNKYLELFMADHDAWRELAETYVALQMYKQAAFCYEELILAQPTVPLYHLAYAEVLYTMGGLENLQTARKYYASTIQLTGGKNTRALFGVCLCSSAINQLTKGRNKEEESSELQSLASEALLKDYKQRAPSKEALITSLLKNMKLS

SEQ ID NO: 12003 - protein, 859 aa, Legionella pneumophila str. Paris
MSGILIMQQVVIKFGGTSVSSRATWNNIAAITQKHLNTGVQPVIVCSALTQISNKLEKAIEAALLDEHHSLFNDIQSSHLNLAEQLEVNHQLIANDLHQLQQWLTGISLLKQAPAKTHAQILSLGELMMTRLGHAFLEKQGIKVKWYDARELLTSTPTLGGETMNYLSARCESEYDPALVEKFLSTGAQAIITQGFFAANPHGETVLLGRGGSDTSAALLAGKLQAASCEIWTDVPGIYTANPHQLPHARLLKQLNYDEAQEIASMGAKVLHPNCIPPVRKANIPMVVKYTHLPEHSGTLITKDIDESAPLIKSIQVKHSILLISIDTLNMWQQVGFLADVFAAFKKHGFSVDLLSSSEFNVTLSLDVNAKIHDRPAINALLDDLNQFGRAKLIEPCSAVSLVGHHIRTVLPHLGPALEVFEAKQVYLMSLASNDLNLTFVVDESHADKLCQRLHHLLIESNPQIFYYSKSWHEEFGKPNVRPTPWWEIERDRLLTTSAIHSPCYVYHSPTQATRARQLSALESIDSLFYAIKANPFPSILKTLEKEGIGFECVSIQELELVLKLFPNIKKERILFTPNFAPKSEYEFALQTGCYVTIDSLYPLENWPKLFKDREVIVRIDPGTGAGHHKHVSTGGNESKFGITQNDISKILSHTKANHIKVIGLHAHSGSGILSTDLWQQTAVMLASLTDQFPEVRSINLGGGLGIVEKPGQHPIDFAALDAQLMAVKSQYPGLAIWLEPGRFFVAESGVILAKVTQCKEKGKVKFIGIETGMNSLIRPSLYGAYHEIINLTRLHEEKAGFAHIVGPICESGDTLGYDRLLPVTREGDVILIANTGAYGHCMSSHYNLRPPAQEIVLE

SEQ ID NO: 12004 - protein, 238 aa, Nocardia farcinica IFM 10152
MPPHLIDGEPHDHAHDRPKRQRTPGEPLRIGIGGPVGSGKTALVAALCKQLREELSLAVLTNDIYTTEDADFLRRHAVLPDERITAVQTGGCPHTAIRDDITANLDAIDDLIAANPPLDLILVESGGDNLTATFSSGLIDVQIFVIDVAGGDKVPRKGGPGVTYSDLLVVNKTDLAPLVGADLGVMERDAAKVRQGRPTALISLTDDPAATPVLAWVREQLAAIAEADRHGAASGIAH

SEQ ID NO: 12005 - protein, 138 aa, Aspergillus nidulans FGSC A4
MSGEAWLYLLAVLINAVNLFLQVFFTIMYSDLECDYINPIDLCNRLNAYIIPEAGVHAFLTFLFVINGYWLAIALNLPLLAFNAKKIYDNQHLLDATEIFRKLNVHKKESFIKLGFHLLMFFFYLYSMIVALIRDESH

SEQ ID NO: 12006 - protein, 263 aa, Coprinopsis cinerea okayama7#130
MANLKTLYENLQRAFYSRPSDLKACASLLAQLKIGLIEAGLLIPQGNVNIGDLVVARDILEIGALTSIRSKDIPSFDRYFSQLQSFYTDYRNLPNFPPSKREYPIRGLNLIRLLTQNRIADFHTTLESLPADVIAENPYIKHPVNLERWLMEGSYSKVWNAREEAPAEEYKIFIDSLMGTIRNEIASCEEAAYESLPIKDAATLLFFTSQSDLAKFAAERNWQIDLTAGLIRFSQKTEEKVQIPKQKLIAASLLYARELEQIV

SEQ ID NO: 12007 - protein, 356 aa, Cordyceps bassiana
MSRANPPNNASASRKISFNVSEQYDIQDVVGEGAYGVVCSAIHKPSGQKVAIKKITPFDHSMFCLRTLREMKLLRYFDHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDNLSKEQLKQLIYQEIMR

SEQ ID NO: 12008 - protein, 503 aa, Arabidopsis thaliana
MSNIQEMEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 12009 - protein, 323 aa, Streptococcus thermophilus CNRZ1066
MERIRKRLKENNMSIDQLRDVKLITALITPFHEDGSINYDALPDLIEHLLAHHTEALLLAGTTAESPTLTHDEELELFAAVQKIVNGRVPLIAGIGTNDTRDSIEFAKEVAKFGGFAAGLAIVPYYNKPSQEGMYQHFKAIADASDLPIIIYNIPGRVVVEMTPDTMLRLAEHPNIIGVKECTSLANMAYLIEHKPEDFLVYTGEDGDAFHAMNLGANGVISVASHTNGDEMHAMLKAIENSDLKTAAAIQRRFIPKVNALFSVPSPAPVKAVLNHLGLEVGPLRLPLVACTSEEAKRIIKVVLEEDVEATRETVTGVVRPDY

SEQ ID NO: 12010 - protein, 856 aa, Cytophaga hutchinsonii ATCC 33406
MNLSIRTLNIIFSISLLLLASAFIYSYLNIQGLRSANHWVNHTNKVIISLESIYSDIKNAESGVRGYALTKDASYLEQQDQSRTNIKNQLILLDSLLADNPEQHIYIDTLQKTVNDRFFLFNGLINLTNNNADQAEVLPLMQKGKASTEHIYNLVKKMKNNEGILLLQRNEKAEALDKTTPITIVFSGIFGFMVLVISYYFILADLKQRRKIANEVKIKNTLLEYAQQITQMGTFEYNVFTNTLFWSNEMYNIFELDRSVIPEINFIDSLIKEESEITHNRRKKNFQPGASYSDELKIRTVNGNEKVLISNGYVVNEENGLVVHGAIIDITPLKKAELTAREQQELMRVAKEKAESASQFKTRFLSNMSHEIRTPINAILGFTAILSKQELTEQQKKLLKNISISGELLLKLIGNILDISKIEEGKVIIESKSFHLKESIRSVLSPFQHSASEKGLQFHLIIDKSIPDYLLGDFPRISQVLVNLIGNALKFTSHGNITVSVLLTKKQDGLSFVEFVINDTGIGIQANKQDEIFESFTQANESISVKYGGSGLGLSIVQEVVHLMGGNIQVQSPAHYNERGKGYGSKFFFTLPFKLGEKGADPQAKKTAVQPFPRVLHILVADDNEMNRTLATYTLQSLGCTFEIVENGLQAIQKAAANTYDIILMDMQMPVCDGLQATRQIRLNKNTTPIVGLTANVFQEDINRCLDAGMDGHLGKPYTEEDLYHIIDKWVFKNEKNIAASVPSFSNYEFIEKLSKNDPVIFREMLEMFLNQNAQLLKIIHTAINAEDLETLSFNVHQYKSCARMLNIEKQISLIKQIEEKIEARVSLETIRTDIMQLIETGALVSKEIEQKLLIV

SEQ ID NO: 12011 - protein, 520 aa, Ostreococcus tauri
MVKTASSSSGRFESRASASMTSRAREMEQTLEVQAEGEGVEDEMREIAVDARAPRVRRDRAKTASRELKRRFQSRDARCVILAGGADETNPLTRRRARSAVHLAGTYRVIDFPMTNLINSGMRQLYVLTQFNSHSLVTHVNKAFPSELFGGEVNGFVEVLPTSQTREHGETWSLGSADCVARHLSSGSLTKYTYEMRMEDECLRQLGSLDECLMSELDGTTIILSAEALYSMNFAELLEQHFLKGADVTIATCNQISSDQANAFGILDVDEMTAQVNCFIEKPTKAQLEEFMQCTTEELESCKLDANMGVYVFNNSALLELLTASKSGVAPGGPTRVRLGYDVKAFRHSDYWKPLRSLRDLYEANISIAVGGDAASLLTHGRQVYTKPNFLPPTTFHGSVYTEKTIFSDGCLVQDGSRIVNSVIGACTSIDKNVDLEGVVVVGRDEIMKRSGGVNSVPDIGANTIIRKCIIDSDATIGANVRIVNAAGIEELDRTDEGYVITEGIVTILGGAIIPDGFVI

SEQ ID NO: 12012 - protein, 452 aa, Ostreococcus tauri
MAGTNTPVTAALGAAAANDGMDNVLSIILGGGAGTRLYPLTKKRAKPAVPLGANYRLIDIPVSNCINSDINKVYCLTQFNSASLNRHLAQAYNTNIGTHTRQGFVEVLAAQQSPVNKAWFQGTADAVRQYLWLFEESKCEEYLILSGDHLYRMDYRPFIMKHRETEAAITVAALPCDEKRASSFGLMKIDNTGRVIEFAEKPKGAELQAMKVDTTVLGLDADKAQEMPFIASMGIYVFDAKKMRECLLENFKEADDFGGEIIPMAAQMGLKVQAFLYEGYWEDIGTVDAFFHANLSCNDPNPAFNFHEMNAPIYTQSRFLPPSKVQDCEIERSTIGDGCFITKAKLKNVMVGLRSTVNANCDLEDTLVMGADYYETYDEAKTSALPGGVPIGIGAGTKIRKAIIDKNARIGENCQILNEAGVMDKDCENEGYIIRDGIIVVIKDAVIKPGTV

SEQ ID NO: 12013 - protein, 229 aa, Debaryomyces hansenii CBS767
MFHLASSLYTQYTKREQYNVLILGLDNAGKTTFLEHLKLLYATPNETKKTEGGPDTTETIRSKRILPTVGQNVATIKYEGTDSHQFANINLKFWDLGGQKSLRSMWSRYYKSCHGIIFIIDSTDTERFHECYETLMEITHDQSWSDENNGFDFVNVPILMMANKQDLPTAVDLISLKTGYFIDLVSELEATDLKLLPVSILENQGLRESLDWLVTRLVYNKANKMPQYK

SEQ ID NO: 12014 - protein, 363 aa, Anthurium andraeanum
MATEVMTAVPAGSRVESLASSGIQAIPPEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKANFSIWPKQPANYVEETREFGRQLRVVASKMLAMLSLGLGVEEGKLEAEVGGMEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGHPAQFPPRTFSQHIQHKLFRKTQGDFATPN

SEQ ID NO: 12015 - protein, 499 aa, Vitis vinifera
MELLSCLLCFLAAWTSIYIMFSARRGRKHAAHKLPPGPVPLPIIGSLLNLGNRPHESLANLAKTYGPIMTLKLGYVTTIVISSAPMAKEVLQKQDLSFCNRSIPDAIRAAKHNQLSMAWIPVSTTWRALRRTCNSHLFTSQKLDSNTHLRHQKVQELLANVEQSCQAGGPVDIGQEAFRTSLNLLSNTIFSVDLVDPISETAQEFKELVRGVMEEAGKPNLVYYFPVLRQIDPQGIRRRLTIYFGRMIEIFDRMIKQRLQLRKIQGSIASSDVLDVLLNISEDNSNEIERSHMEHLLLDLFAAGTDTTSSTLEWAMAELLHNPETLLKARMELLQTIGQDKQVKESDISRLPYLQAVVKETFRLHPAVPFLLPRRVEGDADIDGFAVPKNAQVLVNAWAIGRDPNTWENPNSFVPERFLGLDMDVKGQNFELIPFGAGRRICPGLPLAIRMVHLMLASLIHSYDWKLEDGVTPENMNMEERYGISLQKAQPLQALPVRV

SEQ ID NO: 12016 - protein, 219 aa, Oryza sativa
KTCELVVLSVFLCGTLGTWLPGVLHHHLRGRPPRRRRRHSAHAYRAAAASRTPTTLSALSPSAHSSVKDTEKRTNTREKGGKAATTRGGGAAAETPVPIDLRFPDRPGFEAGGSVLLEMMLRGGRLAGLASRMVGAKPFSTEIFVSRLSFYTTEEELKNVFSPFGAVEEARLVRDNQTGRPKGFGFVKYSSQADAEKAVKAMDGRIIRGRLIFVEIAKE

SEQ ID NO: 12017 - protein, 476 aa, Nocardia farcinica IFM 10152
MSNRTGENRRHQVVVIGSGFGGLFGTKHLKRADVDVTLISKTSTHLFQPLLYQVATGILSVGEIAPATRLVLRKQKNARVLLGEVIDIDLEAKTVTSRLLNQNTVTPFDSLIVATGAQQSYFGNDQFATYAPGMKTIDDALELRGRILGAFEGAELATTQEMRDRLLTFVVIGAGPTGVELAGQIAELADRTLEGTFDNIDPRDARVILIEGAGAVLGPMGPKLGGKAQRRLERMGVEIQLNAMVTDVDAHGVTVKDADGTIRRIESSCKVWSAGVQASPLGKMLAERSAGTEVDRAGRVIVEPDLTIKGHPNVFVVGDLMSVPGVPGQAQGAIQGATYAAKQIKAGLHGQRPEDRKPFKYFNKGSMATVSRFSAVCQIGKLEFGGFIAWLAWLALHLYYLIGYRSRIITCIQWFVTFLGRSRGQMAATEQWVFARLALEQVNEDQADADELAAALGAPPAAGRAPGSKAADQRAS

SEQ ID NO: 12018 - protein, 399 aa, Oryza sativa (japonica cultivar-group)
MGAAMLLAPMPLLLLASTPLAAVHLPTRCRLRLQLLSRAAPEAASATTTTTTAPDNHFSVEEYLISNCNLTQPQAHKASKSIAHLKSRSNPDAVLAFLADFGLSPKEVAAIVASNPRILCARIDRSLAPICSELRAVGLSPSQIARLAQITGRYFLCRSFVSKVRFWLPLFGSSERLLQASDWNYWLLTSDLEKVVEPNVSFLKECGLSARDISKLLVAAPRLVTMHPDYVKDAVRRAIQLGVAPGSQMFRHALSTAGCIGQDKIDAKVAVLKESLGWSQEEVNLAVSKAPRILVASEERLRRNAEFLIDEVGLQPQYVARRSVLLMYSLERRLVPRHLVVKLLKERGLIEQDRCFFNAVAPTEEKFLEKFVVPFEGCVPGLADAYESACAGKTPVQAE

SEQ ID NO: 12019 - protein, 1124 aa, Mougeotia scalaris
MSSSKRSQSSGRSSTQTRIQNRVTQASADAKLSTAFEVSSSSGGDSFDYTKSVTASLNPTEPLAAKSVTAYLQRMQRGSIIQSFGCMMAVEPGTFRIIAYSENVSEMLGVTPQSVPTGDHQNAIGIGTDVRSLLSPSSVSVVEKAVAANDVSMMNPIAVYSLATQKLFFAILHMNDVGLVIDLEPISSSSDSAMFSAGAVQSHKLAAKAISRLQSLPGGDICGLCDVVVEEVRELTGYDRVMAYKFHDDEHGEVVAEIRRSDLEPYLGLHYPATDIPQASRFLFIKNRIRMICDCTSPQVKVVQDSRIPQEMSLAGSTMRGVHGCHTQYMMNMGSTASLVMSVTINDTNEIAGGPGMKGRKLWGLIVCHHSTPRHIPFPIRSACEFLMQVFGLQLNMEVELAAQHREKHILRTQTLLCDMLLRDAPMGIVSQSPNVMDLVKCDGAALLFGGRCWLLGISPTQEQVKDIATWLISSHTDTTGLSTDSLVDAGYPKARELGVDVCGMAAARITENDFLFWFRGHAQKEVKWAGAKDGGSEEDGSRMHPRSSFKAFLEVVKQRSLPWEDVEMDAIHSLQLILRGSFQDIEDKEDRKIVHARLKEMHLQGMEELSSVASEMVRLIETATAPILAVDTAGCVNGWNFKISELTGLSIPEVMGKSLVKDLTHPSSKDTVEKLLYMALNGEEEQNVEIRLKTWGMQQGKGPVILMVNACASRDVSEKVVGVCFVAQDVTGEKIVQDKFTRIQGDYTTIVRSHNSLIPPIFGSDESGFCVEWNPAMERLSGVKREEAIGKMLTRELFGGILRLKNVDGLTKFMIVLNAAMSSHDTDKFPFTFYDRSGKIVEVLLTTSKRCNSEGVVTGVFCFLHTASSELQQALTVQKAAERVAEVKAKELAYIRQEIQNPLDGIHFARSFMEHTVLSEDQKQLIETSATCEKQLRRILADMDLASIEKGYLELETGEFSMATVMNSVVSQGMIQSTQKNLQLYCDTPPDFKSLSVFGDQVRLQQVLADFLLNAVQFTPPSGWVEIKVEPVVKKLPGGVSVANVDFRVSHPGEGLPEDLIDQMFDRADARVKSQEGLGLSICRKLVRLMNGEVQYRREGERNFFLLQLELPLAQRDDQASMK

SEQ ID NO: 12020 - protein, 1252 aa, Streptococcus agalactiae NEM316
MKRKDLFGDKQTQYTIRKLSVGVASVATGVCIFLHSPQVFAEEVSVSPATTAIAKSNINQVDNRQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPQIENGYFRLHLKELPQGHPVESTGLWIWGDVDQPSSNWPNGAIPMTNAKKDDYGYYVDFKLSEKQRKQISFLINNKAGTNLSGDHHIPLLRPEMNQVWIDEKYGIHTYQPLKEGYVRINYLSSSGNYDHLSAWLFKDVATPSTTWPDGSNFVNQGLYGRYIDVPLKTNAKEIGFLILDESKTGDAVKVQPNDYVFRDLANHNQIFVKDKDPKVYNNPYYIDQVQLKDAQQTDLTSIQASFTTLDGVDKTEILKELKVTDKNQNAIQISDITLDTSKSLLIIKGDFNPKQGHFNISYNGNNVTTRQSWEFKDQLYAYSGNLGAVLNQDGSKVEASLWSPSADSVTMIIYDKDNQNRVVATTPLVKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDQSLDGKLKNQFVTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGKPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKGSKTVEKVNRIANKTSITPVVSNKTDSYLTNEANLPKTGDKSSKILSVVGISILASLLALLGLSLKRNRHLK

SEQ ID NO: 12021 - protein, 628 aa, Glycine max
MAFSCKLDSFILSAYKPQNSILPLSIQPSSFLPSPSSLKPQKLPFRIRYGSTIRATSSSSTPSATIAEPEGIKIKSIPTKPIDGQKTGTSGLRKKVKVFMQDNYLANWIQALFNSLPPEDYKNGLLVLGGDGRYFNQEAAQIIIKIAAGNGVGKILVGQEGILSTPAVSAVIRKRKANGGFIMSASHNPGGPEYDWGIKFNYSSGQPAPESITDKIYGNTLSISVIKIADILDVDISKVGVTKFGSFSVEVIDPVSDYLELLETVFDFQLIKGLLSRPDFRFIFDAMHAVTGAYAKPILVDKLGASLDSISNGIPLEDFGHGHPDPNLTYAKDLVNILYAENGPDFGAASDGDGDRNMILGRSFFVTPSDSVAVIAANAREAIPYFKNGVKGLARSMPTSGALDRVAKKLNLPFFEVPTGWKFFGNLMDAGNLSVCGEESFGTGSDHIREKDGIWAVLAWLSIIAHRNKDKNPGEKLISVSDVVMEHWATYGRNFFSRYDYEECESEGANKMIEYLRDILSKSKPGDQYGSYVLQFADDFTYTDPVDGSVVSKQGVRFVFTDGSRIIYRLSGTGSAGATVRVYIEQFEPDVSKHDVDAQIALKPLIDLAISVSKLKDFTGREKPTVIT

SEQ ID NO: 12022 - protein, 456 aa, Coprinopsis cinerea okayama7#130
MPRAVKQPTKPRHDPLHVQLNEDELHSKYGRVTQPGKRKKARRNDSDNEDTSEVILDPKTSRRIFELAKDQQQEIEFPEDEDDEPIREDPSAALSRPRTQASDDDDDENEDMDFEGVHDVDYEEEFEIDADDLETLDAIHPHNSTERRTLADLIFSKLDNPDSTPVAAIQKVQQDRDAPDPALGLNPAVVEAYEKVGVFLSKYKSGKLPKLFKVIPSLPAWARMLALTRPENWTPHACRAATKIFISNMKPAQAQLFLGVVLLDAVREDIRENKKLNVHYYEALKRALYKPAAFFKGLIFPLLDQGCTLKEAAIIASILAKVKVPVLHASAALLRIAEMDYSGPNSLFIRVLVDKKFDLPYKVIDALVFHFIRLSNTYKAKSRGDTEKLPVLWHQSLLVFAQRYASDLTPDQKDALLDVIRATPHPQISPEIRRELVSSVVRGAPRPDADQDIVMS

SEQ ID NO: 12023 - protein, 268 aa, Triticum aestivum
  misc_feature (236)..(236): Xaa can be any naturally occurring amino acid
  misc_feature (252)..(252): Xaa can be any naturally occurring amino acid
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFRDKLGAGEYQTVIGASAISGFCAAACSLPFDYVKTQXQKMQPDATGKYPYTGXLDCPCKLEDGGHLSSL

SEQ ID NO: 12024 - protein, 195 aa, Clostridium thermocellum ATCC 27405
MDRKFEVSRKTGETDITLSINIDGSGKSNISTGVGFFDHMLNLFAKHGLFDLDVKAKGDLEIDAHHTVEDVGIVLGQAIKQALGEKKSIRRYGSSFVPMDEALVLVALDLSGRPYLVFDAELKCEKLGNMETELVEEFFRAVAFNAGITLHVKALYGSNTHHIIEAMFKAFGRALDDATRKDDRIEGVMSTKGML

SEQ ID NO: 12025 - protein, 851 aa, Ostreococcus tauri
MATRAIASARSRAPARAREGTSLARARRWTRSPHRGVSGRRSRATRWTLDAVSTEDAEGWRRETSKAKETRPTRTTVADAGRGVDDVHARTRVAREAKRRTAPRGVPGVCDTPRRGDASALGATRVVGCPDDTVNFAVYTSAATAVSLVLWTPEGLARGEIAGEIELDETTNKTGSVWHVALPRCAEDVLYGYRVDGPYEPEAGHRFDKSKILLDPYAKFTVSRPEYGVASKKEDGTEDCWPQYAGGVPKKLRSDGKEDFDWEGVTSPKRPMRDLVVYEAHARGLTADLETKAKPGTYAAIEEALPYLKQLGVNAIELMPCHEFNEMEYHSLNHVTGEFRRNFWGYSTVNFFSPMTRYAEAGADDCGREAAREFKRMIRECHRAGIEVIMDVVFNHTAEGNEQGLTLSFRGLDNRVYYMVAPEGQFYNYSGCGNTMNCNHPVVREFILECLRYWVLEYHIDGFRFDLASILTRASSMWDRANIFGEPTAETPMLEEVVIGTPLQDPPLIDAISNDPVLAGTKLIAEAWDAGGLYQVGSFPHYGVWSEWNGKFRDDVRNFIKGVDGYAGLFAERLCGSPNLYADRSPSASINFVTAHDGFTLRDCVSYNEKQNHANGEENRDGEEHNASWNCGLSCDDDGECWDPEIVALRDRQMRNFVVALFVAQGVPMMYMGDEYGHTKCGNNNTYCHDNALNWIDWSEASSPLAGDGLARFTKQVIALRKKHSAFRLDSFPSADNIQWHGHLPDTPMWDEESRFVAFTLQDKPETDKFYIAFNSHHEPAMLKLPSPPERCKWKLILDTSLESPFDVLSAEDIAEADSYTAEAMFLPGLRKNTYLCADRSAVIFRAVSLA

SEQ ID NO: 12026 - protein, 1057 aa, Ostreococcus tauri
MSVTHTSLSSINESLPRLARARAHVDAGRRRDGLIIRKSFGRSRTPIARARAVSDVDVPDATILRVRYHRTDGSSYAGWGAHAWGDVRAPTTWDAPLAATLDDYSTWATFDVELVSGASRVSVLIHRGEDQDCRAEDLDVSAGTREVWLVSGYSCAFEQEPDLKALPKGDVDKHRAIWVSASVIAVPPDFALSAAARESVKYSLVSSESAELRVTGEGVEGGDGEPQTLELIPTGLSKGAREKFPHIAAADYRALELPPSAPVRDLLRRQLAVAAVDEDGAPVDATGVQLQGALDELYAYDGPLGAEFGSDNLVTLRVWAPTAQNVTLSVFDEPRGDATRIEKSMTRDSRTGVWSVSGEFDGKFYNYNVTVFNPSTGQVSTNVSSDPYARSLAADGRRAHVCDISKDDLKPAGWESFEKPTFTHPVDCAIYELHIRDFSAMDDTVSSAARGKYVAFTESSSTCVSHLRKLAQAGLTHVHLLPSYDFGSVPELPENQKSVDFEQLAALPSNSSKQQELIEECNWCDAFNWGYDPVHYGVPEGSYSTDADGSRRVLEYREMVKSLAENGLRVICDVVYNHTLSSGPSDVNSVLDKIVPGYYHRRNFDGFIEASTCCNNTASEHYMMDRLIVDDLVHWARSYKVDGFRFDLMGHLMLSTMLKAKKALNSLTLERDGVDGKSLYLYGEGWDYAEVAQGRVGKNASQLNLAHTGIGSFNDRVREGCIGGSPFADPRLQGFLTGLYYSPNGVVQQGDEESQRYRMMEDGERILAALAGNVRDFAYVDRHGVEVMASSAVWPNSNVAYAGEPEETVNYVSAHDNETLFDSITLRVADSISLAERCRINHVATAIVALAQGVPFFHAGDEILRSKSLDRDSYSSGDWFNRLDYSGETHNFGVGLPPARKNGDRYAFITEMLADLSMRPTKENIHAATKNLCELLSIRRSTPLLRLRSSHDIQRRMKFYNRGPAQTPGLIIASINDGDASTPGLQALDSNYKRIVLAINATPRRISHEEAGLKVDFAGVELKLHPLISDAVAAESSVVDGAYTIPPYTWAVFVQCR

SEQ ID NO: 12027 - protein, 345 aa, Cenarchaeum symbiosum
MLWFVGMGLAGAGSIPADAKNVIEQAEMVYLEGFTSIVTESDERALEEMAGGKIIPARRWMVEDGKEILDNARTKKVVLVSYGDPYTATTHIELRTRAAELNIPTGSIHAASILASAVGECGLHHYKMGRTATVTRDPRAASTPYRIIYENLVSGSHTVLLLEYDQDGGFFLDPGDALGLLIEYEKEQRRGVITDELFAVIASRIGMKGQSIVAGRISSLKGYDFGAPPHAVIIPGGLHFTESEALSASAKCLDAPSDNSERMPSIPQQMVKKYVPMVRDAMKTIEALEDNPPEYGHVLENAGHYLRDAEEFMGKGEGELAVLSVGYADGLVDALRMARGIDRVQ

SEQ ID NO: 12028 - protein, 396 aa, Solibacter usitatus Ellin6076
MATPKHEYYETLGVPRKADAEEIRKAYRKLARKYHPDLNPGDKSSEERFKNVQEAYDILSDPKKRQMYDQFGFYSENGGYPGAGPGGQPGGGPQGAHFDGFDFSDYMSGQGGAAGGRRTQGTSSQGGGGFRDIFSQFFGGGAAAEQAEPERGADLEYVMNIDFWQAIKGTTARVNITRYDVCTTCNGTGSTGSGEVTCPQCKGVGQVTQMAGAMKFNLTCPRCGGAGKLRNACPTCGGDGRVPKTETVEIRIPPGARDGSRLRVAGKGNAGTMGAAPGDLYITTKVEPHQFFHREGDNIEIKAPIAIWEASLGAKIEVPTIDGRTLLKIPQGTVNGQKFRLREKGVLNSRTNQRGDQIVEVQLTTPDPRDEKTRQLLRDLAELHPEDPRAEMWSKV

SEQ ID NO: 12029 - protein, 422 aa, Oryza sativa (japonica cultivar-group)
MSITSASRRAGAAALPILRRIGGAFRRPFSSEPDPASSPGYHVAGGPSFMRGAVFWEPGRPLTLEDFRMPRPKAGELLIKTKACGVCHSDLHVLKGELPFSSPCVVGHEITGEVVDHGTHTPAEIINRFPVGSHVVGAFIMPCGNCFYCVKGQEDLCESFFAYNRAKGTLYDGQTRLFLRSNGKPVYMYSMGGLAEYCVVPANALAVLPNSLPYTESAILGCAVFTAYGALRHAAEMRAGDSVAVIGVGGVGSSCLQIAKAFGASEVIAVDVLDEKLQNARTLGATHTVNAAKEDAVEKIKEITDGRGVDVAVEALGKALTFSQCAKSVRDGGKAVMIGLAATNVMGEVDITRLVRRQVKIIGSYGARARQDLPQIVKLAESGAFNLKNTISRKCKFEEANSAYEDLDRGKIVGRAVVEIMS

SEQ ID NO: 12030 - protein, 658 aa, Colwellia psychrerythraea 34H
MNNSTDAVNPAKKPQTRREKREAAEAFLKNVSDQSFPNSKKVYVQGEIHDIKVGMREITLSDTLVSGSKDKPVYEKNEPLCVYDTSGFYTDENVEIDVHKGIPRLRETWIDARDDVETFTSTHSEFAQQRLDDEGVDEIRFEHLPKMRIAKKGKNVTQMHYARQGIITPEMEYIAIRENLKREEVKDATLLLQHKGQSFGASIPEQITPEFVRDEVARGRAIIPVNINHPECEPMIIGRNFLIKVNANIGNSAVTSSIEEEVEKLVWSTKWGADTVMDLSTGRNIHETREWIMRNSPVPIGTVPIYQALEKVNGVAEDLTWEIFRDTLIEQAEQGVDYFTIHAGVLLRYVPMTAKRVTGIVSRGGSIMAKWCLAHHKENFLYTHFEDICEILKQYDVSFSLGDGLRPGSVADANDEAQFAELHTLGELTKIAWKHDVQTIIEGPGHVPLHMIKENMEEQLEHCGEAPFYTLGPLTTDIAPGYDHITSGIGAANIGWYGCAMLCYVTPKEHLGLPNKEDVKEGLMTYKIAAHAGDLAKGHPGAQIRDNAMSKARFEFRWYDQFNIGLDPERARTYHDETLPQESGKVAHFCSMCGPKFCSMKISQEVREYAANLDKNAIKIQLLDETITLTSDEAIERAMQEKSAEFKATGSEIYQLAE

SEQ ID NO: 12031 - protein, 58 aa, Oryza sativa (japonica cultivar-group)
MVLWELTAITAYFLGLRRTYRLALRIQRRLIGPNHPRIRHFVYRSLSSPSPPHAPRAL

SEQ ID NO: 12032 - protein, 141 aa, Solibacter usitatus Ellin6076
MSRVRDVVHQCQLFSVEEHQSVAQVARVMAGFKVGAILVLKGDDLAGIFSERDLMTRIVLERRDPDLTPVRDVMTTDVCTIDESATPEEAMEAMQANNCRHLPVTRDGRVVAFLSMRDLMNFEVARQTEEIYHMRAYISNA

SEQ ID NO: 12033 - protein, 624 aa, Oryza sativa (japonica cultivar-group)
MEHKGLCILAVVIAFQLAGGEAVTDATARARRFACNVSAPCDTFVVYRTQSPGFLDLGNISDLFGVSRALIASANKLTTEDGVLLPGQPLLVPVKCGCTGARSFANVTYPIRPRDTFFGLAVTAFENLTDFVLVEELNPAAEATRLEPWQEVVVPLFCRCPTREELSAGSRLLVTYVWQPGDDVSVVSALMNASAANIAASNGVAGNSTFATGQPVLIPVSQPPRFPPLTYGAIAADPGAGKHRHGIIVATSIAGSFVACAVLCTAILAYRRYRKKAPVPKHVSPKLSWTKSLNRFDSNSSIARMINGGDKLLTSVSQFIDKPIIFREEEIMEATMNLDEQCKLGSSYYRANLEREVFAVKPAKGNVAGELRMMQMVNHANLTKLAGISIGADGDYAFLVYEFAEKGSLDKWLYQKPPCSQPSSSSVATLSWDQRLGIALDVANGLLYLHEHTQPSMVHGDVRARNILLTAGFRAKLSNFSLAKPAAMVDAAATSSDVFAFGLLLLELLSGRRAVEARVGVEIGMLRTEIRTVLDAGGDKRAAKLRKWMDPTLGGEYGVDAALSLAGMARACTEEDAARRPKMAEIAFSLSVLGQPLSVSDAFERLWQPSSEDSIGIGNEVAAR

SEQ ID NO: 12034 - protein, 512 aa, Bacillus anthracis str. Ames
MKKQHDTIIVLDFGSQYNQLIARRIREFGVYSELHPHTITAEEIKAMNPKGIIFSGGPNSVYGEGALHCDEKIFDLGLPIFGICYGMQLMTQQFGGTVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 12035 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 12036 - protein, 220 aa, Clostridium thermocellum ATCC 27405
MENILKELKFDDRGLIPVITQDYKTNEVLMMAYMNEEALKKSLETGKVHYFSRSRNKLWLKGETSGHFQLIKSISIDCDADTLLIKVEQVEAACHTGHYSCFYREISGNELKETSDKVFDEQKVYEAENAKILQEIYDVIVDRTIHPKEGSYTNYLFEKGLDKILKKVGEEAAEVIIGAKNRDKGEIVYEISDLIYHLLVLMVERGIKLEDIYEELRKRR

SEQ ID NO: 12037 - protein, 360 aa, Aspergillus nidulans FGSC A4
MAAARTLRIGLIPGDGIGREVIPAGRRILEALPASLNLKFNFVDLDAGYDCFKRTGTALPDKTVEVLKKECDGALFGAVSSPSTKVAGYSSPIVALRKKLDLFANVRPVKTTAGTSAGKPIDLVIVRENTEDLYVKEESTEETPNGKVARAIKQISERASSRIATIAGEIALRRQNIRDGAAASGLRTKPMVTITHKSNVLSQTDGLFRETARAALAAQKFSSVEVEEQIVDSMVYKLFRQPEYYDVIVAPNLYGDILSDGAAALVGSLGLVPSANVGDNFAIGEPCHGSAPDIEGKNIANPIATLRSVALMLEFLGEEQAAAKIYAAVDGNLDEGKYLSPDMGGKATTTEVLEDVLKRL

SEQ ID NO: 12038 - protein, 526 aa, Zymomonas mobilis subsp. mobilis ZM4
MSVSSIADKIVSESILIVDFGSQVTQLIARRVREAGVYSEIVPFNRAEEAFQRLQPKGIILSGSPASVVAEGSPRAPESFFQAGIPIFGICYGQQVMCHQLGGKVTANDVDGEFGRAFIDVIAPSPLFENLWKVGEKHQVWMSHADRVEALPEGFKPIAVSDGAPFALIADEKRRFYGMQFHPEVVHTPDGGKLIAHFVHDICGLAGDWTMAEFRQTKIAEIRKQVGDGRVICGLSGGVDSSVTAVLVHEAIGDQLTCVFVDHGLMRQGEAEQVVSLFREHYGIKLVHVNAEDRFLAGLKGVTDPETKRKFIGKTFIEIFEEEAKKIGGADFLAQGTLYPDVIESVSFLGGPSVTIKSHHNVGGLPERMNMKLVEPLRELFKDEVRDLGRELGMPDVFVDRHPFPGPGLAIRIPGEVTKERCDILRKADAVYLEEIRNAGLYNAIWQAFAVLLPVRTVGVMGDGRTYDSVCALRAVTSTDGMTAEIYPFQPEFLANVATRIVNEVRGINRVTYDFTSKPPGTIEWE

SEQ ID NO: 12039 - protein, 337 aa, Zea mays
  misc_feature (205)..(205): Xaa can be any naturally occurring amino acid
VGIWATAAASSLFRNGEASYSNSTHEGIKTIPVQRACEFTTNSVLCVCIVTWNMNSKMSAEDVAKLVSSDRKFDLLVVGLQEAPKPDVSRVLQEALAGTHVLLGQKSMQSLRMLLFGSRSSEKYIREMKVDKHAVGGCGGIIGRKKGAVAMYINFSGIRMVFVSCHLAAHEHKVEKRNAEFQHISQSLFARYGAPTPYAQSADIXTVWLGDLNYRLQGISSTPARKMIEENRQSKLRGRDQLLQEAEKGQVFSGYCEGTLSFKPTYKYDVGGSVYDTSYKCLRAPRADRPLRSRVGQSSGLDAVLSSYESLDCVRSSDHKPVKAHLCLKVRSDGDAD

SEQ ID NO: 12040 - protein, 224 aa, Candida albicans SC5314
MSSDKSNLLKKYKIVFLGDQSVGKTSLITRFMYDTFDETYAATIGIDFLSKTMYLEEGKTIRLQLWDTAGQERFRSLIPSYIRDSHVAVICYDITNKKSFDNLDKWIKDVKLERGDDVIIVLVGNKSDLASDKRQVSLDDVENLQIKIGAKFFIETSTKANHNVKLLFKKIAQSLPDFNQDSNDKSNDNNNNNNNNNNNNNQSETIDITIDNTAPNPQGTSTCC

SEQ ID NO: 12041 - protein, 475 aa, Ostreococcus tauri
MSERRIARGRDARARVVTRMDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTI

SEQ ID NO: 12042 - protein, 465 aa, Desulfovibrio desulfuricans G20
MAPQFCTTPVPVPPVHTGYRHIATPLPVPESLALLEEMRACEPRSVDCQPPLVWHGAQGVQVYDPYGNIWLDFTSGVLVTNIGHCQPEMVQAARAELDAHRFFSYCFATEPRIRLARRLVDMLQPHIGTACKAFIMSTGSEATENALKLARAHGRSLHPEKNVIVSFDRAFHGRTLGAQQMGGYPAAKSWIGNLDPAFVQVPFPDGLHCTDTSFNLFSRRLAQLGIAPQRVAGVIMESYQGGGASFAPEEYVRELRSFCSRHEALLIMDEVQSGFGRTGRLFAFEHYGIAPDLVCLGKAVSGGLPVSAVAGRADVLDMHDPGSMTSTHGGNPVACASAAANLEVLLRDGLTEAAAATGHILRQGLEGLRQRHAGHIMAIHGRGMVQGIHVGRTEPDGTPCPDGALAFDVTERAFRKGLLLFAPVGTGGATIKICPPLIMQPDAVLEGIDVLTQCFDEALSAETDR

SEQ ID NO: 12043 - protein, 453 aa, Cytophaga hutchinsonii ATCC 33406
MKEYFYKKISQLDYKEFHRTAYQLIPLWVASVLVGVAAVMYARGFLYVEDLSTEFLHTYPEAIFAISPVAFLSSWFLVKVFAPMAAGSGIPQVMAAVELEGKSNLSRKLLNVKVSIVKVLSSLVMLAGGGAIGREGPTIQISASIFSFMHHALPKQWEKFSAQLMVLTGAASGLAAAFNTPLGGIVFAIEELTRIQFSKFRTTLFVAVIISGMTAQAMLGPYLYLGFPKVQVAGYSYILWVIAAAALAGFMGGMFGSLILVIHRWKKTIKTTGKHIAIVLIFALSFASIYYFFNRSVIGAGKEVMEDLLFISNKDVSPSLVLSRFFGPILSFGSGGAGGIFAPSLCAGSTIGAFIAYVADIPSEFTNLLILAGMVGFLTGVTHSPFTSAILVLEMTDRHSVIFYLMLAGMFAYLVSMLVDKKSVYEHLKEGYLNSFLPPEGKTPEPTETDVAK

SEQ ID NO: 12044 - protein, 425 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASFPRMGLI

SEQ ID NO: 12045 - protein, 514 aa, Oryza sativa (japonica cultivar-group)
MDLLRDRRLGALLVVVLVLVSGAAVEASIHTYDREPFREVGNAFLLSGGSEGVVADGADLAAPASSFIKFTNVTFWRTPESAESHAKMAHSTGLVQAILFEAADRDNIGGSAYGGQRSICCTPDLAKLEGCKQGEVIRRPSSDDPDWPYVLDTHFSGSHLSVKLEDEVVRITKTGMYNLFFISCDPKLRGLSMSGKTVWRNPGGYLPGRMAPLMKFYVFMSLAYLLVMVVWSSQYIRFWRDIMPIQNWITLIIALGLFEMTLWYFEYLNFNSSGVRPIGITTWVVTVGAIRKTISRLLILSISMGYGVVRPTLGGLTSKVLLLGLTYFLASELLDIAENVGTINDISGKARLFLVLPDAFLDAFLILWIFTSLSRTLEKLQARRSSVKLDIYRKFTNALAVSVIASVAWIGYEVYFKATDPFSERWQSAWIITAFWDVLAFVLLLVICYLWAPSQSSQRYAYSGEAADDDDEESQSLTKGTDGDVGMVKVDKDRSGGVSSAFSLEDEAEEDKRE

SEQ ID NO: 12046 - protein, 144 aa, Nocardia farcinica IFM 10152
MRIAEILRRKGCEVATVTPGTTVRALLAVLAEHNIGAVVVSPGGGRISGIVSERDVVRGLHEYGAGLLDTPVSDIMTTPVRTCAPEDRVDGLRRIMTEHRVRHLPVVRDDRLVGIVSIGDVVKSAISELATERQLLVDYVQGRY

SEQ ID NO: 12047 - protein, 276 aa, Mycobacterium smegmatis str. MC2 155
MPGRRPAAPGEPRKAAVLGSPIAHSRSPQLHLAAYRALGLTDWTYERIECTAEQLPGLVEAAGPEWVGFSVTMPGKFAALQFADQRTDRAELVGSANTLVRTEAGGWRADNTDVDGVAGALGTAGEAALVIGSGGTAPAAVVGLAEMGVQHITIVARNADKAAALVDLAGRCGAQGDWCDIAGPALTDAVAQASAAVSTIPADAAAGYAPTLAAVPRLLDAIYNPWPTPLATAVQAAGGEVISGLQMLLNQAYSQVELFTGRPAPKEAMRAALEEP

SEQ ID NO: 12048 - protein, 156 aa, Ostreococcus tauri
MEAPMTSFEAGARQEGWGSAGGGAAPWTPTRELKKRKSYFKRCGHMMETLERERMKELAAERVIVPFRPGDVVKLTLEVPENMRKTQTFTGICIAKRHRGMGSSFTLRSAVGNLVVERTFPLFTPNIKGMEILERRKVRRAKLYYLRDKPLRYSRP

SEQ ID NO: 12049 - protein, 457 aa, Mesorhizobium sp. BNC1
MLYHRAKNSWEQRDQENVFHGFTDLETLNQNGPVVLTHGEGIHVFDVHGKSYMDANSGLWNNVAGFNHKGLIEAICDQARRFPGYHAFFGRIADTTVALSEKLIEISPFPSGRVYYTNSGSEANDTVVKMLWLLHRRNGQPQRRKIITRVNAYHGVTVATASMTGKTYNAEFGLPLPGFLHADCPHHWRYGEPGESEAAFSQRLARKLEELIIKEGPDTIAGMFAEPVQGAGGVIPPSRGYFEAIRPILRKYGIPLIADEVITGFGRTGEMWGGDKYNVEPDAIVASKCITAGYFPMGAIILGPELADALTRACEAAEEFPHGFTSGGNPLGSAIALKALEVIETEGLLDNVRRVSPRFLAGLDRLARHDHAGEARGVGLMGAVELVADKNSKAPLDGALRIPERIANKALEKGLICRPLGQAIVLGPPFIITEGQIGEIFDILEDTMAEVFADVGL

SEQ ID NO: 12050 - protein, 428 aa, Arabidopsis thaliana
MVSVSLPKELILEILKRLPAKSVKRFHCVSKQWASMLSCPHFRELFLTRSSSAQPRLLFAIEKHNQWSLFSLPQRLTPYEKSSSSSVVVTPEFHMKFPPDGMLIYPRHDRRFSFGYASGLMYFYGMWINEHDYDGVPVICNPLTGRYASLPFLERYRKAFSFFGFDPIEKQYKVLFMAYPSGPDHHTVLTFGTGEMSWRKIECSVKHDIVSDGICINGVMYYLGDTSEFMTAFVVVCFDVRSETFSFIYPGSYCEVINYKGKLGLVFCDDYTDDAIELRLWVLEDKEKIEWSKYAYKLKDEKFSAHYVSIVGVSAAGEIVLSMADFTSKQPFYVFYYNPERNTLQCTEIQGFEEHHGTFDRRSRVRVFVDDCSSFYRFADHVEYLNVDEPKLLKSKIYDGPNAKIEWEEEEEEDEDEDQEKEEEDQWS

SEQ ID NO: 12051 - protein, 361 aa, Penicillium chrysogenum
MNTLSVRAPLRAAAKPQYLHLAVRTYSGVAATTLNPACGANKRTSIFSLTSKRPISSTPQNQITDYFPPPKAPNVKEVQTAWVHPVYTESQMQNIRIAHRQAANWSDWVALGTVRIFRWGMDTATGYRHPKPGQELPDMFKMTEHKWMNRFIFLESVAGVPGMVGGMLRHLRSLRKMKRDNGWIETLLEEAFNERMHLLTFLKLAEPGWFMRLMVIGAQGVFFNGFFLSYLISPRICHRFVGYLEEEAVITYTRAIEELEAGKLPQWDDLDAPEIAIKYWQMPEGQRKMKDLLMFVRADEAKHREVNHTLANLKQTFDPNPYQIEYTDPSISHPTKGIDNLKPEGWDRDEVFITESRQVKP

SEQ ID NO: 12052 - protein, 98 aa, Brassica napus
  misc_feature (87)..(87): Xaa can be any naturally occurring amino acid
ARIVALNSSFFLKTGGHFNISIKVSSSTSVFILDMLINVHSSIVTQRIFLSCLQQANCIDSTVPAEAVFQSEVKKLQQEQFKPAEQXTLEPFERDHAC

SEQ ID NO: 12053 - protein, 350 aa, Saccharomyces cerevisiae
MVVNNPNNWHWVDKNCIGWAKEYFKQKLVGVEAGSVKDKKYAKIKSVSSIEGDCEVNQRKGKVISLFDLKITVLIEGHVDSKDGSALPFEGSINVPEVAFDSEASSYQFDISIFKETSELSEAKPLIRSELLPKLRQIFQQFGKDLLATHGNDIQVPESQVKSNYTRGNQKSSFTEIKDSASKPKKNALPSSTSTSAPVSSTNKVPQNGSGNSTSIYLEPTFNVPSSELYETFLDKQRILAWTRSAQFFNSGPKLETKEKFELFGGNVISELVSCEKDKKLVFHWKLKDWSAPFNSTIEMTFHESQEFHETKLQVKWTGIPVGEEDRVRANFEEYYVRSIKLTFGFGAVL

SEQ ID NO: 12054 - protein, 365 aa, Cytophaga hutchinsonii ATCC 33406
MILLNLMLYFCSMQTTSTEIKKKCIRSLSAEELKDFFVASGEKAFRSRQVYEWLWKRSARSFEQMTNLSKETRTLLENNFSINPVTISQKQVSTDGTIKFGFKLHDGYLVEGVLIPADDRMTACISSQVGCSLTCKFCATGYMDRKRNLEPYEIYDQVVLIKEAAEEHYQTPLTNIVLMGMGEPLLNYTNVLKGIDKVTSEEGLHIASKRITLSTAGIAKMITKLGDEKVKFRLALSLHAANDVKRNTIMPINETNNLNVLKESLLHFCKETGSSVTFEYIVFDGVNDTAQDAKELYAFAKNIPCKINIIEYNPIQEADFMNTSVDKLEQFKKVLTDKGIIVNIRRSRGKDIDAACGQLAIKEVK

SEQ ID NO: 12055 - protein, 399 aa, Ostreococcus tauri
MVRSGMRYGYRINGEGGWDTGQRFDATKVLMDPYAPLVEARRKVFGEWSKHKVSGDTNDPDMLSGYDFESAPFDWRGVESPQIDEKDMIVYEMTVRAFTADASSGLDADARGSYAGVAAKVEHLKSLGVNVVELLPVFEYDEMEFQRIPNPRDHMVNTWGYSTMSFFAPMTRFGKKGCSAREASREFKEMVRALHAAGIQVILDVVYNHTGEMNDELPNTCSMRGIEYKTYYMTDTNQYVQMLNFTGCGNTLNANNPYVSQFILDSLKHWVKEYHVDGFRFDLASALCRDEQGHPMNSPPLIRAIAKDPELAHVKLIAEPWDCGGLYQVGSFPNWDRWSEWNGAYRDVLRRFIKGDEGMKSDFARRISGSSDMYHHNNRKPYHSVNFITAHDGFTLRDL

SEQ ID NO: 12056 - protein, 586 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 12057 - protein, 634 aa, Brachypodium sylvaticum
MARFAAATLLFQAAVMAVTPHSSSTPPSMPGCPSSCGDVTIPYPFGVGAGCHLAGFGLTCDVATLLGPPKLRLVVTGCNVQAVLLDEISRRVVAACTAICSARTTVAHDDDSCAGAGCCQASIDTGLASYGIRLSSFGDATPNSSLDESASVFITDSAWFRENAGKLLDDGDKPPAVLDWGIGNSGASHGGYSCRCQHGYAGNPYVADGCQDIDECALPEEYPCYGECMNRPGSFLCLCPGGTQGDARTEGGCGIAFPSLYVIALTMAYLIKARRVKKLKELFFKQNRGLLLHQLVDKVIAERMVFTLEELETATNQFDQRRKLGSGGHGTVYKGFLPNRHVVAIKKSNITVQKEIDDFINEVVILSQINHRGVVRLFGCCLETRVPLLVYEFISNGTLSDHLHVEGPESLPWTDRLRIALEAASALAYLHSSASVSIIHRDVKSANILLDDRLTVKVSDFGASRGIPIDKKGVTTAIEGTFGYLDPEYYQTSRLTDKSDVYSFCVVLVEMLTRKKPTVFTSTENASLIALFNLRMMQGKLYQILDPQLISEGMETAEEFAALASACLSLKGGERPTMRQVEMRLERLLGPNLVIEVEQGCSTEVQCTLTQMSNGNSRQYSMEQEFLSSATFPR

SEQ ID NO: 12058 - protein, 103 aa, Zea mays
  misc_feature (57)..(57): Xaa can be any naturally occurring amino acid
MSGRGKGGKGLGKGGAKRHRKVLRDNIQGITKPAIRRLARRGGVKRISGLIYEETRXVLKIFLENVIRDAVTYTEHARRKTVTAMDVVYALKRQGRTLYGFGG

SEQ ID NO: 12059 - protein, 502 aa, Arabidopsis thaliana
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESPYKFLAFNAGPRTCLGKRLTFLQMKTVAVEIIRNYDIKVVEGHKPKPVPSVLLRMQHGLKVSVTKI

SEQ ID NO: 12060 - protein, 549 aa, Bacteroides fragilis NCTC 9343
MQLYERTLGQWLEHWAETTPDKEYIVYSDRNLRFTWKQFNKRVDDMAKGLIAIGVERGTHVGIWAANVPDWLTLLYACAKIGAVYVTVNTNYKQAELEYLCENSDMHTLCIVNGEKDSDFVQMTYTMLPELKTCERGHLKSERFPYMKNVIYVGQEKHRGMYNTQEILLLGDNIEDTELNELKSQVDCHDVVNMQYTSGTTGFPKGVMLTHYNISNNGFLTGEHMKFTGNDKLCCCVPLFHCFGVVLATMNCLTHGCTQVMVERFDPLIVLASIHKERCTALYGVPTMFIAELNHPMFDMFDMSSLRTGIMAGSLCPVELMKQVEEKMYMKVTSVYGLTEAAPGMTATRIDDPFDVRCNTVGRDFEFTEVKVLDPETGEECPVGVQGEMCNRGYNTMKGYYKNPQATAEVIDKNNFLHSGDLGIKDEDGNYRITGRIKDMIIRGGENIYPREIEEFLYKLDGVKDVQVSGIPSKKYGEAVGAFIILHEGVTMQASDVQDFCRNKISRYKIPKYIFFIDEFPMTGSGKIQKFKLKDLGLKLCEEQGIQII

SEQ ID NO: 12061 - protein, 194 aa, Burkholderia thailandensis E264
MQRPPARPRAAHGRALMRRALSSLSLTVCRPNLFTMAARRSLRSADGYVATDVEPRSAAASPDRAAADPRDNTRTLRMGKLTTHVLDTAHGRPGAAIKIELHAISGGGSRLLKTALTNDDGRCDAPLLEGDALAAGTYELVFHAGDYFAAQGVALPEPRFVDLVVLRFGVADPAAHYHVPLLVSPWSYSTYRGS

SEQ ID NO: 12062 - protein, 624 aa, Methylococcus capsulatus str. Bath
MCGISGLVQLEGVADTSAMRRSVETMVKALAHRGPDDSGVAGDGSAVFGMARLAIRGCHDGRQPMVDAETGVMMVCNGEIDNHAELRGWLAERGRAVEHATDVAVIPGLYLELGDGFVERLVGAFALAVWDPRRGRLLLARDRAGERPLFYACRDGRVSFASQAAALVAGSPEPYPADEAAVQAFLKAGYFEAPASPFAGMRKVLPGERIAIDVKGVERSRYWRLNFTRGPARKNPLDEFDAVFREAVRRQSEVEVDFGAFLSGGVDSSLVTAVMRSVHPDRKLKAFGLRFSESSYDEGVFAERVAESLGVDYTPIWVRPEDFPETLADLVRQSGEPLADPAWVPTALLARRASDEVRVALVGEGADELFGGYPTYFGARLAERYSRLPGGLRALIRKAVEAWPVSDKKVTVSFLLKRFVQGDELDFLARHVLWTSSIPPALLRRLGVTPPETPHVAGPQETMLDRLQQHDLETSLAEGLLTKADRASMRSALELRAPFLDKDVIEFAATLPERERVQGLETKVFLKRVALRYLPKDIVYRKKRGLSVPLSAWLRGPLHDWAEARISSPRLEELGINRAAALELLREHERRSADHARALWTLIVVSEWLEWKAGMEAHPAAFTA

SEQ ID NO: 12063 - protein, 345 aa, Medicago truncatula
MLKKRKNVTIFFLPLPLPSELMRISIPSFTGKRRLKDLLVQKDNRFCADCSAPDPKWASANIGVFVCLKCCGVHRSLGTHISKILSVTLDEWSNDEIDAMMEVGGNASANSIYEAFIPEGYTKPGPDASHEERAKFIRSKYERQEFLKHSLRILSTKSKRQTSFSKKIMDSFRKSSGSKNMEGMVEFIGMLKVKVVKGTNLAIRDMRTSDPYVVLKLGQQTVQTTVIRSNLNPVWNEELMLSVPQQFGPISLEVFDHDLFSADDIMGEAQIDLQPLINSAMAFGDTGMFDDMRIGKWLRSNDNALIEDSIVNIIDGKVKQEMFIKLQNVECGELNLELEWMSLDH

SEQ ID NO: 12064 - protein, 263 aa, Mycobacterium smegmatis str. MC2 155
MPDARALGAAQLWIGTSWKMNKGLAESRGYARELAEYVAAKPPAGVQPFIIPSFTALTTVRDALGDDSPVLLGVQNAHWEDHGAWTGEVSVAQAKDAGAQIVEIGHSERREHFGETVETTRLKVAAALHHGLVPLLCIGESAENKQAGESSRFILEQAAGALEGLTDEHLARVLIAYEPIWAIGENGRPATVEELRQPFDDLAREYGCRTMGLLYGGSVNTDNAEDLLGIDHVTGLFIGRAAWQLPGYVRILEMAAAHPKAKA

SEQ ID NO: 12065 - protein, 465 aa, Corynebacterium efficiens YS-314
MRIAIIGAGLAGLTAAYEIHKAEPDTHIDVLEAGERIGGKLFTVPFASGPTDMGAEAYLATRADATELFHELGLGDSLVTPSGARSQIYAGGRLRPMPRGGVMGIPSSSAGLEEILSEETRTLIDAEAGTAPVDWQVGGDASVGALVRARYSDEVADVLVSALLGGVYSSSADDLGIRATVPALAEALDRLAESGEPVTLSGAVKLVETERAEARKNSETTPVFQTFRGGYAELYEALADQCGADIHLDTFVSGITQVNGGGFQIKGGGEGTYDRVILAVPAPTAAVLLREVAPGATEHLKTIQLASSAVVGMRFDSAEGLPDVSGVLVASGEPAITAKAFTFSSKKWPHLGERGGALVRASFGRLGDEATARMDEDNLVDAALDDLQTITGFDGRAAGLSEIFVQRWFGGLPNYGVDHIATVARARTEISQVKGLEAIGAWASGVGVPAVIADAKAAVERLLDA

SEQ ID NO: 12066 - protein, 442 aa, Corynebacterium efficiens YS-314
MVDMSASPSGTSANVSRSIEWFEKAKMFTPGGVNSPVRAFGSVGGQARFIDRAHGSTLIDVDGNEYVDLVCSWGPMLMGHAHPAVLEAVQKTIVDGLSFGAPTIGEVELAQDIINRTSVEEVRLVNSGTEATMSAVRLARGYTQRPKILKFDGCYHGHVDSLLASAGSGVATFALPDSPGITGAQTRDTIVVPYNDIEAVRAAFAEFPGQIACIISEAAAGNMGTVAPQDHFNEHLLAIAHADGALLILDEVMTGFRTSYRGWFGVDKVRADLVTFGKVVSGGLPAAAFGGRAEIMNMLAPQGPVYQAGTLSGNPVAVAAGRASLSAATEEVYRTIDANADRLHGLISDALTREGVAHHIQRASNMLSIRFAEGEGHNFTDMKNADTFRFAPFFHALLDHGVYAPPSVFETWFVSSALTDDDFQKIDDALVPAARAAAAATA

SEQ ID NO: 12067 - protein, 462 aa, Mesorhizobium sp. BNC1
MSDFDLIVIGAGPGGYVAALRAAQAGMRVACIDERATAGGTCLNVGCIPSKALLSSTEHWAGLKSLADHGIETEAARVDLSRMMARKDKVVSDLTKSIAFLFNKAGVEFIHGRASIAAPGRVTVGVREISSQHILIATGSAPAVLPNVPFDEKLVLSSTGALSLAKVPDRLVVVGAGVIGLEIGQIWSRLGAKVTVVEYLDRILPGMDGETAKNAQRIFARQGIGFMLNAAVEAVVDNGETAEIKIKSRASGKVEKLQADAVLVAIGRKPHTGGLGLEALRVRRDARGFIEVDEQFRTSVPGILAIGDVVPGPMLAHKAEEDAVACIDALAGKPHCAPDYGLVPGVVYTTPEIAGVGLTEDDASAAGRAVLIGKASFLANGRARAIGTTDGFAKVIACAETGKLLGAHILGHGAGELLQELVLALRFGASLNDVAGTSHAHPGMGEAVKEACLSVLDARSLD

SEQ ID NO: 12068 - protein, 195 aa, Streptococcus thermophilus CNRZ1066
MGNNVDKPTGQSLFLAAITILIILLVNIFTKGFIKSISILIGLIIGTVIAASMGLVDFSPVAAAPVVHVPTSFYFGMPKFELSSIIMMCIIATVSMVESTGVYLALSDITKDPIDSTRLRNGYRAEGMAVLLGGLFNTFSYTGFSQNVGLVKLSGIKKRLPIYYTAGFLVLLGLLPKFGALAQIIPSPQYLVVLC

SEQ ID NO: 12069 - protein, 887 aa, Bdellovibrio bacteriovorus HD100
MKSFRFCSLLLICSFVLSCTLLLGQIAEAKAPARAQWVDNSRIVFRLPQGFRVHQNLLFSLGERISLHQQDSILLPVIRTDSSHVELSTQHLSSTQIDQLIRRPLRLFVSNKNGQILDSTALQYSGILDQMYFYDGDDLGAHVRSTSVGVKLWAPTARNVELLLYKDAQDTNPAAVLPMSRQQGVWFADLPGKYVNYFYLYQVEAYQPLSDQVETHTVTDPYSFSLTADGAKSQIVNLNDSSLKPQGWDRLHKPALRSFNDIVIYELHIRDFSVADFTVPFPYRGGYEAFAQTNSESSKYLQSLADAGMTHVHLLPFNDFGSVPENKDAWENYDSESSDLQEAQAYLGRIKAKDPFNWGYDPVHFMTPEGSYATDPNGSRRVYETRNMVQALNKMNLRVVQDVVFNHTYEAGLEPYSVFDKIVPLYYYRVNDEGDIQKSSCCNDTASEHRMMEKLMIDSVLHWARTYKIDAFRFDLMSFHSRNTMEKIKSELRGLTEREDGIDGSKIYLYGEGWAFGSFYDRYPAESLHMLNSYGSGYGFFNDRLRDAVRGGTTNSAEKSDQGFATGLYFDFNKEPANRNTPTDINGQREKLLHLGDVIKAGLAGNLRDFKFKEHWGSFVTAGQLHYRGAPTGTSAEALETVSYVSAHDGYTLWDAVQAKAPFYTNGRFPSLSKSEDRQRMHQLALALPMLSQGIPFIESGSELLRSKNGDQDSYNSGDFFNRIDWSRQQNFWGAGLPPAWKNVEDWSFWQPRLQEPGMKVTPELITRTEKYFKALLRVRQSSNLFKLNDLSEIQKSLTFIDNDKQTEPGLIAMHLQSSSEKLLIFFNAAREARSFEHRVLGQNWELHPLLDEKVDATLSQVLLAPSDKRIQIPGRSTVILIQKAGH

SEQ ID NO: 12070 - protein, 548 aa, Bacteroides thetaiotaomicron VPI-5482
MTKSALQIARAAYQPKLPKALATGAVKAVAGAATQSVADQEAIKALFPNTYGMPLITFEAGEAVQLPAMNVGVILSGGQAPGGHNVISGLFDGIKKLNPESKLYGFILGPGGLVDHNYMELTADIIDEYRNTGGFDIIGSGRTKLETEAQFEKGFEIIKELGIKALVIIGGDDSNTNACVLAEYYAAKKYGVQVIGCPKTIDGDLKNDMIETSFGFDTACKTYAEVIGNIQRDCNSARKYWHFIKLMGRSASHIALECALQVQPNVCIVSEEVEEKDMSLDDVVTSIAKVVADRAAQGNNFGTVLIPEGLVEFIPAMKRLIAELNDFLAANAEEFSQIKKSHQRDYIIRKLSPENSAIYASLPEGVARQLTLDRDPHGNVQVSLIETEKLLSEMVATKLAAWKEDGKYVGKFAAQHHFFGYEGRCAAPSNFDADYCYSLGYTASMLIADGKTGYMSSVRNTTAPAAEWIAGGVPITMMMNMERRHGEMKPVIQKALVKLDGAPFKAFAAQRDRWAVETDYVYPGPIQYFGPTEVCDQATKTLQLEQAK

SEQ ID NO: 12071 - protein, 222 aa, Yarrowia lipolytica CLIB122
MAQKPLFRFGATDSLATLLERNEKWANRVSSVRPSLFPTNAQGQAPKILWIGCSDSRAGEGCLDLLPGEVFVHRNIANLLPDSDFSSLSVIQFAVQVLKVRHIIVCGHYDCGGVWSSLTSKKLGIIDHWLRPIRDTKVRHKAMLDAIEDPKDKCARLVELNVCAQVNNLKRNTVIIEAQGERDLQIHGVVYDPGSGLLKEIMVPEDEYAEDYFVSDAGELVH

SEQ ID NO: 12072 - protein, 362 aa, Geobacter metallireducens GS-15
MSQVFKVAVLPGDGIGPEVMAEALRVLDAIEKKYDVKFERTHANVGGAGIDLEGKALPETTITICKTSDAILFGSVGGPKWETLPPDEQPERGALLPLRKIFGLYANLRPAIIFPSLTGASSLKEEVIAGGFNVLVIRELTGGIYFAQPKGIEGEGRDRVGFDTMRYSVPEIERITHVAFQAARKRGKKVCSIDKANVLSSSVLWREVVTGIAKEYPDVELSHMYVDNAAMQLVRWPKQFDVILCENMFGDILSDEAAMLTGSLGMLPSASLAEGTFGMYEPSGGSAPDIAGQGIANPIAQILSMGMMLRFSFGMVDAADAIDNAVAKVLDQGCRTRDIFQEKPGEKLVNTKEMGDAIIVAL

SEQ ID NO: 12073 - protein, 228 aa, Erythrobacter sp. NAP1
MPKLILVRHGQSQWNLENRFTGWWDVDLTEKGVAEAKAAGTLMKEKGVLPTTCFTSFQTRAIKTLNLALEEMGRLWLPVTKDWRLNERHYGGLTGLNKQETRDKHGDEQVHIWRRSFDTPPPPMEPGSEYDPGADPRYEGIDVPYTESLKLTIERVLPYWESDILPVLSSGETVIISAHGNSLRALVKHLSNISDEDITGLEIPTGQPIVYEFDDTMTPGERYYLKDS

SEQ ID NO: 12074 - protein, 1128 aa, Brachypodium sylvaticum
MPPRPRAVALAPPRRLALLVSSAFAALLLIVSPCHCVNEQGQALLEWKRSLRPAGGALDSWKATDAAPCRWFGVSCDARGDVVSLSVTGVDLRGPLPASLPATLATLVLSGTNLTGPIPPELGAYSELTTVDLSKNQLTGAIPPELCRLSKLETLALNTNSLRGAIPDDLGDLASLTHLTLYDNELSGTIPGSIGKLKQLQVIRAGGNVALKGPLPSEIGGCTNLTMLGLAETGMSGSLPETIGRLEKLQTLAIYTTLLSGRIPESIGNCTELANIYLYQNSLSGPIPPQLGRLRKLQTLLLWQNQLVGAIPPEIGQCEELTLMDLSLNSLSGSIPASFGRLKNLQQLQLSTNRLTGAIPPELSNCTSLTDIEVDNNALSGDIRLDFPKLPSLTLFYAWKNGLTGGVPASLAECASLQSVDLSYNNLTGPIPRELFALQNLTKLLLLENELSGFVPPDIGNCTSLYRLRLNGNRLSGTIPAEIGNLKSLNFLDMSSNRLVGPVPAAISGCASLEFLDLHSNALSGALPDVMPRTLQLVDVSDNQLAGPLRPSSIVSMQELTKLYLGKNRLTGGIPPELGSCEKLQLLDLGENAFSGGIPAELGELPSLEISLNLSCNRLSGEIPPQFAGLDKLGSLDLSHNQLSGSLDPLAALQNLVALNVSFNGFSGELPNTPFFQKLPLSDLAGNRHLVVGDGSGDSSRRGAITTLKAAMSVLAVVSAALLVAAAYILARARRRGGTGGSTAVHGHGTWEVTLYQKLDISMDDVLRGLTTANVIGTGSSGVVYRVETPNGYTLAVKKMWSPSPDETAAAAAAFRSEIAALGSIRHRNIVRLLGWAAANNGSTATRLLFYSYLPNGNLSGVLHGSGGASVAKQSAQPGSDWAARYDVALGVAHAVAYLHHDCVPAILHGDIKSMNVLLGPAYEPYLADFGLARVLSAAQSKLDDDSSKPRPIAGSYGYMAPEYASMQRISEKSDVYSFGVVLLEILTGRHPLDPTLPGGAHLVQWVTQARRRACDGDDALLDARLRERSAGEADAQHEMRQVLAVAALCVSQRADDRPAMKDIVALLEEIRRPGTAAADDVKPAPAPAASLPAAVAAAPVLSPARGGAHSRGVSSSCSFAGVSDYSA

SEQ ID NO: 12075 - protein, 144 aa, Zea mays
MVHGKLEVLLVSAKGLEDTDFLNNMDPFVILTCRTQEQKSSVANGAGSEPEWNETFVFTVSDDTPQLHLKIMDSDLTNDDFVGEATIPLEAVFQEGSLPPAAHPVVKEEKYCGEVKLALTFTPAAETRHRPDDNEEGPPYSSWS

SEQ ID NO: 12076 - protein, 468 aa, Streptococcus agalactiae NEM316
MTKTLPKDFIFGGATAAYQAEGATHTDGKGPVAWDKYLEDNYWYTAEPASDFYHKYPVDLALAEEYGVNGIRISIAWSRIFPTGYGEVNLKGVEFYHKLFEECHKRHVEPFVTLHHFDTPEALHSNGDFLNRDNIEHFVNYAAFCFEEFPEVNYWTTFNEIGPIGDGQYLVGKFPPGIQYDLAKVFQSHHNMMVSHARAVKLYKDKGYKGEIGVVHALPTKYPLDPENSADVRAAELEDIIHNKFILDATYLGYYSEMTMAGVKHILKENGGELDLREEDFQALEAAKDLNDFLGINYYMSDWMQAFDGETEIIHNGKGEKGSSKYQIKGVGRRVAPDYVPKTDWDWIIYPQGLYDQIMRVKNDYPNYKKIYITENGLGYKDEFVDNTVYDDGRIDYVKQHLEVLSEAISDGANVKGYFIWSLMDVFSWSNGYEKRYGLFYVDFETQERYPKKSAHWYKQVAKTQIIE

SEQ ID NO: 12077 - protein, 448 aa, Prosthecochloris aestuarii DSM 271
MSTTAYCLEPFMEWIQTKNPAEPEFHQAVFEVARSIIPFVNEHQKYQQACILERMCEPDRIISFRVVWEDDKGNIRMNRGHRVQFNNSIGPYKGGLRFHPSVNTGILKFLGFEQTFKNSLTTLPMGSAKGGSDFDPKGKSDREIMRFCQSFMTELSHYIGHFTDIPAGDIGVGAKEISYLFGEYKRLSHQFTGVLTGKSLEYGGSLIRKEATGYGCVYFMEEMLHEKGESIRGKTCTVSGSGNVALYCAQKINHLGGKVVTLSDSDGFIHIPQGISDEELDAIIELKTFKRGRLAEYAEKTACSYFAAEKPWGIECDLAFPCATENEITKSDAALLAGGGCIALAEGANMPTTQDALEVLRNSGILTAPGKAANAGGVAVSGLEMAQNSMRMAWTTQDLDSRLQAIMKSIHQQCTTYGRTNGYIDYVKGANIAGFIKVADAMLAYGIL

SEQ ID NO: 12078 - protein, 768 aa, Zea mays
MEINEEAMAAHKRAFLDFLDQDVGKGVYMQAVRDMVQNKRHRLIIGMDDLRNHNLDLARRVIRTPGEYMQPASDAVSEVARNLDPKFLKEGERVMVGFSGPFGFHRVTPRDLMSSFIGTMVCVEGIVTKCSLVRPKVVKSVHFCPVTGDFLSREYRDITSFVGLPTGSVYPTRDDNGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGARSLDKEGYAEEDDGDANAAIFVKYDRMLHGQDRRRGKKSKQDRLTVKFLKKYIHYAKNLIQPRLTDEASDHIATSYAELRDGSANAKSGGGTLPITARTLESIIRLSTAHAKMKLRHEVLKSDVEAALQVLNFAIYHKELTEMEEREQKEMEMKQQAEHDAGATGGTVDGHGSSGNDPMDVDVGSNDQNVSAERIEAFEALLGQHVLANHIDQMSIDEIEQMVNRESTAPYTRSQVEFILERMQDANRVMIRDGVVRII

SEQ ID NO: 12079 - protein, 343 aa, Rhodococcus sp. RHA1
MQSHELKLARHPRGKVRPSDFHLDVVTVPGELAPGDILVRNSWSSIDPSVRMRLGPTGPAGYLPPFRIGETLSGLAVGEVLESRDPGFEKGDTVLHIKGFREFAVVRQGSETLAGAGGVTRLDTSVHPPQSYLGALGSSGLTAYVGLQCIGGLTSGDVVWISSAAGAVGSLAAQIAKLRGHYVVGSTGSGEKVTFLLDEVKLDAAFDYHSPDLAGALANAAPDGIDLYFDNVGGTHLEAALYHLRPGGRVAMAGAVASYDADTAAPSPGNLFQIVAKNLTVRGFRAGAYDHLLGDMRDEVGSYLRDGRLVVEETVFDGLGSAPDAIVAMLHGRTVGKTLCRLR

SEQ ID NO: 12080 - protein, 615 aa, Zea mays
  misc_feature (231)..(231): Xaa can be any naturally occurring amino acid
  misc_feature (283)..(283): Xaa can be any naturally occurring amino acid
  misc_feature (349)..(349): Xaa can be any naturally occurring amino acid
  misc_feature (396)..(396): Xaa can be any naturally occurring amino acid
MSWNAREQRSANDRYAAIHREKNTVEAAAAARIAAAASRSEQADGGPPIQRVLVSKIVLTTCRLVAVVLHFASGIGSTHVPTLCSSMLVFFIVFFEFFHDGELQDIQDDMSDDLSPSPQIEYDRLLGGLLVEGFDDKSCRSRYRFARYHSSPSIPSPYLIERLRKQEALQKKCGPGTRAYREASKQLKSGQSMSINATDDCNYLFLIIHAGLGNRMLEITSAFLYALLTNXILLLDRYKEIADLFCEPFPGTSWLVPSDFPLNDDEFGQSSAESYGNMLQNKXFGGGTDRSLVGNRLPPYVYLHLDGNYGFHDKLFFCEDDQQFLRGVPWLVMRTDMYFVPSLFLVPSXQDELGRLFPEKDTVFHHLARYLFHPTNGVWYSVTRCFRSYLAKAEKXVGIQIRIYETKGIWQRNGPFPHILNQILSCAQNEKLLPEISMAEGAADGTRNNRTAAGSGTRNNRTIAVLTTSLSAWYSEQIQEKYDEQSAVDGVTVRVFQPSHEEYQRSRNKGHNMKALAEIYLLSMTDVLITSGFSTFGYAAQGLAGLKPWIMLKSENHVTPDPPCVRAMSIEPCFHQAPFYDCKARKDTDLGKVVPYVRHCEDVSWGLKIVDQTHL

SEQ ID NO: 12081 - protein, 678 aa, Bacteroides thetaiotaomicron VPI-5482
MKKKYDIKTTDVETLKKWYHLMTLGRALDEKAPSYQLQSLGWSYHAPYAGHDGIQLAVGQVFTLGEDFLFPYYRDMLTVLSAGMTAEEIILNGISKATDPGSGGRHMSNHFAKPEWHIENISSATGTHDLHAAGVARAMVYYGHKGVAITSHGESATSEGFVYEAINGASLERLPVIFVIQDNGYGISVPKSEQTANRKVAENFSGFKNLKIIYCNGKDVFDSMNAMTEAREYAISTRNPVIVQANCVRIGSHSNSDKHTLYRDENELEYVKEADPLMKFRRMLLRYKRLTEEELLQIEAESKKELSAANRKALAAPEPDPKSIYDFVMPEPYQPQKYKEGTHQEEGEKTFLVNAINETLKAEFRHNPDTFIWGQDVANREKGGVFNVTKGMQQEFGEARVFSAPIAEDYIVGTANGMSRFDPKIHVVIEGAEFADYFWPAVEQYVECTHEYWRSNGKFAPNITLRLASGGYIGGGLYHSQNIEGALTTLPGARIVCPSFADDAAGLLRTSMRSKGFTLFLEPKALYNSVEAAAVVPEDFEVPFGKARIRREGTDLSIITYGNTTHFCLHVAEQLEKESGWKVEVIDIRSLIPLDKEAIFESVKKTSKALVVHEDKVFSGFGAELAAMIGTDMFRYLDGPVQRVGSTFTPVGFNPILEKEILPDEAKIYEAAKKLLEY

SEQ ID NO: 12082 - protein, 190 aa, Triticum aestivum
FPEENDEEGEPSIPWDCFQLDEEEEPDLPLEGSVPAEEFDWEEVAFASGPLVENPEPDWEMLGDMPPNAPAGANEGFVYTSDREAYEVLVAVGDGLFLTNKPPAARSAVKALPSAIVAAGEEGEGEECSVCKDGVVAGERVKMMPCSHRYHEDCILPWLEVRNSCPLCRFELPTDNPKYETWKAERAMAA

SEQ ID NO: 12083 - protein, 256 aa, Streptococcus thermophilus CNRZ1066
MAGAVNYPLPLTIENNFLPQYSSIPKEILEKSKLLFLNYPNNPTGAGANDEFFKETVAFAKENNLVVSHDFAYSDISFSGKSPSFLQAPGAKEVGIEIYTLSKTFNMAGFRIAFAVGNKEVISLLKGYIRASVGGTFGSVQDAVTYALLYSEKERGQLRKLYKERRDLVLSLLEEHNIDVIKSEGTFFIWIKLPKTIDDITFVEEFLAKEQVALIPCSTFGEFGKGYIRLSLVSDLKTIQLGIEKLIAFLEKKRVI

SEQ ID NO: 12084 - protein, 225 aa, Arabidopsis thaliana
MKLIEKTMSMNQFRTMEEEKQDGGELFHTIEVAKVDRNNVSQPPPAATAALLEVPGDELNLIPPLNFSMVDNGIFRSGFPDSANFSFIKTLGLRSIISLCPEPYPENNMQFLKSNGISLFQFGIEGSKSKEPFVDILDQKIREALKVLLDEKNHPLLIHCKRGKHRTGCLVGCMRKLQKWCITSILDEYKRFAAAKARVSDQRFLESFDVSGLKHTPMSFSCSNR

SEQ ID NO: 12085 - protein, 130 aa, Arabidopsis thaliana
MGSGMIRTLVILAIALFMIGSDNVHVAKAQVCGANLSGLMNECQRYVSNAGPNSQPPSRSCCALIRPIDVPCACRYVSRDVTNYIDMDKVVYVARSCGKKIPSGYKCGSKYLSCFSYYSFVIVKHIIIWI

SEQ ID NO: 12086 - protein, 422 aa, Erythrobacter sp. NAP1
MLNGVFAMSELAIVSAKTSALRARSDEGSIAARIAIRLAEEPGKFLSTVQIGITLIAIVTGALSGASLEAPIGERVALLGVPEDTARQVAFVGVIALTTYFSVVVGELVPKQLALRAAVPIAIVMARPMDLLARLAAPLVWLLDKSSAGIIALFGIRTKGRPSLTAKELQMIFADATRSGVIEQDQHQILTGVVRLAERPVRELMTPRTELDWVDADADLEQVLATISNSPHSLLPVAEGSPDAILGIVKVREVLAALVAKEPVSIRGMAKKAEVVPDQLDAMDALRVLQSAEIAMAVVHDEYGHFEGVVTPVDLLTAIAGTFASDQDQGDTPQIIECTDGSLLVSGALSADGLADRLGLEYGEDREFGTAAGYALSVMKKLPLIGESFTDQGWEFEVVEMDNRRIDKIIVRKRAEDSSEDG

SEQ ID NO: 12087 - protein, 203 aa, Brassica napus
  misc_feature (15)..(15): Xaa can be any naturally occurring amino acid
MTTPQISEIEQEQLXEKLEIFKIHGRDKRRRKILRIIGKFFPARFLSLDVLNKYLEEKIFPRLGRKPFAVLYVHTGVQRSENFPGISALRAIYDAIPVNVRDNLQEVYFLHPGLQSRLFLATCGRFLFSGGLYGKLRYISRVDYLWEHVRRNEVEMPEFVYDHDDDLEFRPMMDYGQESDHARVYAGAAVDSSVSSFSMRCIS

SEQ ID NO: 12088 - protein, 689 aa, Brachypodium sylvaticum
MAAAARGRRCRGAVLLLLLLPSVLAPLVLYGYSPTSPLPDSTLARVAFDREDGSNLVWPHMAASEVSLAKDLTIERLGEHKNRVLSATDDWQAVQAARSRSSENSDASVQLKVPVTRDADEMIAEETGSALSGQEGRIKEVVSSQRNADGFGDPGNAKQAEEQDGLATEVEHTDGSGASTENNVAGIHTTESTADSLSNGTIHATPRESYTRATGINADLPTTTSSAGHSTASPDVKIRIIKDQLIRAKTYLGFVASRGNHGFAKELRARMRDIQRALGDATNDGLLPQNVHSKIKAMEQTLGKVKRSHDSCSGAVNRLRTALHSMEERLQSHKNEANYLAQIAAKSLPKGLHCLPLRLTNEYYSTNSNNKDFPNTEKLEDPKLHHYAVFSDNVLAAAVVVNSTLVHATNHVFHIVTDRLNYAAMKMWFLANPLGKAAVQVQNIQEFTWLNSSYSPVLKQLGSRSTIDYYFRSGTARPDENPKFRNPKYLSILNHLRFYLPEIFPKLNKVLFLDDDTVVQQDLSALWSIDLKGKVNGAVETCGETFHRFDKYLNFSNPIVANNFHPQACGWAFGMNMFDLSEWRKQNITDVYHTWQKLNEDRLLWKLGTLPAGLVTFWNRTFPLDRSWHLLGLGYNPNVNERDIRRASVIHYNGNLKPWLEIGLSKYRKYWSRYVDFDQIFLRECNINP

SEQ ID NO: 12089 - protein, 289 aa, Bacillus licheniformis ATCC 14580
MNPANRQTDGQKAQKQEKQPGAEHKMVPLPLSEDRDYKGSGKLKGKTAIITGGDSGIGRAAAIAYAKEGADIAVMYLDEHKDAEETKERIEQEGAECLLIPGDVGDEAHCKSSVEKTVNHFGGLDILVNNAAEQHPQKGIEDISTEQLERTFRTNIFSMFHMTKAALPHLGEGSAIINTASITAYEGSPALIDYSSTKGAIVAFTRSMAASLVKKGIRVNAVAPGPIWTPLIPATFPPEKTEKHGTDTPMGRPGQPSEHAAVYVLLASDDSSYMTGQTIHINGGRYVTT

SEQ ID NO: 12090 - protein, 425 aa, Burkholderia thailandensis E264
MAIVEVKVPQLSESVSEATMLQWKKKPGEAVAQDEILIELETDKVVLEVPAPAAGVLAQVLQNDGDTVVADQVIATIDTEAKAGAAAAAAGAAEVQPAAAPAAAPAPAAQPAAAAASSTASASPAASKLMAEKGLGAADVAGSGRDGRITKGDVLSAGSAPKAAPAAAPAKAAAKPSLPDVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 12091 - protein, 352 aa, Campylobacter upsaliensis RM3195
MSEKILFIDRDGTLIKEPKEDFQVDSLEKLAFEKGAIPALLKLQKFGFKFVMISNQDGLGTTSFPKEDFEKAHFKMLEILQGCGIEFKDIFICPHFEKENCACRKPKAALLKDYIKYHLYDKGQSFVIGDRQSDMDLALNLGLSGLRYGELSWEEITEQILNSFRYASVKRKTKETDISVKVALNGGEVSVKSGVAFLDHMIEQIAVHSGIGLELSCRGDLEIDEHHSVEDIALALGEALKRALGDKIGIARYGFVLPMDESLASCALDFSNRPFLKFKAKFKKKKLGTLSTEMIEHFFYSLSYALGVSLHLKVKGKNDHHKCEALFKAFAKALKQAIKIESENLASSKGML

SEQ ID NO: 12092 - protein, 220 aa, Clostridium perfringens
DPETKRKIIGEEFIRVFEEEAGKLGDIKFLVQGTIYPDVVESGTDTSAVIKSHHNVGGLPEDMEFSLIEPLRELFKDEVRAVGEELGIPHHLVWRQPFPGPGLAIRVLGEVTEDKLEVVREADAIFREEIALAGLESEIWQYFAVLPNIQSVGVMGDERTYCHTVGLRAVTSSDGMTSNWAHIPYEVIDKVSRRIVNEVKGVNRIVYDVTSKPPATIEWE

SEQ ID NO: 12093 - protein, 477 aa, Enterococcus faecalis V583
MEHHQLKAFPQDFLWGSASAAYQVEGAWNEDGKGASVWDEFVRLPGKTFKETTGDLAVDHYHRFKEDVALMKQQGLKAYRFSIAWTRILPEGRGRVNQAGLKFYSDLIDELLAAGIEPMVTLYHWDLPAVLQKEYGGWESRKIIDDFVAYAKILFDAFRGKVRYWISLNEQNVFTSLGYQLAVHPPGVTDNKRMYEANHIANLANAAVINAFHELEMPGKIGPSFAYTPVYAVDAHPANVLAAENAEDLLSHFWLDVYLWGEYPIAALNYLQEQGVAPTIKEGDLALLRSAKPDFLGINYYRTDTVAANPLDGVGIGKMNTTGEKGSETESGVPGLFKKVNNPYVERTNWDWAIDPQGLRIALRRLASRYQVPILITENGLGEYDTLTEDKQIHDTYRIDYLRSHIQAIQEAITDGVSVIGYCTWSYTDLLSWLNGYQKRYGFVYVDQDETQKGSLERIPKDSYYWYQKVIETNGLI

SEQ ID NO: 12094 - protein, 242 aa, Oceanospirillum sp. MED92
MHRLTELLEKNRDWADKINKEDPQFFETLAQQQAPEYLWIGCSDSRVPANEIVGMLPGELFVHRNVANVVVHTDMNCLSVVQYAVEVLKVKHILVVGHYGCGGVAASIESEPHGLIDNWLRNIRRVYQKHMDFLSTWDESQQKLDRLCELNVIEQSVNLCETTIVQQAWANGQDLTVHGWIYGLGDGLVNDLEFNASSAEAVEEQYQLAMNKMGKLRELAQVSDKSQESARTLWDKVRSIFN

SEQ ID NO: 12095 - protein, 850 aa, Magnaporthe grisea 70-15
MDGLATLQPAGGASAPLRAASQTFATAPQPIHNSSNNAQQLPQLEQQQQLQSGAPPQDACVSQQQTQKQPQPQPQSHPSKCISTISPIRPTASDPAQGENSLSSSPRQFPTGLTSSILEEEDESSESDTPNEPVTPVSGRQSQDFHSLQNHDTHPTSLSSSAEHSTGAFSSLQNDAAPTNKTPLILGTSATPDRPEPAPSEHSPTSTKTVRSPTAPSDTEASTSATKSIPVPINTANAAANADQPLPSATPPTHSRKNSRNPLRRMSQAFRRSNSQIERPNIEQPEAACTSSEFAISDGPPKPQQPNRRWSIRREGTSLATTRSNSPPSPPINMLAPSERAATSLLPSPSHEHVDFGVIKKKVRSSTGLGGLGRKAAQFVTSGGKTSQAHQPNGDAKQPQRMKPQRRASSFDLKKAQADQTQRVQNGDMESLEELTRQPWGMPAMTGVGLKARRLSVSLPDDFTVDVADLLAEFEYYHKVLGRHGKHLGKGATSKVTLMQRKSCPEELYAVKEFRPKSSTETKDEYEQKIKSEFSIAKSLHHPNIVESIRLCTDHGRWNHVMEYCSEGDLYSLVEKKYLLEESRKVDRLCLFKQLVQGINYLHTNGIAHRDIKLENLLITKDSKLKITDFGVSDVFTGTHPGLREAGGQCGINMGEVRLCDPGICGSLPYISPEVLTRGVKYDPRALDVWGAGVIAINLFFGAPLWKEARDDGANPQYTQLVRAWTRWEKKHGNDMLGEGEEGVPAICDGDQPYTAAFDMGIKPPALRRLVFGMLHPNPARRIGISQVLNNRWMKTVECCQFESYDEPSTKIDASKKECFTNKKIFCHNHLPPVASGNHSLGKMPGQAGY

SEQ ID NO: 12096 - protein, 212 aa, Prochlorococcus marinus str. MIT 9301
MKITTKTEALNIVETSYLASLSSLLWVALYYLPIGGALLRLILPLPMILLHLRRGTKIALEGLLIQFLLLFIIMGPVRGTLFLFPYGILAFWLGWCWVKEKSWKLSLTGGVVTGTLGFLIRVIALSTLVGDNLWVLITRASYGLIEKLIGLFNLPLYPSILSIQLGAILLIIFQEIVYVLTVHVVAYSLFPRFKLTIPEPPRLLNSLVDFNN

SEQ ID NO: 12097 - protein, 515 aa, Bacillus anthracis str. Ames
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFSYIPLGVGVIISPWNFPFAIMAGMTTAALVSGNTVLLKPASTTPVVAAKFMEVLEEAGLPAGVVNFVPGNGSEVGDYLVDHPRTRFISFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVISNNRDHIEKAREDFHVGNLYFNRGCTGAIVGYQPFGGFNMSGTDSKAGGPDYLALHMQAKTTSETL

SEQ ID NO: 12098 - protein, 378 aa, Shewanella oneidensis MR-1
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGGQRQAARGSDLRYNLELSLEEAVKGLTKELRIPTLASCDVCDGSGAKKGTSATTCTTCHGQGQVQMRQGFFTVQQPCPTCHGRGKIIKDPCAKCHGDGRVEKTKTLSVKIPAGVDTGDRIRLAGEGEAGEFGAPAGDLYVQVSVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 12099 - protein, 229 aa, Triticum aestivum
  misc_feature (37)..(37): Xaa can be any naturally occurring amino acid
  misc_feature (39)..(39): Xaa can be any naturally occurring amino acid
  misc_feature (76)..(76): Xaa can be any naturally occurring amino acid
QGHKYLEGNGGRSPPLKNTFTYLGGLKRSSIRILKHXVXTPHFPNFTTRTKAEDPSAQRYIISFTAHNVVNLEGIXFKSEVVGQSLMLHQIRKMVALAVAVMRNCAPESIYDVAFRKDIRLNVPTAPEVGLHLDECMFTSYNSKWMDTHEAVSIEPYAEEAEEFKIKYIFPHIAAMEHKEGAVALWLHSLNSRNYPDFRYVETAGSEAKVGAEVENMEEAQMPSNNISE

SEQ ID NO: 12100 - protein, 149 aa, Sesbania rostrata
MGAFTESQEALVTSSYETFKQNASDLSVLFYTFILEKAPGAKNLFSFLKDSDGVPKDNPNLKAHAAKVFELVVDSAVQLRTKGAVVIADANLGPVHVQKGVTDAHFVVVKEALLKTVKEATGAKWSDELSNAWEVAYDELAAAIKKAMG

SEQ ID NO: 12101 - protein, 124 aa, Pseudomonas aeruginosa
LLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHV

SEQ ID NO: 12102 - protein, 563 aa, Burkholderia thailandensis E264
MALFCASTPMQRTRLFPTLTRRTQRIWRQYGVFWLGAIAVGLTAVTYARLIDWGYEAFRSLERGRPWLPFVLTPAVAALSVWLTRRFFRGAEGSGIPQVIATLHAQPSAFGSRLLTLRILFGKILISLLGIIGGFTIGREGPTVQIGASLMFNLRRFYPRSNALIERQLVLAGAAAGLSAAFNTPLAGVVFAIEELSRSFSARASGVLITAIIIAGVIALGMNGNYTYFGTIEIGQHFPKMLAAAVLLTALVTGIAGGLFGWLLLHTGRWLPARLLTLYRERPIVFAVACGLAIAAVGAVSGGTTFGSGYAEARGLLDGREQLSVLYPFLKMISMVASYLPGIPGGIFAPSLSIGAGFGNLLHFVFSGMHLPMLIALAMVGYLAAVTQSPITSFVIVMEMINGHALVISLMATALIASRVSRLFVPPLYETLAERYLKPPQPKHAAAAATGAAPSHAGIAAVKMPEDAESAPADPLDTLRDEATNDAQANATSAAGGNIDARAAVRAADAPTPGGDAAHAAAQPHAGAAPTPVEAGEPNACAAGPASQSGDTAHREPPHRPAQ

SEQ ID NO: 12103 - protein, 446 aa, Tortula ruralis
MGQGQSGGLPKQGPGGERNKGDGQKKEKKYEPAAPPTRVGRKQRKQKGSEAAARLPVVTPATKCNLRLLKLDRAKDYLLMKEEFVRTQKRLNPQEDKTEKDRSKVDDLRGSPMSVGNLEEIIDENHAIVSSSVGPEYYVNILSFVDKDQPGPGCAILMHNKVLSVVGLLQDDVDPMVSVMKVEKAPLESYADIGGLDPQIQEIKEAVELPLTHPELYEDIGIKPLKGVILYGEPGTGKTLLAKAVANSTSATFLRVVGSELIQKYLGDGPKLVRELFRVADELSPTIVFIDEIDAIGTKRYDAHSGGEREIQRTMLELLNQLDGFDSRGDVKVILATNRIESLDPALLRPGRIDRKIEFPLPDTKTRRRIFQIHTSRMTMADDVNLEEFVMTKDEFSGADIKAICTEAGLLALRERRMKVTHADFKKAKEKVMYKKKEGVPEGLYM

SEQ ID NO: 12104 - protein, 497 aa, Burkholderia thailandensis E264
MRRCRRVECCAFHGDRNTTMKTCEQFYIGGAWHPSTGKGTIDVIDSGTEAVIGRIPEGTAEDAKAAVAAARAAFDGWAATPPAERARYLRKITDNLKARSEDLAQSITGEVGMPIKLSRAIQVGGPIYNWGAYAKLAETFAFEEPVGNSLVVREPVGVVAAITPWNYPLNQITLKVAAALAAGCTVALKPSEIAPLNAFILAEAIHDAELPAGVFNLVCGYGPVVGEALASDPEVDMVSFTGSTRAGKRVAELAAAGVKRVALELGGKSASVILDDADFAAAVKGTVSACYLNAGQTCSAHTRMLVPESRYEEARELAKAAAESYVAGDPRDDATRLGALASSAQQKRVQDYIRRGIDEGAELVTGGLGMPEGIARGFFVKPTVFGRVKPDATIAQEEIFGPVLSIITYRDEADAVRIANDSPYGLGGAVWSGSDERAMRIARRIRTGQVDINGGAWNMAAPFGGFKQSGIGRENGVYGLEEYLEYKSMQLRPKKGA

SEQ ID NO: 12105 - protein, 982 aa, Bdellovibrio bacteriovorus HD100
MNDIQSQIVSRGEEILKRMESQSKASIFSKDFWYGSIMEWSMKNEKFKTNMFRFVDVLPSINSGDEVARHLKEYFSEDGGTLPPVFNVGLGLGSLAPGLMAGAIKKNVMGMAKMFITGESPDEALPVLKKARKNKMTFTVDILGEATLSEKEAQDYSNKYMELVTWLAKDAEKWDEVPQIDRDHEGALPKVNVSVKMTALYSQIKDAAWDESKKILKDRLRPVFRLGMEKGVFVNLDMEQYSVKHLTLEVFTELINEPEFKNYKFFGIVIQAYLRDSFEDVKSLTEFAQKRGTPFWVRLVKGAYWDYETIEAEQRGWPVPVYTNKAESDANYELCAKYLLENIKFIRPAFASHNVRTLAACMLYAEKLNIPKEALEFQMLYGMAEPIKKTIVDMGYRMREYAPVGELIPGMAYLVRRLLENTSNESWLRGKFADNKSMAELLKDPAQGLTPTSPVIPKKPGKFYNEPLLDFAVKADREKMLKALAEAKASLPVNVNIVINNKELQSGKIFDRVNPSQSDQIVGKIQMATTEQAEQAMQAAQTAYKTWKNVPCEQRAALVDKLADIMTRDRFKLIATQVLEVGKPWAEADGDIGEAIDFCRYYARHMRELQKPLRVGGLPGELSHYIYKSRGVTAVIAPWNFPLAILAGMVTAAAVAGNTVVMKPAEQSTVVAWGLMKMIQEAGFPQGVINFLPGYGEEVGEYIVNHKYTTTIAFTGSKAVGLHIMNRAAVVQPGQQHVKRCIIEMGGKNAVIIDNDADLDEAVDGVIYSAFGFSGQKCSAASRVIVLDEVYDRFVDRLVETAKSIEIHPAENPKAYMGPVVDKEAYDRILGTIAEAEKNHKLLFKGSVPGGGFFAPPTIFGDVPGDAKLAQAEIFGPVVAVIRAKNLDQALDIANSTEYALTGGVFSRSPANINRVKEELEVGNLYVNRGITGAMVDRHPFGGFKMSGIGSKTGGPDYLKQYMEPACVTENTLRRGFAPAEE

SEQ ID NO: 12106 - protein, 461 aa, Streptococcus thermophilus CNRZ1066
MSIFRKKDVGLSQTEMKRHLTLRDVVLLGIGAMVGTGIFTITGTAASTLAGPALIISVLISAVCVGMSAIFFAEFASRYPSAGGVYGYLYASWGEYPAWMGGWLTMIVFMNAVSSVASGWGAYLKGLLASFGLQLPKAISGPFNPSQGTYIDLLPVLVLVLVTALLLMDSKQVLRLNSLLVVLKFSALAVFILVGLFHLNPDNWANFAPFGFGQIYGGKTGIMAGASLMFFGFLGFESISMTVDEIKEPQKNVPRGIVLALIIVASLYAVVSLVLTGVVHYTKLNVDDAVAYALRYIGVSWAANYVSVVAIMTLITVCISMAYALSRMVYSLARDGFLPQTFQKVSKTHKVPHYATLLTGILSAISSGIFSLANMASLVNISTLAYLVLLAIALIILRKDKGLPQKDEFKVPFVPVLPILSIIVCLSFMSQYSWQTWSAFGIAVLIGSAIYAFYGYKHSKY

SEQ ID NO: 12107 - protein, 350 aa, Corynebacterium efficiens YS-314
MSSGRTVPTRSHGLGKEGASGNNASQVEFGDPALTARIDNAMQQVEDRLLKELSIGEDFLVDKVTHLARAGGKRFRPMFALLASEFGAKPLSDNVIKAAVVVEITHLATLYHDDVMDEATMRRGVPSANSRWDNSVAILAGDILLAHASRIMSQLGMETVAHFAETFGELVTGQMRETVGARGGDPVDHYMKVIREKTAVLIASAGFLGSMHADATPEHVDALKKFGAAVGMIFQIVDDIIDIFSETAESGKTPGTDLREGVFTLPVLYAMREQTEVGAQLREILTGPIEDDDTVDRALELLAQSGGRREALADVHHYMAIANAELDRLPDNSVKDALRNLAIFTVQRVG

SEQ ID NO: 12108 - protein, 341 aa, Streptomyces coelicolor A3(2)
MRIGVLTSGGDCPGLNAVIRSVVHRAVVDHGDEVIGFRDGWKGLLECDYLKLDLDAVGGILARGGTILGSSRVRPEHLRDGVERARGHVEELGLDAIIPIGGEGTLKAARLLSDNGLPIVGVPKTIDNDIAVTDVTFGFDTAVTVATEALDRLKTTAESHQRVLIVEVMGRHTGWIALHSGMAAGAHAVVVPERPFDIDELTAKVGERFSAGKRFAIVVAAEGAKPKAGTMDFDEGGKDVYGHERFAGIARQLSIELEERLGKEARPVILGHVQRGGTPTAYDRVLATRFGWHAVEAVHRGEFGKMTALRGTDIEMVSLADAVESLKTVPDARYAEAECVL

SEQ ID NO: 12109 - protein, 443 aa, Triticum aestivum
  misc_feature (130)..(130): Xaa can be any naturally occurring amino acid
  misc_feature (172)..(172): Xaa can be any naturally occurring amino acid
MASFARQEHQFLAELGLAPRNPGSFACGAWGGSGPVVTTTNPSNNEVIAEVVEASMDDYEKGMSACFDAAKTWMAIPAPKRGEIVRQIGDALRAKLHHLGRLLSLEMGKILPEGIGEVQEIIDMCDYAVXGLSRQLNGSIIPSERPNHMMMEVWNPLGVVGVITAFNFPCAXLGWNACIALVCGNCVVWKGAPTTPLITIAMTKIVASVFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQNIRSQGGKILLGGSAIESEGNFVQPTIVEISPSAPVVREELFGPVLYAMKFQTLKEAIEINNSVPQGLSSSIFTRKPDAIFKWIG

SEQ ID NO: 12110 - protein, 669 aa, Ostreococcus tauri
MRDPIARPTHTRARRTSATTTNATRAIDAGDAARARTSSESEREGEVDAIDFASGETRAMSAEGNAHKRCAAPGMRAYLWRRRRNLTASQHRTIVLLVTFASYAMYHASRKPPSIVKSVLNPDAESRASGARGWAPFDGDDGTRVIGTCDFAFLASYSVGMFFSGHIGDRMDLRKFLTFGMLMSGLWVSLFGMGYYWNVHSVGYYVVVQMVAGAMQSTGWPSVVSVMGNWFGKGKRGLIMGVWNAHTSVGNMLGSILASMALRSSNWGMSFIVPGVMIMLCGLLVWNFLVVSPEDVGLPPANAPSVSSNVEDESDEESVALRRLINSDGSSRADREKPVGFAAALKIPGVITFSLCLFFTKLVAYTFLYWLPFYIERTEINGQYLSAAKAGELSVIFDLGGIVGGILAGYISDRYNARSMTAAAFVYLSIPVLYMYREFGSRSMFTNLILMAFSGMLVNGPYALITTAVSADLGTHESLKGNARALATVTAIIDGTGSFGAAIGPMLTGYITSISEDWNHVFYMLYIADLCAGPCPTRGRVSRVKPHSSSHVASARTRDVRRARCSPAPRRENALGERRRGVQSRARLRCVDECARRSDPSDPSGNGHGVTHEGVTLHEASTAHKALGTGFGALMWFWVFYRFYHDGDTLIYGHAPHFEHDDHDDEHGH

SEQ ID NO: 12111 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILPGGAGTHLFPLTNRAATPAVPLGGCYRLIDIPMSNCINSGVNKIFVLTQFNSASLNRHISRTVFGNGVSFGDGFVEVLAATQTQGETGMKWFQGTADAVRQFSWVFEDAKNKDIDNIVILSGDQLYRMDYMDLVQNHIERNSDITLSCATVGDSRASDFGLVKIDRRGRVVQFCEKPKGTEHKAMQVDTTLLGLPRQDARLNPYIACMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKHVVITNKDGVQESDRPDEGFYIRSGITIIMEKATIRDGTVV

SEQ ID NO: 12112 - protein, 197 aa, Marinobacter sp. ELB17
MAERKARVERNTLETQISVEVNLDGTGKTNFQTGVPFLDHMMDQIARHGMVDLDVVCDGDLHIDDHHTVEDVGITMGQAFAKAVGDKKGIRRYGHAYVPLDEALSRVVLDLSGRPGLHMDVPFTRATVGGFDVDLFAEFFQGFVNHALITLHIDNLKGKNTHHQIETVFKAFGRALRMAIELDDRMAGIMPSTKGTL

SEQ ID NO: 12113 - protein, 193 aa, Saccharomyces cerevisiae
MTEKHKTMGKFKVIVLAGTAGTGKSTIAGELIHEFKDIYPDLKFIEGDDLHPPANVEKMTRGIPLNDDDRWDWLKKVAVESTKAAASTKEHLSIVACSSLKKKYRDLIRHTCPESEFHFIFLYASKIEVLKRLKTRKGHFMKADMMESQFRDLELPDINDETDCDIVPLDFKTFYQIEKDVIQVVKSKVLNIE

SEQ ID NO: 12114 - protein, 424 aa, Helicobacter hepaticus ATCC 51449
MEQTHYFALADTYQTPLYVYDLERITQAFCAIKDAFKARKSLICYALKANSNLSIIHHLAQLGSGADCVSIGEVRRALRAGIPKYKIIFSGVGKQDNEIEEALQSDILFLNVESEEELLRIESIAKKLDKIARISVRVNPNIDAKTHPYISTGLNENKFGVDIEQAKSMYIFAKNAQFLEPIGIHFHIGSQITDLEPIKQSAQKIAQLTHSLLALKIDLKFFDIGGGIGIRYTDESLINPYDYAQAILEALYGLDLTIICEPGRFLVGESGVLLTRVLYEKHNGHKRFVIVDAAMNDLMRPALYRATHQVEYFLKDKRVDSSLESSLCDIVGPICESSDYLAKNIKLPPLQAGDVLVLKNAGAYGYSMASNYNTRPRPAEVALMQGNARLIKHRESFEKMIEDEERLLEDTLEMPLQSEDGENP

SEQ ID NO: 12115 - protein, 520 aa, Cryptococcus neoformans var. grubii
MAPRSSKKALTLCLFQSLAGVIFGWSNSEGSGLFSMSKYQERFGECVDGVCTLSTTRQSAITGLLSVGAVIGAVGSGSIADRFGLRLTCMVFIFIYLCGAAIETSAFNTYGQLCVARLLTGLGVGATSGLVPVFQAEASPPRYRGLVTGSFQLCVTLGIWGVAMTNWGMSSYAGDVSWRIPVSLQMVWAALLLVGFLFSPESPRFLAKKGRWEHCRKNLANLRGLPVDHPDIDTEMEEVREATIKDQERGQASYVECFSTKDRILWRTMIGICVQIGQQITGVNFFFSYGVQFAQTAGLDDTYVFQIILASVNVLFSFPGILAVDRAGRRPILLIGGILMFIGQIVVGAVSKAYPDDKIAGDVLIAFTCLFIASFASSWGPIAWVVCGETFPIRLSSLCVTLGTGANWLFNLIIAFAAPQIQARIGTGITFVWAGCLAISVSFAFFCIPETRSMSIEQVDALYLSHTPAWRSHKFVDEQLARAQNAQEKHYSRSIHAENEQVKSSQQTSARTSAEDDRIV

SEQ ID NO: 12116 - protein, 469 aa, Prosthecochloris aestuarii DSM 271
MEEHDMHTQSDFDLAVIGSGPGGFEAAVRAARKGLTVCVIERGALGGVCVNWGCIPTKALLRSAEIFRLAGESSAFGLDIEASSIDLARAVKRSRKVVLLASKGVESALKKNKVTVFQGEATFVDERTLRVSRDGQEDERLTAKHIIIASGARPREIPVLPVDGRHIMTSREALALKSAPERMIVVGGGAIGLEMAWYYHSAGTKVTVLEMLPRLLPLEDKEVSEGLERLLKKAGISIHCEAAVVSASAGDDGIVDAVVRMKDGSEQKMQGECLLVAAGVVPNSGGLQLDAAGVILERGFIATDAQCRTNVDHIYAIGDVRGGMQLAHKASAEAVIAVESITGGNPMPIDDAMVPRCVYVEPAVAAIGASQEDAAAEGREVMVGRAMFAASGKASAYGFRDGFVKLIFDAGSGVMIGGHVLGHGAVELIGELSLAMRLGATADQIASTIHAHPTLSETVREAAENAVVA

SEQ ID NO: 12117 - protein, 515 aa, Marinobacter sp. ELB17
MTATRTPTALIILDGWGHRDPAEDNAISNANTPFWDSLWQNNPKTLIDTSGMFVGLPSGQMGNSEVGHMNLGAGRVVYQNLTRIDKDLKDGGFQKNPALCKAIDAAVSQGKAVHLIGLLSPGGVHSHERHILAAAELAATRGAKAVYLHAILDGRDMPPRSAKASLENAAASLATLGVARIASVTGRYFAMDRDNRWGRVESAYNVMTLGEAEYTCEDAVTALEQAYERDENDEFVKPTRIQAEGDTTAIINDGDAVLFMNFRADRARELTRTFVDADFDGFKRKKVPQLADFVMLTEYAADIKASCAYPSAQLVNGLGEYLANAGKTQLRISETEKYAHVTFFFNGGREEPFTGEDRILVPSPDVATYDMKPEMSAPEVTDKLVEAIKSDKYDLIICNYANGDMVGHTGKLDAAIKAAECLDACVKRVVEALAEVGGEGLITADHGNCEQMQDPVSGQVHTAHTIGPVPLVYTGPKQIILNDGGALSDVAPTLLALMGAAQPTEMTGHSLAEIG

SEQ ID NO: 12118 - protein, 288 aa, Triticum aestivum
NKFVQKSRPVPVRNSRDIVDPRVRDMGFMALPELGQDKGYLSETVFTCIFLSFLLWSFHPFVYHSKRFYTVLLWRRVLAFLVASQFLRIITFYSTQLPGPNYHCREGSKLATLPPPKNVLEVLLINFPRGVLFPTRPLIFSSHMIFTLVFVRTYHKYGSKRLIKLFAWLMAIIQSLLIIASRKHYTVDVVVAWYTVNLVVFFVDKNLPEMPDRTSGLSLLPVSTKDKSDRMKEELHKPEKDNKMKDEHHKLLNGNTVDSTDRRQWMPMNGKHGEDMNHTLSDAAPNGT

SEQ ID NO: 12119 - protein, 343 aa, Solibacter usitatus Ellin6076
MNALLLTQYMHLEMVEMPVPAIGADDVLVRVRACGICGSDVHGLDGKTGRRIPPLVMGHEAAGEVVETGANVTDLRPGDRVTFDSTVYCGRCFHCTRGEVNLCDNREVLGVSPGPYRRHGAFAEYVSVPRRIMYRLPDSLSYEQAALIEAVSVAVHAVNLTPVRLGDSAVVVGSGMIGLLAMQAAKHAGCTRVIAVDPDEGRLRLAIGAGATDAINPKSTDAAAAIRELTEGRGADLAIECVGATDPIRTAIAGVRKGGAVTLVGNVAPEIEFPLQSVVTRQIRLQGSCASNGEYPACIDMMARGAIRVDELITAVAPLEEGPSWFDRLYRHEPHLMKVILRP

SEQ ID NO: 12120 - protein, 116 aa, Solibacter usitatus Ellin6076
MKNIFVGNLDFAATESSIRSLFEPYGSVDRVNLVTDRDTGRSRGFAFVEMTDAAEADRAIAALNGHELDGRALNINEARPKPQGGGGGGRGFGGGGGGGRPGGGGGGRPPRREPRW

SEQ ID NO: 12121 - protein, 90 aa, Brassica napus
MVRGKLEVLLVSAKGLDDSDFFNSMDPYVILTCRSHEQKSTVASGAGSEPEWNETFVFAVSGDAPELRVKIMDSDALSADDLVGEACIPL

SEQ ID NO: 12122 - protein, 388 aa, Rhodococcus sp. RHA1
MRPESQRSNIQTFHVMDVWKAATERQRTHGDVLTLAAGQPSTPAPQPVLRATREVLDGHLLGYTETFGILPLREAIAGYHSAKSGIDVDAEDVVVTTGSSGAFTLLFLAAFDVGDTVVVARPGYPAYRNTLAALGCTVIEIDCGADTRFQPTVAMLEALPEPPAGLIVASPANPTGTVIDPDELAALARWCDDHGTLLISDEIYHGIGYGEQAMTSSWETSRESVVVGSVSKYFSMTGWRLGWMLVPEGLRRPLQRLASNMTVCPPAISQYAAIAAFTEESRVELDGHVQRYAVNRELLLTGLPELGITDLAPADGAFYVYADIGHLLGGSHGATSTEWCSRLLQDTGLALAPGIDFDTVHGDRTVRLSFAGSTAEVRESLVRLGRWL

SEQ ID NO: 12123 - protein, 454 aa, Bacillus anthracis str. Ames
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRCPEGLTEEQYDDFMIEEFKNFFISEVAPETIAAVVMEPVQGEGGFIVPSKKFAQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTARV

SEQ ID NO: 12124 - protein, 145 aa, Gossypium hirsutum
MAHFQNQYSAPEVTQTDAYGNPTRRTDEYGNPIPTQETGRGILGIGGHHHGGHHGLHRTGSSSSSSSSSEDEGTGKKKKGLKERLKEKIPGNKEHQSQATSTTTPGQGPTYHQQHREERSDGQDQGEAPWSPQPLISCLWSAISY

SEQ ID NO: 12125 - protein, 249 aa, Prochlorococcus marinus str. MIT 9301
MSNTDSLSGKVALITGASRGIGKEIALELSRFGAEVFINYSSSDEKAEEVVNSIKNSGGKAHKLKFDVSREDSVSSAFEEIIKVNGSIDILINNAGITRDGLLMRMKSEQWDDVLNTNLKGVFLCTKYASKFMMKKRSGSIVNISSVVGIIGNPGQANYSAAKAGVIGFTKTCAKEFASRGINVNAIAPGFIETEMTEKLNTEEILKVIPLGKLGSCTQIANLVSFLVSSDAGRYITGQTISIDGGMSI

SEQ ID NO: 12126 - protein, 1074 aa, Shewanella oneidensis MR-1
MPKRTDIKSILILGAGPIVIGQACEFDYSGAQACKALREEGYRVILVNSNPATIMTDPEMADATYIEPIQWEVVRNIIAKERPDAILPTMGGQTALNCALELEAKGVLAEFNVEMIGATADAIDKAEDRSRFDKAMKSIGLECPRAGIAHSMEEAYGVLEQVGFPCIIRPSFTMGGSGGGIAYNKEEFEEICSQGLDLSPTKELLIDESLIGWKEYEMEVVRDRNDNCIIVCSIENFDPMGVHTGDSITVAPAQTLTDKEYQIMRNASMAVLREIGVETGGSNVQFGINPKDGRMVIIEMNPRVSRSSALASKATGFPIAKIAAKLAVGFTLDELMNDITGGRTPASFEPAIDYVVTKVPRFNFEKFAGSNDRLTTQMKSVGEVMAIGRTFQESLQKALRGLEVNRHGLDPITDMSKPEAMARIRLELKEPGCDRIWYIADAMRAGLTLDEIFRLTNIDPWFLVQIEELIKLEGQVAEAGLAGLNEELLRKLKRKGFADARLAVVLGVNESEVRKLRDRFDIHPVYKRVDTCAAEFATDTAYMYSTYEEECEANPSNRDKIMVLGGGPNRIGQGIEFDYCCVHAALALREDGYETIMVNCNPETVSTDYDTSDRLYFEPVTLEDVLEIVRIEKPKGVIVQYGGQTPLKLARALEAAGVPIIGTSPDAIDRAEDRERFQQAIQRLEMKQPENDTVTTVEGAVIAAERIGYPLVVRPSYVLGGRAMEIVYDQQDLLRYFNEAVSVSNASPVLLDHFLDDAIEVDIDAVCDGETVVIGAIMEHIEQAGVHSGDSGCSLPPYTLSQEIQDRMRVQVGKLAMELGVVGLMNVQFAVKNNEIYMIEVNPRAARTVPFVSKATGVPLAKIAARVMAGQSLKAQNFTQEVIPPFYSVKEVVLPFNKFPGVDPLLGPEMRSTGEVMGVGDTFAEAYAKAQLGATSEVPKSGRALLSVRNSDKKRVADLAAKLIELGYQIDATHGTAVILGEAGINPRLVNKVHEGRPHILDRIKNGEYTYIVNTTEGRQAIEDSRQLRRGALRYKVNYTTTMNAAFATCMAHAADDRTNVTSVQELHKRILAK

SEQ ID NO: 12127 - protein, 483 aa, Bacillus anthracis str. Ames
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFEKAVGQLKVGDGFGDGTTVGPLIDENAVSKVQEHIEDAIQKGGTVLYGGQKVAELDGHFMQPTVIGLANDTMLCMNEETFGPVAPVAKFKTVEEVIERANHTPYGLAAYIFTKDISQAFQISEALEYGIIGLNDGLPSVAQAPFGGFKESGIGREGGHFGIEEYLEIKYISLGL

SEQ ID NO: 12128 - protein, 135 aa, Gossypium hirsutum
MAHFQNQYSAPEVTQTDAYGNPTRRTDEYGNPIPTQETGRGILGIGGHHHGGHHGLHRTGSSSSSSSSSEDEGTGKKKKGLKQRLKEKIPGNKEHQSQATSTTTPGQGATYHQQHHEKKGVMDKIKEKLPGHHNP

SEQ ID NO: 12129 - protein, 210 aa, Sabal palmetto
MESFSDCSMDSPLAQRSASDEEVYATVSSAPPKRRAGRTKFRETRHPVYKGVRRRNADKWVCEVREPNKKSRIWLGTFPTAEMAARAHDVAAMALRGRSACLNFADSAWLCPVPRSSSPKDIQRAAMEAAEAFRPQTESDAAESREDAAMAMIAGPSLAATDDPFSMEDGLNFGMQGYLDMAAGLLMEPPPIYADEEVSDGDVSLWSYSI

SEQ ID NO: 12130 - protein, 423 aa, Zea mays
MARPNQTRRPTGAPEAAHVADSAVSSSLCFAHSPRLRPAGSLFLPFLLCAAAADPISHSRVPRYCCSFREIDRFLLLAIGVALAACRPSLRRAACGALLVLLTMGGWNRSLYVTGHRDRSAGASRTPLPPPSPDYGDKHQQVPLWEREFCRHVGDITWEQFCENKQYVGQFHKLEPWDDSAAFDCFQNAKARFWASYHGQPSDIPLLDDPDLYIDKVDHQCEVDPELVADLDSVGLPFESDDNPASAKGWTNAGADNKCTQNGSGNWDAFVEKPAEVSKWDSEANLASNTTWGGQANVATPEAVWRGQSFSKWGNDSNTSRGVPLEKPSWRGCNKNRYTPNSWSSNFHSRPSDNRYQQLEDPSYTSGTGRKWNGGDGGGYVKQRSFKHRNQDQGQHQQPRSGSWQQDQRGRSRQWRPVHSRAP

SEQ ID NO: 12131 - protein, 333 aa, Bdellovibrio bacteriovorus HD100
MMKLTVIPGDGIGPEIMAQVVRVLKHVHAPFEYEEHQAGEVALNSLGELLPQTTIDSINKTKLAIKGPTTTPVGGGHKSINVTMRQKFDLYANVRPVRSLPGVQCVCSDVDLTIVRENTEDLYAGIERMVDEDTAESIKRITRKGSERIARYAYDLAQKTGKPRMAIVHKANIMKLSDGLFLKVAQEVGWQYPEITTKDVIVDNACMQLVTKPQQFDVIVTENLYGDILSDLCAGLVGGLGVVPGANIGANHAIFEAVHGSAPDIAGQNKANPTALLQSAVMMLQHVGENAKADAIMKALIAALSDVNARTGDLGGKGTTVSFTDAIIQRLGH

SEQ ID NO: 12132 - protein, 210 aa, Sabal minor
MESFSDCSMDSPLAQRSASDEEAYATVSSAPPKRRAGRTKFRETRHPVYKGVRRRNADKWVCEVREPNKKSRIWLGTFPTAEMAARAHDVAAMALRGRSACLNFADSAWLCPVPRSSSPKDIQRAAMEAAEAFRPQTESDAAESREDAAMAMIAGPSLAATDDPFSMEDGLNFGMQGYLDMAAGLLMEPPPIYADEEVSDGDVSLWSYSI

SEQ ID NO: 12133 - protein, 84 aa, Brassica napus
MAKKRKRTDAPAEAAGAEKPDDSAPARPERTLFGFKDLVPDAEPASAGAEAAVAPFRNREKVLITCSRRITYRYRHLMQDVLSL
